United States Patent 6,812,339 (POLYMORPHISMS IN KNOWN GENES ASSOCIATED WITH HUMAN DISEASE, METHODS OF DETECTION AND USES THEREOF) - sequence listing, part 32

SEQ ID NO: 13372 - DNA, 21590 bp, Human
ggttcgagcaatcctcctgtctcagcccccctagtagctgggattataggtacccgccaccacaactggctaatttttgtatttttagtagagacggggtttcgccatgttggccaggctggtctcgaactcctgacctcaggtgatccacctgccttggcctcccaaagtgctgggattacaggcttgagccaccacgcccggccaagttaaagggtttttaaacaagagctgggcagtgcaatggcatagctgtaaggcagcagggggtggtggggactgtggtaggtgggaaagcttgtgttccatctaaatggggcagctgctgcttgactgtaggctgtattgctggtcttctaattcttcaagtgaatcaggaattgggattttgtgaagactcacaatttctaaacaaaaagttgaagttttacagatcgtggggctcaagtataactcctcttgggctgtatccagccttgattctgtaatctgtggctcctgcctgtttttcctcggccaggccactcccttcttcccctcacttatatttttcacctggggttggaggctgggtagatggtggaattgatgaggaaccacttttttttttttttttttgagatggagtctcactctgcctctcataatgctgggattacaggcatgagccactgcacctgtcctggccagacatttttgaggccaccaccagacaaaagaggctcctcatcggccaggtgtgatggctcgcctataatcccagcactttgggaggcagaggcaagaggattgcttgaggccaggaattcgagaccagcctaggcaacataatgagacctcatctctccaaaaaaaaaaattagctagacatggtggcatgtacctgtagtctcagctacccaggaggctgaggcatggcttttgtgagctatgattgcaccactgcactccagcctgggtgacagagtaagactccgtctcaaaaaaaaaaaaaaaaaaaaaaaagtctgacctgagtctcttaaggatgaggctctggagcacctagtaaacttggtcccatttgtgtgactcaaagggacatgtccaaagtccaaagtgctgggggcaggggtggggcttaggtagggcatgtgacattcctgaacaggccaagcactgggtgaaactactcaggattcagaagcaggtgggatgggtgggtggaacatgataatcatcccccttctccttcctttccaccctacccttgctcacaactgcaggagctgaggatgggagagaactggggacgagggggccagagtgatttgcagtgttagtaatgcagctggttctatggaaggctcagttccatctgggatccctttatgagcagtggactaggtcttcacattcagcccaggattactaaagcataggaaagaggcagggaacatagacacagctcatgtaaacattccttttgtttatggccgaatcctagccactggactacctgaggcatacagatattctttggctatgggctgacatttgaatacagctggggcctcaggattctctgaaataaagggctgcctccctctggaggagccaggcagctcctcagagcagctgcccattgcgtgctggacaaggccatgtcaccacctccatggctccccagtttcccagcttgctgtatctctccaccgtaagagactgggagcaccttgatctgaagctctttgcagtgccggtggcagtgtagggggaagtagttgatgggagtgagggaaaggaattggcaaggaaccctgggcctctgtggctcactgcatcaagcagttcttggcaaaggtaaggtcaggatgggctgtgtcgtcttgggtggggtgaagacagggagcagtgggcatgcagatgcggacagggaagggtgcagtggcctggctggaggaggtagggccgtatcccacccagagtctgtcaccagattcatgcctgccccaccccaggctccccaggttcatcctgtgtcgtctcccccacctaccagtcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagaggtgggtgtgggggctgggctgtgggggatccttggggatgtgggggcctgtttggctggcatgatggtccttatcctcctccctcttcccaagcaggagtggccctcgcttgggcgatagagaggtttctctctcatttggtgtcctctttggtagtggagacctggtcccaggtcctcacacctcttctcatcttcctgcagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggtacctggtttcctcactccctatgccccaccctacctgtcctccacctgccttgggctctatactgctgccttcttcttctttttttcttttcttttttgaggcagagtttcactcttgtcgcccaggctggagtgcagtggcataatctcggctcactggaagctccacctgggttcaagtgattttcctgcctcagcttcctcagtagctgggattacaggcacccgccaccacgcccggctaatttttgtatttttagtagagacagggtttcaccatgttggccagtctgatctcaaactcccgaccccaggtgatccacctgcctcggcctcccaaagtgctgggattacaggcatgagccactgttcccggcctgtaccgagttctaaagggaaaacaaaccagggcagtgggaggggtggggagagacacttgctggctctcaccaagggtggaattgactcactgtacctccactcacctccagccacccccatcctccacacatgccccaaacacacctgcctcttttctgagaactgttggcccatctcaccttcccaggctccagagcctaccagaagtgcccagccagtctggcattaaatgacatgtgccaaggttaagcagttcattcacccggtgccagacactggtgggcagtgccaaagcagcagtgacaagcccaggccccaggctgtgcctgttctaggagaagccatcacaggcctgaacctacagccaggctcttgtccccgttggcctcaggcctgggcctgagcaggtgggtgtcccaccttcattcctttacctgttcttccacctttaccttctggccatttaatggttttgggttttttgtttgtttgtttgtttgtttttaatagagacggggtttcaccgtgttagccaggatggtcttgatctcctgacctcatgatccgcccgcctcggcctcccaaagtgctgggattacaggcatgagccaccgtgtccagccccatttaatggttttcttactgactttactaaccagtgctgcttgatcctgaaagcataatagcagaacatggggaacttttagagacattcatgtccacttaggtgcagacagtttgggggaagaagtgtgtgtgtagagagaaaatgaagaatgattaagacaataacccttaaggaatccaagtgaaaagtatatagggattcttgtacctttttttttttttttttttttttgagatggagtctcactctgttgcccaggctggagtacagtggcataatctcggctaactggaagctctgcctcccaggttcacgcaattctcctgcctcagcctcccgagtagctgggactacaggcgcccaccaccacacccggctaactttttgtgtttttagtagagatggggtttcaccgtgttagccagggtggtctcgatctcctgacgtcatgatccacctgccttggcctcccaaagtgctgggattacaggcgtgagccaccgcgcctggccttttttttttttttttttactggatctccccctgttgcctagacgagagtgcagtggggtgatcatagctcactgcagcctcaacctcctgggctcaaacgatccttccacctcattctcccaaaatgctgggattgcaggtgtgagccaccaagccctgcctaagctttcattttaaatatgttcagccgggcacagtggctcacgcctgtaatcccagcactttgggaggccaaggtaggcagatcacttgaggtcaggagtttgagaccaggctggccaacatggcgaaaacccatctctactaaacatacaacaattagccaggcgtggtggcatgcgcctgtaatcccagctacttgggaggctgaggcatgagaattacttgaacctgggaggcggagattgcagtgagctgagattgcgccactgcgctccagcctgggtgacagagcaagactctgtctcaaaaaaaaaaaaaaaaattagctgggggtggtgacacacctgtaatcccagccactcaggaggctgagacagaaggatcacatgagcctgggagattgagactgttgtgagccatggttgtaccactgcagtccagcctggatgacataggaagaccccatctccaaaaataaaaaaaagccagctcttcctttgagccccagtttcagttcaaagggccttctctaacttctccttcatctgaactcctgagacagggtcttgctctgctgcccaggctgaagtgcagtggtgcagtcatagctcactgaagccttaacctcctgggctcaagtgatcctcccacctcagcctcccgagtagctgggactacaggtgtgcgccgccaccatgcctggctacacttttttttttttttttttttttttagagatgggatcttgctatgttgcccaggctggttcttgaatgtctgaggtcaagcaatcctcctacctcagtctcccaaagttctgggatgacaggtgtgagccactgtgcccggcctccaccccagtcttatttcaggacatacagagatggatgttgtggacccgcctccagagcatcaggcttggccctggggtcacagcactgatggttctgtgtctccaccttcttccccactaggacatcacacccctgcaggtggttctgcccaacactgccctccatctaaaggcgctgcttgattttgaggataaagatggagacaaggtggtggcaggagatgagtggcttttcgagggacctggtaagttctgtctccatagggctccctgccttcctgtcatagccctgataccttctgaccatcaccttccctccccaggcacgtacatcccccggaaggaagtggaggtcgtggagatcattcaggccaccatcatcaggcagaaccaggctctgcggctcagggcccgcaaggagtgctgggaccgggacggcaaggagagggtgacaggtggggtcaccaaggggcgatgatggtgggtgggcaggaggggtccccactgcaggggaagcaggggaaggttgaggaaagcctcctgtagccccagagaggcgctttcctggtatcttttgaaagctgttgagggccacccactgctcttccttccccacccccgcttcatgctgtttccacttgggctggaaaatgtgaccatgaccatgcggatgtggcttttccttccctcaccttcaccatgagctgtgggcagtggccatgacttacctgattctggatcaacaaagaagatgttcaaatacaattgacaaatgtaggccaataggtacagtggctcacacctgtcatcccagcactttgccaaggtgggtgaatcgtctgagcccaggagcttaagaccagcctgagcaacacagtgagaccccatctctacagagaatttaaaaattagcctggccttggacacacacctgtggtcccagctactcagaaggctgaagggggagaatttcttgagcccaggatgtggaggctgcagtgagctgtgactgcaccactgcactccatcctgggccacagaggtactaccccgaggtgctaccattcccactttttttttttttttgagacggagtcttgctttcttgctgttgcccaggttggagtgcagtggcgcgatctcggctcactgcaagctccgcctcctgggttcacaccattctcctgcctcagcctcctgggtagctgggactacaggcgcccaccaccatgcccagctaatttttttttttttgtattttttttttttttttttttttagtagagacagggtttcaccatgttagccagggtggtcttgatctcctgacctcgtgatccaccaggttcggcctcccaaagtgctgggattacaggcgtgaaccaccgcacccggccattcccactttctatatatcaaaactgggatgcagaatgcaggttgcttgccctggggtgtggccaggcagggcgaggctgggacctgcatccaggcactctggcttctccagtaaaccaaaggacatccacaactctaacagaggcagttctgctgcctgttttagcagaaggacaaaagttggtctttggagcttagagaaggcagaacaggctgttggcatagcagcaacttgggcatcttaggaggccaaggtgggcggatcacttgaggccaggagttccagactagcttgggcaacatggtgaaacaccatctctacaaaaaatacaaatattagccgggcgtggtggcacgtgcctgtaatcccagctactcaggaggctgaggcatgagaatcacttgaatccaggaggctgaggttgcagtgagctgagatcacagcctgggcaacagagggagactccgtctcaaaaaaaaaaaaaaaaaaaaaaaaacttttaaaattcaactggggtgggggtttggcctcaaaagaatgaataagaggaccgcagtcaggaacttgagcctggggtcagtgctatctttttgcctatgaaatctgtcaatcccctgtgtctaagctgtgggggaggggtaggtggggagcaggctggggggcccttgtcccttaccctccactcttggcccaggggaagaatggctggtcaccacagtaggggcgtacctcccagcggtgtttgaggaggttctggatttggtggacgccgtcatccttacggaaaaggttggtgctctgggggctgtggtttaagggacctggggctagggaaccctccgagtggcagagaatggtggtagaatggcatgagagtaaaagagaagcaataattttagggtcacttaaaaaaattcagagatcagattgcctgagtattctggatcatctgaagggttaaatagtctttctggggctgggcgcaatgactcacatctgtaatctcagcaatttggaaggctgaggcaggaggatcacttgaggccaggagtctgagaccagcctgggcaacacagtgagaactcatcgctacaaaaaatttaaaaattagctgggtgtagtggagcatgcctgtaattccagttactccagaggcgctgaggcaggagaatcgcttgaaccccagaggcagaggttacagtgagccatgatcatgccactgtgctccagcctgggcaacagagcgaaaccctgtctcaaaaaaaaaaaaaaaaaacaaagccggtcgggtgcagtggctcatgcctgtaatcctagcattttgggaggctgaggtgggaggatcacctgaggtcaggagttcaagacaaacctggccaacatggcgaaaccccatctctactaaaaatacaaaaattagctgggcatggtgtcacccacctgtaatcccagctgtactcaggaggctgaggcaggagaatcgcttgaacctaggaggcggaagttgcagtgagctgagatcgcacctttgcactctagcctgggcaacaagagagagactccgatttaaaaaaaaaaaaaaacaatccctggattggtagaaattgtctctgagatctgggagcattgggagcatttggtggccaatggggctcgcagatcccctgaagttggaggcaggtcactcaaatacccaacatgttgctctgcagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaaggtgaggtccctacacccccacagaggactgccctgggagatgtatgtcctctagtggcatgaggccctctgccttctctcctccagacgcacgttctaggaacaccttctgtgcctttgcatgcttagttcttacacacctgagacactggcccatttgattcctggcagcctctgacttacccctcagacctgaagttaattccccttctgggaaggcctcctggctacccgctgcctgagactctgaaactctgatacagtcatgcgccacttaatgatggggatacattctgagaaatagtccttagatgattttgtctttgtgcaaaagagtgcacttatgcaaacctagatggcacctagtctagatggcgtagcctgcccctaggctgccaacctgtgcagcatgtgactgtcctgaatactgcaggcagctgaacacaatggcaagtacttgtgtatctagccatagaaaaggtaaggtaaaaatacaatataaaagcttcgttataggccagcacagtggctcatacgtgtaatcccagcactttgggaggccgaggcaggtggatcacttgaggtcaggagttcgagactagcctggccaacgtggggaaaccctgtctctactaaaaatacaaaaattagccaggtgtggtggcacacacctgtaattccagttactcgggaggctgaggcacgagaatcacttgaaccctggagatcaagcctgtggtgagccgagatcgtgccactgcactctagcctgggcgatagagtgagactctcagaaaaaaaaaaaatctccattataatcttacgggaccaccatgtgcagtctgtaatggactgaactatcatgcagtgactatatttcacatctttaatatcctggtgttcactttgctttgtcatcttttgtaaaataaacctcttggtttaccctctcccaccccctacttcatcccctctctgaactatatgtgggaataccagcagttgccaaactcattctgtaaagggggctggatggtagatactccaggctccgtgagtcattgtttctgtggaagttcttcaactctgctgttatgtcaggaaagcagcttgggcactacgtaaacaagtgagtactgccatgctcctggaatagtttatctgcaaaaacaggaggcagaaaaagtagaaataggccaggcatggtggcttacatgtgtaatcccagcactttacgagtccaaagcgggtggatcgcttgaggtcaggagttagaaaccatcctggccaacatggcaaaaccctttctctactaaaaatacaaaaaaattagctgggcatggtgtcaggcacctgtaatcccagcttctctggaggctgaggcaggagaattgcttgaacccgggaggcggaggttgcagtgagccgagatcacaccactgcactccagcctgggtgacagagcaagactgtctcaaaaaaaaaaaaaaattagaaataacccaaatgtacatatataatgaatggataaaaaattgtagcatatccatacaatggaatatcattcagccataagaaagaaatggcaggccaggcgcaacagctcatgactataatcccagtgctttgggaggccgaggcaggaggattgcttgaagccaggagtttgagaccagcctgggtaacatagtgagaccccatttttacaaaaacttttaaaaattgaccaggcatggtggcacacctgtagtcccagctatttgggaggctaaagtgggaaaatcgcttgaccccaggaagtggagtgtatagtgagctatgattgtgccactgtactccagcctgaggcagtagagtgagatcctgtctctaggaaaaacaaaaaataatgacatacgtgctacaacatggataaaattgaaaatgttatgctaagtgaaagaagccagctggacgcagtggctcacgcctgtaatcctaacactttaggaggctgaggtgggcacatcacctgaggtcaggagttcaagaccagcctggccaacatggtgaagccccgtctctgttaaaatacaaaaattagctagcatgatggcgggtgcctgtaatcccagctactgctcgggaggctgagacaggagaatctcttgaacctggaagacagtagttgcagtgagccgagatcccaccactgcactccagcctgggctgctgagccgagactccatctcaaaaaaagaaaaagaaaaaagccagacatcaaagaccacatattgcatgattccatttatgtgaaatgtccagaataggtaaacacataaagaaaatagactagtggtgggtggggtaggtggggagtggcagtaacttctaggtacaggatttcttttcagggtgatgacgaaaatactctagacttaacatagcagtgatggttggacaactttgagtatactaaaacaactgaattgtgaattgtatactctagatgggaaaatttcatatgtggattatatctcaaaatttttttaagaaacaggcggtgctgggcgtggtggctcacatctataatcccagcactttggaaagctgaggtgggtagatcgcttgagtctaggactttgagaccagcttaggcagcatggcaacaccccatcatctacgaagcacacaaaaattagctgggtgtggtgatgcgcatctgtagtcccagctccttgggaggctgaggtgggaggattgcttgagcctggaaggttgaggctgcagagagctgagatcatgccactgcactatccagcctgggcaagagaggaagactatctcaaaaaaaaaaaaaaaaaaaaaaaaaggcagaatccagatttggcctgaaaaccagagtttgtcaagccctaggttacaccatctctagaaaacaaagcctgggagaaagaagaaaaaacaggttgatttttaatggtttagcttgcgtggatccaggtcctgacagttatggaatctttcaaggacacatttgaccagatgagatttggcaggcgtttgtgtagagcctcacagtccagacagtgcctcaccgtattatgatgtgggggtgggggcgggcttctggtgctcttgtcctccacacaggcctgaaacagcacaggactggggaggtaccattggaagcacccgcaaccctaaaggcactgaccctaacctcacgtctccccactagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtaatggctgggagtgagcagcagtgctgccacgtggccttggccttggtggcggcttcctctgggtgtgtggaagaggtgggcagggacttcagcagcatggagagccatatcaggtgggctgtctggttgggggagggcactacgtggagtgtttgccatccttctgccttaaatgtctcatttgaaatgttagaaccaaccaggtgcggtagctcacatctgtaatctcagcactttgggaggccgaggcgggcggatcacctgaggtcaggagttcaagactagcctggccaacatgggaaaccctgtctctactaaaagtacaaacattagtcaggcgtggtggtggtctgagtagtcccagatacttgggaggctgagacaggagaattgcttgaactgggaagcggaggttgcagtgagccgagatcacaccactgcacttcagccagggtgacagagtgagactctgtcaaaaaaaaatattagcatgtccactgagaggacaagtgggggtttaggacagggaccctttcccacagcagacctggtttccagcataaaggtctgatggggtggccagggaacaggaaggacctcctccctcatgcccatatcccggtggaatctttcatttttttctgcttcacctaaaaccttgaccttgatttgacctcgggccacatctccaaccttctctaagaatccaagctggaagtccagcttggaatccgagggagcatccgtgtacacagcctacttcaccatccccgaggtgccctccaaactgccccatgaaggaagattctagaaataacattgagcaccttctctatgccaagagctgtttgagctagacatgtgaagatgtcattcacccctagaccctgcaaggtagccaccgtcaagtccacttgacacatgaggaaactgaagcccaaggggtgaggtagttagcccacgatgacagggccagcagatggcaaacccggggtggagcctggcctccccgtagagaaggtgtttaacctcgtggcgcgccttccctggatgggctctgctttgggacagctgggcggatcttcctcccttccacccttacgggcagcttccctccctgtcctcgtcccaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccggtgagtgctggcagcgcagggtgtagggggtggctctccatgggtctggctctgaccctcggctgtctctgcagcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggtaaaaatggggacagggcatgggggtgcattcctggaatcccagcactttgggaggctgaggtgggaggatcacttgagcctaggaggtccaggctgcagtgagccttgatggccccactatactccagcctgggtgacagagcaagaccctgtttctttgttttttgtttttttagttttttggttttttggttttttggttttttttgagaccgagtttcactcttgttgcccaggctggagtgcaatggcgcgatcttggctcactgcaacccccacctcccggattcaagcgagtctcctgcctcaacctcccaagtggctaggattacaggcatgtgccaccatgcccagctagttttgtatttttagtagagatggggtttctccatgttggtcaggctggtctcgaactcctgacctcaggtgatccgcctgcctcggcttcccaaagtgctgggattacaggcatgagccactgcacccggtcaaccctgtttcaaaacaaaaaaaacaaaccgggtggcaagcagtgggtgagggttcctgctgggtgcagcctaggaaccccaagaaaaggagggtcctgctcaagtgctggtgctgggctcctcatgaaggcaggacacctcattcagtgctgaggtcaagagggaacctaggagttcacgcaaatccagggaaggcgtgggctcacctcctggggtcaggactcagggatccagtagcaggacactaccccaactaagctcccagtgagcgtgcagccaaatgcgtaactgtcgggctgttaaaagatgcatgggacacagctggcgggagtgggcagtgcaagggggcggtgagaactcaagttcagaaactgactgccctggcctgcgcccccgccctgctgtttgcagcctgtggacctggggaagggacagggtgctttcctcagtttccccatctgtaacatgaggaagacagcattttctccttcacaaggccattgaaaagatgcaatgagtgttagaacagtgcctctattggtcagagctcaatagcagctattaggattgggtgagataagtcatgtacagaaacagtgttcatgactgggtactgtggctcacacctgtgatcccagcactttgggaggctgtggcaggaggattgcttgaggccaggagtttgagaccaggctgggcaacataacaagactctgtttcaaaaaaaaaaaatttataaactagctgggcatggtggtacatgtctatagacccaactacttggaaggctgaggtgggaaaattgcctgagcccaggaatttgaggctgcagcaagctatgattgtgccaccacactccagcctggacaacagagacccacagagaccctgtctcggaggaagggaggaagggaggaagggaggaagggaggaagggagggagggagggagggagggaggaagggaggaagggagggagggagggagggaggaagggagggagggaggaagggagggagggaggaagggagggagggagggtcaggcgtggtggctcatgcctgtaatcacagcactttgggagactgaggcaggcagatcacttgaggtcaggagtttgagaccagcctggccaacatggtgaatccctgtctctactaaaaatacaaaaattagccaggcctggttgtgggcacctgtagtcccagcttgtagtcccagctactcaagaggctgaggcaggagaatctcttgaatccgggaggcggaggttgcagtgaacccagatcgagccactgcactccagcctgggcgacggagcaagactgtctccaaaaagaatattcaatactcccaagcatgtccctcacctcttagctgagagcagccagtgccctgatggcggcagacagctgccgacatattcccagggctgccgacatattcccaggcactacaacatcatagttaagagcacaggccccagaagcagctgcctggttcagctttctggcttgtcacatgttatatggcaagtcttgggccagccacttgacttccctggacctctacttcctcatctgtaaaatgggggtggtgatcattgccatctcatagggtggctgagtgggattaaaggagaacgtgtgttaagtttttaggaccttaccaggcatacattagcattctctattgcgagagaccctgcccggccacacaggatgggtgttgaagttcttctcggagagagttgctggctgggcgtgatcacacatgtagtcccagcactttgggaggctgaggttggggggttgcctgagcccaggagttcaagaccagcctgggcaacatggcaagaccttgtctcttctaaagagagattcctgggtgaaagcagcttccccattctgggcctgtttgttcacaggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagtaagtgaggctgggagctcggctgcctataatgcccatggcaggccactgctgggaactggataacctggcatcccttgtggactgcctgctgccatccctaccctcaaagatctattccctacccaacagatcaggtgacccacttaaaatgtgaatcaggctgggcgcggtggctcatgcccgtaatcccagcactgtgagaggctgaggcaggaagatcacttgaagccaggagtttgaggctgcagtgagccatgattgcgccactgcactccagcctgggcaacaggcctgggagactgaccctgtctcaaaagaaaaaaaaaaaaaaaaagcacgtatcagatgtggctcctgcagcctcccatcttgcatgtgataaaacctaaactccttcctgcagctccagccggcctcccccgatttgccttctagcctcccccttccatgctcctcgtccctggaacatgttccagctgacatgttccagccccactggcttcctctgctccttcaatgcacagcttggacccacctgaaggccttttgcaatggctattcctgctgcccagaaagcttccccccgcccctgagctcccttccaggcaggcttctccttctggcttcagcccaaagatcccctccttggggaacacttttctttctctcacagctgaatagcaccctctttgcctggtctctcccacacttgtcactgtctgaaatcctccttgtatacttgttcttttcccactcaagtggcgtgaaagtagggggccgcagtcacgcctgcatttgtccggcctagaatgacactggcttgtggcgcgtataccattctgggttgagttgcgtattgggtgccttctaggggctggggtctgtcctgggcaccggtttggttggtggccgctgcccttggcgctcctgttcctgctctggccccatgccagcctctcacctgcgctccgtctcctccaggcatgaggctcagagactggagcaggaagcccgcggccggcttgagcggcagaagatcctggaccagtcagaagccgagaaagctcgcaaggaacttttggagctggaggctctgaggtgggttgagaactagaggaggagactggcaggggccgagggtcttaggacagcagctggtgtgggcagcaggcctgggtggggtgtcgatgagacagtgcacggctacagcataagccaaggccgtggggggactgggctgtctcccgggtcttacctgactctgccttctccccagcatggccgtggagagcaccgggactgccaaggcggaggccgagtcccgtgcggaggcagcccggattgagggagaagggtccgtgctgcaggccaagctaaaagcacaggccttggccattgaaacggtgagtggggggaggcattaagaagagggtggccttgagtcctggaaaaggcccattccctacagtccctgagactgtataggacaccaggtcccccaacataaagccctatccaagtactttgcatttgcaaagtcctttgccttgtaggattcattgactccattgctggaaggtaaggattagaacacccattttgcagctgggcgctcatgcactggccaccttggcacaagtgctgtgtatgcttcataggcattatcttatttaatgcttgaaatcccattaagaggccgggtgcagtggctcacgcctgtaatcctagcactttgggaggccgaggcgggtggatcacctgaggtcaggagttcaagaccagcttggccaacatggtgaaaccccatctctactgaaaatacaaaaaattagctgggtatggtggcatgtgtctgtaaccccaactacttggtaggctgaggcaggagaattgcttgaacccaggaggtgtggaggctgcggtgagctgaggttgtgccactacactccagcctgggcaacaagagtgaaactccatctcaaaaataaagtaaataaaaataaatgtaaaaagaggcctagtgtggtgcctcaggtctctaaccccagcactttggaaagctgagatgggaggatcatttgaggtcagttcgagaccagttcaagactagcctgggcaacatagcaagacctcatctctacaaaaacaaaattttttaattgactgggtgtggtggcacatgcctgtagtcccagctacccaggaggctgaggcaggaggatcctttgagccaggagttcaaggctgcagtgagtcctgatctgcattccagcctgggtcaaaaaataaagaatgattgatttttcctcttccaggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtgagagttggggaaggtgtgttggtttcaggaccaaccttgaaaccaggaaggcagagccaaggcggaaaacacaacatctggaaagattgtggggaagggaggggtgagtgacctgacccacgatgcagggacattcacacagtgtcacgctgcatcaacgtcaggcactgtactagacccagcagtgagccagagctccggaggagacaggaaatggatgggacgccagtctgacaggcatttccaaggcagtcaagcagggtggtcagatgcaggggaggtgacccttcaaaccagctgacttaaggagggtcactctgaagtggccagggtttgacgcccatctcaacttcctcctgttctcaccctccaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaacacttttctcttgtctgacattggttggggttaccagggagcttaatggtggggaggggaggtgcccctggcatctttttttttttttcgagctggagtcttgctctgtcacccaggctggagtgcagtggtgtgatctctgctcactgtaacctccacctcccaggttcaagtgattctcctgcctcagcctcctgagtagctgggattacaggcacgtgccaccacgcccagctaatttttgtattttttagtagagatggggtttcaccatgttggccaggctggtctcgaactcccaacctcaggtgatctacctgcctcggcctcccaaagtgctgggattacaggtgtgagccactgtgcccggtcaacatctttagatagttacaggagactcttctcctccataaaggggagaggaccccgaggcaggggaaggatgagctggaagtcacccagtaggaatgtggccccaaagccttgtgcactgggcttcctagagcccagataggggtgatgatgccacgggtgggggcatggggcccacaatggcaacatctcaccactggttctccaggagcccagctgcctggtagctctcagctgttgcagatgcaacccagcttcccattcgggaggcgccctccagcgccacctgctggagcacccacagcaccagcagacgtgtcaggcttgcacccggtgctgtgcgcttgtcccttcccaggtgggggtgtcaggttggggaggaggaccctgcctagggcagtaggaattgggcatctccttgagcttccggtctgggctgtttgggagcactgaaggaggagtgcccttatcccaccttctcccccacaaccagtatggggtcctcatttgagagaaggatccaggtgcagtcagcctgggtgcactagccctttggggccaggaacagttgtaggtgccaggcctgccccgtctctgccgaggaagtaaaaagatcccaggggccgagtgcaagagcttaggcctgtaaccccagcaccttgggaggccaaggcacaaggatcacttgagactaggagttcgagaccagcctgggcaacatagcaagacccccatctctaccaaaaaaaaaaaaaaaaaagcaaaagccagatgttatggcatgcatccgtgttcccagctactcggggggctaaggtgagaggattgcctaagcccagaagttggaggcagcagtgagctatgatcataccactgcagtccagcctgggtgacagagggagaccctgtctctataaaaaaaaacaaaacaaacaaaacccttaaagcctccctaaagccctcattttcaccttcctgtaatattgagtggaaaaagcccgatccccccttaaaccacctccctccctctctgccctgcccctgaccgttgctgcaggaggaacaccccacggagctgactgatcttattttaaactcatgggaacaaattttgagggaggtgcagcttctctgactgtgctgctctgtcttgtgtgcgatccgctttgagacaaccattcacaccacctctcctctcagcctcctacacccctgcccactttctctcacctctttgagaaaatagaagcaaattgggtaggaaggcccttcccagcaacaaacctaacaaactgctggcatctagactgtcctccctcctcttcccaccctgggctcctccccttgggctctaggagagagggctgcattccttcactgattgccgtcctctcctgtgctgtcaatttttttttcttttttttttttttcttgagactgagtctcgctctgtcacccaggttggagtgcagtggcgtgatctcagctcactgcaacctctgcctcctggattcaagtgattctcctgcctcagcctcccgagttgctgggactacagtcatgcaccaccatgccctgctaatttttgtatttttggtagacatggggttttgc

SEQ ID NO: 13373 - DNA, 21590 bp, Human; identical to SEQ ID NO: 13372

SEQ ID NO: 13374 - DNA, 16914 bp, Human
ggccgaaaatgtgctcaagctaaaaaacctacagttccatcatcgtttgccaagacaggagtgaccaatgagatataaacagaagtagttgggttggacttctaacaaagctttataacagagccgactcagttcgcagatgtcgtttcttgtccctgccccttcctctttcttcttatccagactcagagatgatgattggaggagcagtagacatcttgtgcctatgaggtggctttcgggctagcagaacagaaggatgggagtccagatgtctgaagacatcatggagccactataatatttctgaactacttgtgttaagtgagaaaaaaagttcctaccttattcaagtcactattacttttgcatcctttgtgttactagccaggtgtaattattgataaagcctaaatcacctctggttttccccctcctacctcaaacttcacccagctccaatccaccctccacctggccaccagggagcttcctcacacacaaatctgataccgaccctgtcctgctttgaagccttcaatggctttccagcacccctagacaaaatccacattctttagtatgacatttgggatgctgcacacccaggcctgagctgagctgtatctcctgcctcaaccccagacaccctgtgctccagccactccacacttttcaacattcctgtctataccactcctcaatatccacaatcctgtaacttgaagtgttctaggtgctgagctcctgcttgtcattcgatacctatctgcaaagccacctcccacaggaagtcttccccggtgtcctcagagtaagttactgactcctatggacttctaagaccagctctttgtaaaatatctctgatctgtggcacttaccgcacagtattataatcacttattgttttaattagtctccccaccttgactgggagcacttcaaggcggacagagccttgttggtctgtttatccccagctattagcaaatcctgaatgaaggagtgaatagacaggtaaatggaagcacagaccctgacccctgaggattcagagttgccatccttcatgctgctggagcccaggggaaggctgagttagaagagggcacagaaaaaccgagcaggtatctaagagaggtgcaccccactgatgcatgtggagtgtctgggacccaagaaaatcctggaagctgtcactagggcagggtgaagggtagcacgaacatggacttcatgttccccccaccgggcatatcccagtgcaggctccagacggcagacgaggggcagccccacagcagcttcctctccctgtttcatccccagcctggccccacaccacagtccatcaactcctgctccaggtggaaacctcagaaacccacaaagctcggacctgctccaggtcaccaagcagcagggccaggcactggcaatccaacgagaagccccactacatcgcattccagctcctgaagccattccctgggtaggagagccctgattgttattatcatctctccattttacagatggggacagagtggcctagagaggtgaagtgtgccaaaggtcacacagccagccagaggcagaggagggactaaccccacttccctccacgggcagtgcaccccaaaggagccaaaatgctgacagcagtggggcaaattccaggggccccggagcgaccgccgagttggccacagccacacgatgcataggaaacgctaggccctctgcaccctctcctgaggcccagtgccctgaggcagccccctttaaggagcgatcggccttccagaagagctccagtcttaattttagcttggaggcctgccacaggaggctttagagagaggcaggctgaagttatgtgggacagctgtcagccggcatgctgggtggggcctatttagctggcagggacataagtctggggacactgaattggtctctctgccccaagtattttcagccccagccggccacacagctcggatctcctcctgtggatccccccagctctgcgatgatggcagaagagcacacagatctcgaggcccagatcgtcaaggatatccactgcaaggagattgacctggtgaaccgagaccccaagaacattaacgaggacatagtcaaggtaggctctgcaggcctgcctcggcgggcggagagtgtcaggtttgcgagacgtgggcgcttggcaggggagggtatctgctgcagacacagtttccctgaaaagagacttgttgctctgttgtctctgtatcacccccccaaccccaccccacccccaaaaaaaggcttctaaatcaccgaaggatctttagcaaaatcaagagcaaaaaattagcctcatctccatgacctaagtgctaatcagggcaggaggagcgagtcacaaagaaaatccctccttactactgtgacgctcctgccactcactcctggctctcaccctgggaggaacaggaacgggcggccaagttgggctcctttctgtgccaaggggcatttctgcggtctctccagtgggtgcagggttaatccccagagggcagcttccagcagggccggcagcccctcgaggtacactcactcccccagagcactgcccaatatctgtccccaaggccgagggccatgcccagccctcccctagctaccccctcaccccaggtctagtggccaggacagggcagacggcacccgggaccctcgaagagaaagctcggggttgtctagccctcagggagtctctcagcgtctgaagttgggcctcttccctcgcctcctggtgacactagcggccctgctgcctccaggcccacaccttcaatccaacttccagccagtacccagagggatctttcttttttctttttgagacagtctctctctgtccccaaggctggagtgcagtcgcacactcacgcctcactgcagcctcaacctcccaggctcaagtgattctccctcctccacctcctgattagctgggaccacaggcgagtgccaccatgcccagctaatttttgtatttttagtagagactgggtttcattatgttgaccaagctggtatcaaactcttgggctcaagtgatcctcctgcctcccaaagtgctgggattacaggtgcaagactccacaactggctcagaggtacctttctaaagcagaattcctccaagaagggtccccagccaccagcatctgagtcactggaggggctgttaagaggccagtgtctgaggcctctcagatcctactgaaagcattggaatctcaggccagtgctgtccaatagggatactgttaccacaaggaatttaaaattttctagcagccacattttaaaatgcgaaagcaaacaggtgaaattaatgttcctgatatttcttacttaaccctatatatctaaaatagtattatttcaacatgtaagcaatataaaacaattatcaatgagctattgtacagtcttcaagtttgaaatccagtgtgcttcctatacccacagtatatttcagttcagaccccacattttcatccgaaatgcttgttctgcatttagatttcataaaatgtacatgtgaaaatcgattcgcatgcctgtactgtttcaaacattctgcaaaaatttttcaataatgaaatcggggtttacattttaattaaagttaaacaaaatctagaattcttcagtttcactagccacatttcaagcgctcaaagctcctggccactggatcagacaggcctgtattgcggtctttcagtggggcacctcccatgctggagaagcctagcctctccacgtggctgtccaaacccaacacaatctggccccaacctgcttcttctgcctggttggctcccacctgccagcccacccaccagagtacattcctgtgccattgccagaagtgcctgtcctctcttctccaggtggtgaatgcctcactcagccttcaaggcccaactcaaatgcaacctcctccagaaagccttccctgactcctccaggcaattagttgctcccacttctgtccccctgcttcactcagggcattcctccaccacagctcttcttatactggatattatatttctatacatcgttagtgatggagatagagtatacagtatagcacagtgtgaaagctgaaatgaggaaaattaggaaacaaatttcacaaactgtaaagcactatatacatgtaaataaaattgtacctgtaaaatattattagttatggtttccatcagtgtcatctagcaggaatagtcctggacttgactttaatagacttgatttcaaatccagtccattttacctaaaaatgataacactggacaaaccaactaggttttctgagactcagtttcccctgtaaagtgggaataatatcatttcccaatttacctccaccaggtaaacgaatctcaaagcagcactgtgcgttagaaatatagcatgaggattgaatgagatgaagggtttgaaagtgtctatcacagtccctggcacccagcaaggatgagacagtgtgagtcaaagaagggtctcaaagagcttgcagtctagagggcaagagagctaagccaggagcctgcgtcatgcccaggtagccatctggtacacccaggtgggctgcagggagatgggaaagaggatcccacgggagaacatggtttctaaagggcacccacaatggctggtaagtacagagggagcccttggatccctctgagccaggagggagccagctccaagccgcaggcctggattatgacgcagagggagcggcgggggcggcggcacaggtgcagcggctttacgcagccctcctggggctgagagctgtcctctcctggaggccctgagccctagcaaaaatagcaaaggctaagaaaggatgccgcaaataattttgtccagaggaggtggttatttggtatgttttggacattctctgctttagggatttgtttgactttttctttcttttatttttagtgagtgagaaatgaaaaaagttaatgcagaacaaggatcataaagcagactcagatatagatcacaaacaggtttaggtagatttcaggtctctgttacagtctgttaaagaataaagaaaagaaagaaggagagaggggactgtggctaggagggatgaagccagactgttcagcctctcaactgcccgggttttgccatcgatggaggaaaagagagatgggaaggaaaagggaatgagggagacagagagagatggagaaactggacagagactgagaggaaggtgcaggaggccctggcagtgccccaggtggcaggtggcagggtggcctcacaggtggtagcaggtttctcatgggctaggatgagtgacacggaaagaatgctggaataggacctggctacagactcaagttctggtccaagacctgacagtaacttgctgtgtgactctgaggaaatcctttgccctctctggtcccaagtccctggtgccaccagtcacggccgtttcacatttaaaaaagccaaggatgaagagtaggagataggcatactacatccatggatttgacccccagtagaggggaggcacccctttttggccctgcctttaaacccaggcagccaagaacagaggaagagccctgtatactccaacagacttcagctgtggtctccaaggctcgggactgggcccagggcagtgtagaaggtcatggagattgtagctgaggaactggggggagcacacccccatttctgttgccacttgccctcctcaccaacactgattccacaaatcgcaactgaatgcctgttcagcacaggcaatgtgctgtcccagaggacgtagtgatgagcaggacagcctcactgcatgcaaaccctccaggctgcaggggtgggaatgtctgccaaaggtccccagggctctcagctcaccagcaggtacacccaaggttgcctcaaccttcagacccaggttggaaaggtcctagccccactacaggtatacctcagcacctcagagccaccccacagtgcctccaagttatttccaagagggcttagggccacctcactgacagcatgctctctctctctgctctctcttctctctctctcctctttcttctctctctctctctcctctgtcttctctctctctctctctcctctctctctctcttctctctctatctccctttcttgactcacacataggcccccagggccctaaagcagtgatgcttgaacctgagagttatgcaggtatcccagcttctgcagtcaactcctccctcttgagcttctcccaagttgcccttcaagcaggggaaggagatagataggatcccagcctctccatgatactactccccaaccccctccacccacatctgccacagaacgcctgccttcttcagaaaaacaaacacccatttgccccccggctcaggctacacaacacccagaggaaccagatgcccaccagccctacaaacacttgttccaggtttgtgctcatcagggacaccctgttgcacaaagaagaaactgacctggtacctcccttggcggggaatccattcctggggagaagatgagaggagaacaatgagaacatacaggagaaggagctgaacaccgtaaatgagtgccaggttaggtgtcatgggaggttaggagaggaagaattactttcatctggaaaaatcagaagccagctatatggacaggtggtatccatggtgcatcataaaaatgagaaaaattaaaaatgtgaaatggaggaacaaagctttccaagaagaaatggaataagcaaaggctttcccaacactgggaagaatgttgggcagagttggcaaacgtaagaggctgtcattaccactgccccttccagtgttcatggcagacatgacaatggatcacagcactgctccatgactaatggatcacagcactgctccatggaagccatgcaccatcagctagtcatagtgggtacaacagataacacttcgctgctctgtctgcagaagaataatgaactatcgaagaggattaggacagaggatctgaaagggaatttgtgggagagaaggcaggaagggcaggttgaaactaaataatagagggtcatccaatccacctgtcattccatattggcaattccttccttttggaaatgtcttgccctctgtcaatgacctctaagaagagctgcatcagactaattcacactgaggtattacaacttagtgttatgaggactcctgggtatcaactgatctagagtttttcaaaatgcagtccactttcccagggtccagtggtgggggcacttactaaactgcagattccttggccttgcccccagaagttcttattcagctgagctggtgaatgtttacactttaatgtttgagcataaaagtttcatgctcaggccaggcacggtggctcacacctgtaatcccagcattttaggaggccaaggcaggtggatcacctgaggtcaggagttcaaaacctgaccaggccaacatgatgaaaacctgtctctactaaaaatacaaaaaaaaaaaagagccaggtgtagtggtgggtgcctgtaatcccagctactcaggaggctgaggcaggagaattgcttgaacccaggaggcagaggttgccatgagccgagatcgcaccactgtattccagcctggataacaagagcaaaattccttctccaaaaaaaaaaaaaaagagtttcacgctcaaacttgtcagcttgtcagcaaccaagtcccattcatcctatagaagacacctggagcccagagttatcccttgttttccctaaagacagactgtatcagttatcaattgtgagtaacaaatcattccaaaacttaatggcttaaggaaacaaccatttttttatttctcacagttctgtgggtgggcagggctcagcttggcagtcctgctggtcccactgggggcctctcatgcagctacagtcagatggtggctgaggctgcaatcacctgggggctccaccgagctagaacatccaagatggttcactcatagccctggaggactggcagagatggctgggaggcacagctgagctgtggtgctggggtggctggccctctatctccatgtagtttcaggcctccttattcacatggcctctccattagtctctcgagcagcattcagcagtgcatttctaattctgctagtctccagagcagagtataaaagtggacttctaacatgggggctcagtgctcctaaaagcagaaggtgctaggctttctgaaggcttagttctagaactggcacaacatcctttctgccacattcttgtggttaaagtgagtcacagggcaagcccagactcaagatgggatgagactacctgaggacaaacaccgagaagcatgactaatggagggtcatctttggagaccagcaaaccacccactgaaagctcgtgcacagccaagcccagagctccacccagggtacttctattcctccctattccaatatgcaccaaatttcttgaaggcagagattgagagagcagaagagcggatgggaagggacaggcagtgaggcaaagatcagggcttagtggattgctgaggagcttcttctggcaggttcttctctctctgtctctctccttgcagccctctgttatctcagtctcttcccagctcctttacataaaaccaagtcctgttatgccccagcccaggtgtcctaggtcccttaaggtagacctggagctgaaaagagaggctggagggaactaggatgggggtagatatatggtcctacctaggatgctctcaactcctagagcaccctcctgaaggaggagtcacagatgttctcaactccaagctccagatgatgcctggccacctcctccacccatcagagccagcctatgctgtgttctggcctcaggccctgctggggtatctggccccttcaatcaccctgctgtcaggctgacctgagcgtcactctgccagtcccttacgtgccatgtgaaataacacatgtaagatacatggccccaaactgacatgcataaagggccatatacatcgtgggtgttaccatggttatcccagattgtacacagttgtattcttttgttgctaccttttataacaaaagatgcagagctttgtcatttttacagtttttgcagctatcacctcattttacttcctactttgtaggccagtgcctctaaaactgagtgaaggaccagttttaatattattattctaatccactgcacagctatacttttgcaaaacgcaacaaaaattaatcactggaaaaatgaaatgaaaacagccgtacagttacaagcaccaatgtttattgttagattcaataaacataaaattactgcatcaaatttctatgaatatttctaagcactctcaacttctataattaccttgttgggagacaggacacactgattgtgaactgccttttaagtagcaaggtaataggggaggaagctgggatctggcaaaagctaagcctctcacttgggttttctgactctgaagctaactccgtgtcattacagatcttggcccaatcgtctctgtgtagagttgaaaaaagaaaacaaacaaacaaaaaacctaggatctcagagagggaaagtaccatgccccaaatcatacagtaactcaatggccagtggatactgggaccatatacctccccaccctgctaagagctatttccccacccacagatatcctatttgaattgtccaaggtcctggatgcctacggactgagtcatgcaggactctgggggaggtattttcgaccccgggtgactgttgtcctcccccgcatcctcaagcaatcccccgccctgctatcctacaccttccccgccctctcagagactgcggggactgcgctggctggtttcaattaatcaactgggtctcttgctgttccaaaaataaatatgccacagaaggggacaccgacagaatgtgcaccatcgttcccccttcctcaccctccagcccctctctccaactgcacacagtgtcctgagcctcagcacgcagatgcaggctttcagcccaccaccctccaagaaaaagccatctcctctcttctggaaaggaattaagaaatgaagtcaccgtatgcttgtgctgcatggtacagctgcctagagctgcctgagccgggccttataaatatctccccaaactagcatgctgtggccaaagctctctcaatgctcaaatctgagctaggggaacagctgcctcctccaagcccagcccagccctctgagagcatgttttctgagattcacagaaaatagagcacttgccccacacacagcacccaaaggcaatccctggaaataattcaaatgttagcaccaatggcttctgcaaacaccaaaaaaaaaaaaaaagaagaagaagaagaagaaagataattaaaagacacatacagaagccattggcggtaggattattactgtaagtactgtacttactactgtaaggaaaggaggactccatccgtcttatcagcacagactgagacacacgcagactcatttataactaagtaggctggagaataatccgggatgtcaaaagaatttctcagatgtattttcgaggaatcttcagagcacctgaaggaataattaccatcactgagcaatattaccatcacaatagccaggcattgtgctaagcactgctcaagaggtagtgtgcctgggcaaagtgggtaatcaatcagtatttatttggatgtgtgggtgggtggatggatggatggatgaaaggatggatggatagatggatgatagatgagcaggcagataggtggatagatggatagatgaatgagtggatagatggtgagtgtcagtctgtttttcattgctataaaggaatacctgagactgggtaatttataaagaaaagagatttattttggttcatggttctacaggctgtataagaagcatggtgcaggcatctgcagctggtgaggcctaaggaagcttccaatcatagcagaaggcaaagggggagctggcatatcacatggcgagagagggagcaagagagctgccgggttcttttaaacaaccaggtctcatgtgaactaacgagcaagaactcactcatgaccacagggagggcaccaagccatggtgaagggtccgcccccatgacccaaacacctcccaccaggccccatcttcaacactggggatcacatttcaacatgagatttggacgggacaaacatcctaaccatctcagtgggttgtggatgtatggatgaatacatgaaagaaaaatgatctcagtcagcaggatccaggccctgggggtttgactagaacctccataaacatggggagtgaatatgacttttccatccctgttccaatcccgaagtcccctaaattcccagccagccaccacctcctggaagccctccaagaagaagtaacatccttcctgagaagatgaggcccattttcttcctctcctcccatccacagggttgcataagagattaagtcatctctgatgaaacctgcagcagagaaagctgggggccaagattatacaaggaaggtcctgggaggtcagcttttccatttctcctgcagcccagagtctcaccctgtaaactgtgctgcctgctgacacaccaccccgagtgaggcctcatcctcagggatccccagcctcagagcacagggggatcagggacctgaggtggggtgcaggagctcagaagctaaagtcacatgagaaaagagggcccaacactgtctgagcaacatggttctagtcacttctttccccagaaaatattgtactggaaagaaatgcaccaaaacaatcatatctttagtaatagagaagtacaaacccaagactcttttcttttttctattctgttaattctctgtgatatggccattttttttataatgaaagtaattttaatattggtgatgcaatagaggagaggatcccctccccataaccaaggcgggaaagggactaactaaccaggaagattgaagttggagcctcagccctgcaggccaccacacaggcccctcctgttgatctgattagtctgtacctgcatccacccccttttaatttgaatggcccaggagcactgctagaaagaaaacatctcagaacagtttcaggcattagcaaacagctctgcaacctcccacttggcgggctgtactggtaacaaccatggggagaccagtcatgaagcagctaatttggttcactgctgtttaattgaccagtggaatttttttttttttttttttttgagatggagtctcgctctgtcacccaggctggagtgcagtggcacaatctcggctcactgcaagccccgcctcccgggtttatgccgttctccttcctcagcctcccaagtagctgggactacagacacccgctgccatacccggctaattttttttttttttttttttttttgtatttttagtagagacagggtttcactgtggaccagtggattttacagcctcccatcctttcatcctcatgataccactggaagacgttcattgactccatcttacagacaagacagctgaggcttagtgatgctaagtgacatcacccatgtgtaggcagctaggaaggtgcttcatgcatagcagggctcgagagagcttaggtaagcgatgtgaggaacctctgcctgttcaccatccaatccacaggtgctcagtaaattgctgtaggatgcatacgaccgtccaacacccttcagatcataaaacaatagaatttgagagctgcgactatagcactgccactaagtcactgttggctttaagcaagtcgctcaccttgagggggttgaacgagcgtgttgtgttggtcagcggtgcctaggaacagcagcagcttgggctcaacagggagcttgttagaaatacagagccttaggccccactccagacttggggagtcggaatccctggggcgatgatatggtctggatctgtgtcccctctaaacctcatggtgaaacataatctccaatattggaggtggggccgggtgggaggtgatcggatcacagaggcagatccctcgtggcttagtgctgtcctcacaatagtgggagagttctcataagatctggttgttgtaaagtgtggcactccaccccctgcccagctctctctcttgctcccactctcaccaggggagacgcctgctctcccttctctagccatggttgaaagctccctgcggcctcacctgaagccaagcagatgccagcaccatgattcctgcacagatcacagacccatgggccaattaaacctcctttctttatcaattacccagcctcaggtatgtctttaaagcaatgcaagaatagcctaatacaggtagggtccagccaccaaggttaacctgacctctaggggattctgacacatgcacgcacacacccaaaagcttgagaagcgggtggcttctgtgagttgaggcttccccttgccacccctgcaggtggattttgaagacgtgatcgcagagcctgtgggcacctacagctttgacggcgtgtggaaggtgagctacaccaccttcactgtctccaagtactggtgctaccgtctgttgtccacgctgctgggcgtcccactggccctgctctggggcttcctgttcgcctgcatctccttctgccacatctgggcggtggtgccatgcattaagagctacctgatcgagatccagtgcatcagccacatctactcactctgcatccgcaccttctgcaacccactcttcgcggccctgggccaggtctgcagcagcatcaaggtggtgctgcggaaggaggtctaaagccaggtggggcaacagcggtggcagggcagggggtggtgggccagactggtccccgggggacttcttcacaggggctgctggcgagctctttctctttagggactgctccataccccatgatggagcacacggtgtagggaagccagaaagaaaagacggcccagccacagaagcacaatggcccttcgctctcccccagccccaccatgatgcccccatgcctgggcgtgggggaagatcatttgccaagaggcagctactgcaagtctttgcgttcacttgtactgtaacaacataaaccagcacgcggttcccacccggggccaacctctccacgcgcactcaggaaagtgaccagtgaccactggcgttaggaaggtggctccagtaaagggttttggctgcatttggggaatgctgcattttgttcgtgcctgtaagattggtttgtgtcctgaccagctccaaaaatatacttcactgccctgaaaaacagacacagggagagttggttgtctcttcacttggccaaatgtaagtgaagaacagagtctttttcttcttcggattctattgtttgctggaaccgtacacgttccttggaagatcatgtttaagtgactcctgttgcctgagcacaaaaatgggcaccaatggaggaaaatgacccttgggctggcaggggcagtgacccttccagggtaccactgagggaagggcctgggttcaagcctcccggaacctcccctttggctaaccgagcccctgaaatgcccagtactgccatttgacatgagggtaccttcgccctcaggagatgtgacgaaggaacaaggtctaatttgtgcgtgtgtggactcactatggaaataaaatgcagtagaaagagcatgtatcacttcctccctcctcacactctctctctctcacacacacacacacacacacagtgcccttatcttctttagggctgtcttttccgagtgtgctatccagaacttagccattaaaaaagaaaggatggggatgggtgttagcatctgtggtccggttctttcagaaatgctgtatatttctctcagagattttcaatagactttggcacattaaaggctctgacatgtcctgcagtagataaacctgtttaaaccagtatccccccaatcctatctgaccttttttttttctttttttcttttcatgcaacgcccatttaagtctcatataattaaagttccacagcacttgtcaggttttcggagacattattcatgcctggccacgagcccagtggtcttgggaggcagtgtggtgaagtggaccacacacagcttgggaactaggacgcaggcagccttggttctagtcctgcttccgctcctagttgccttttctgcctcaattttatcacccacaaattgatctctaatgtgcattttggctccaaaattttacccaattttggttttctcctaacattgtatgtaaatttcaaacacagaaaagttgaacagctacatacccatcttggctctatcattaacgtttttctaccccagctttcttacatccctattcatctatccacccctctatccatcccaccaatctcatctttacgcatgtttaaatacgttgtagagatcagcacattttacccctaaacacttcatcatttagcccttgtttctgcagatgagaaagttacagtccagagaagtcaggaaccttgccaaaaggcacccacctagccagcactatcactgtggctccagcctgctgcctgtgctctcccttggggctcttccacattgtcggggggctcagcaggcccaggctcctccctgctgaaaaggactaaggctgatgttacttatgtcctcctcaaagggcctgccctttcaaacgtctcttgaaatcacgaggccatccatttcagacttggaatcttgggttatgtagagaatttgccatcttggtatttgctataactggatttgacaatgactccaatttttcaagctcactgtctttctctaagggcagactatggtcggtgcttaattagccacaaagttcacagaactagagacaggacacacatctgagatgcatgggtgtccaaggagttctccctccaggaatctccttgagaagtagcaggcagaaaatcacattggggttatgatgagaatgggcctgaggcaggaggatggagttccattccctctcataagatacataggggaccaccagggactcctgtttgaaatgcaggttccaaggctctagctacagtgtttgattcagtagtggggcccaggaatcagcatgttaacacaaactcatttgtgatgctacagatggctcccaaatccacttttaagaaatatttgttagggttccttcaaggtaacagtctagaatcctatcatccccagagttccactgtggttcagagcagattcagggacatcatacatgatgtttgttcctgaatcttagagcatcttcccacagaactctgataactgagtgcacctgtgattccagagaatgggaccagggcccccttccacaccctgtcacagcccatgcatctgtgccgtaatcaggccaataactctgaagccctgcagggatctggggtctacaagccaccagttccagtcaccgttcttgggaggaagaacgggggcaaagcaatgtatggaaacaaatgtttatctagtgcactctctatcaagcagctaatgaagcagacaacttatgatcagccatgtcattcaccaactggcacagttacagaggggtgccagagcaggtcaccacagtagaacaaaatcaaggtgttcacattttgccttaagtggcgtttc

SEQ ID NO: 13375 - DNA, 70262 bp, Human
tctctactaaaaatacaaaaatgagccaggtatggtggctcatgcctgtagtcccagcttcttgggaagccgaggtgggagactcacttgaacctgggaggcagaggtcacagtgagccgagatcgcgccactgcattccagcctgggcaacagcgcgagactctgtctcaaaaaaaaaaaaaaaaaaaaaagaaaagctaaaagtgatttgacatgttcccagtacaaagaaattataaatgttcaaggtgatggaaatcctaaacaccctgatttgatcattacacattgtaagcatatatcaaaataccacatgtacaatcatgatgtatcaataaaaaaaataaaagccagaacccaacctctattcatttgccaaatgtgtactgtgcctataccacatgctaggtgtttgaggacatagctgggagcaaacaaggcaaaaatcaattatagcagaaatctgtgaaaaaagaaataggtcatccctcatcttggaaaagataagccacaaaaagccctttccaggaatatgtaataaaaagtcacaattcaggatccctggctgagatttgggatgactggagatgatgataagaactaaattggaggaggctttcaagaggaaaaagcctccagcaagagacagccccacagtgggaactgcagcctccccttctcaccaaatccctcccgaatggtgtacttcgggaccactcttcagtctctgtgcaaccgagttttattttagcccacgggaccctggtttttctggcagggggcactgcaaagacgggttacaggccgaacacctcacaacagagacagcagtattctctctaggataaaaagggcttgtgtttaatcctctgtcagggcaggggggaaatgcctctggaatccaagtctgtggaaccggctcagcagagagatgtggctttataggcaaacaacgtggcatagagagaggaacctggccaattctgtcttataagagtagttatgttatgcgttgcaaggactccacattccatggatttgtgaactcagatggaatcttgtttgtccaggcctgcatgaccccatttatctaaaaattactaacttcctagtttatagtttacaatcctgtgcccgccgcctccctccccccccccgccacgcccccatgagctttctctctattactctcagtctctcaggttaaagccttgctcagtaattcagctgtggaccagttattctgattatttcctcatctatcgtcttacagtcataataataataatatctgagataatatgagcatacaacaagacagtatgtccacaggagcatctctaagatcaggacagtgatttcttgctcatggaataagaaggatttatgttaaagcaagttataagaaagcagtttaatactttacgaacgttaagtttaaaaaaatcataactcgctggaatcttttctcctctctggatattggagaactcgcccaggtttgggaaacgttagccagctcctgcaaaacacctcctccctcagccctccccgcgccccctacgaccaggcagaaagggtgggaaggggagcacagctcagcatttatttctggatccagctcactaaaaatacctcggctctcctgtttgatcactctcccttttgacctgaatggatcgcgggagccgcgccgcccgccccaccttcggcccgttgccctttaaaggaaaagggcgtggggacggattcctgccgctcgagggatagaagggagctgggtagtcaggggccgcggccatgctgacgtcagggcagccggcgctcagctccgctcgctgccacagtgcagagacctccctgagggagggggacagcctcgcgctgggattggctggcctcgcgcgagcgccggcgcggagtggctggcgaggttttagagggagtcccgctctccaattaaagcggcccagctgcgcctggctgcgcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaaggtgagtggaaagctgtttgtatttacccagattcttactttttcttgtttccccttcccatctgttcgcggaaacttcccaaaaggtaatgagaagggaactctttaaattccaaaactgcatggaaaacaaatagttgggaatacatgtttgagctaacaggcacacacaccccaaacccaatgttgtgtaaaatatttgcaaagggtcttatgtctttggtgatgctagttaaagtttaattaaggttttacatatatatacaatatatataaaatgtatataaaatatatatataaaatatatataatatatattatatataatatataaaatatatattatatataatatatattatatataaaatatataatatatattatataaaatatatataatatatattatatataaaatatatataatatataatatatatatatgaaatcttatggtctgtaaaggaaaaacccctagcttcctcactccctgtcctcaggtggctgaagtaagggttgagagcatgtaatatttactcacagtctcccttttgctattatcccagtgttttgtgtgtttcccccaatacacacacacacacacacacacacacacacacacacgcacgcagtttctttagttggtgatgttggcagtggcagcagttccagcataagggaactgatttctgtccccagggtctgcacgtttcccttacaagaagggctggcccggagcccagaaggtcacgggtaaactcctgcacaggagcctgcggctgtgcctatagctccaataccacttgttgcctacctgaatgcagctgggagaaggcacaggctggagacttagagaacatgtgaacgggaagggaacagagagacaacctaggctttacagatcgggaaactgaggcccggggtcacagagagttggttctaacaggcagctgactgtaaggcaagccctaggcatccagactcagtccctgccactttttaactgcacatgattcaccaggtcacttttctgagcctcagtttccttgtctctgatgtggggaggataggcctaacctccctcatggcagtggtagcagggatactgacactgtgagttaatttcccaaagcagtcattgttaaactctgatttcacagggtttagtcttgaagggcaaagtcttccttaaatatctgccattaacctgcagggtagaatgagagggggaaaaacaaaagacgtgagaatcaaactaaagacacaaacagccactcagaggcacagcatgcactgtctaatttgtagctgtgctcttctgtagaccacctgcccagaccctgtcacagagtccagtggatccttctaaatgtgggtaccaagtcacattgaatctgggcatttgtctggaatgtatcatgcctcactgcatttgccaagctatttgcagaatcaagtcatttcccctcctacagaaattaccataacattttagactcttagaagatacctattaattgctacctagtagtgagttatgcatgcaatgctcttatttctctatacatttttctggactccttgagggcaaacctgtcttgttcatccctgtttgaacatagcacaccatgccacacagcaggactcaaaaacctgtgggtgactcatgagaatatctgtccagctaagaccacactgtttgcataggcttcattttatgcattattttttaacttgtagcattgatatttgtgtgtctgaactgcctccccaagttcagacacagaatagttcacggctaaaggtggcagagttccattgtcctctggaaagtgaaatgattctgagtatttttaatataagctggttgatagttactgtatgaggtgagatgaggtatatggagactcctcctcctcaccacagtcctgtgttgccacttggaggaagccttgtttttattttcctttgcataggggagtgtgattatcctgattagaggtggaacatgttctccttcttgtcaccccctagtgccaacttccttggcctgcaaagggtttgttttccatttagatccaattacaggcttagagaaagaatgtggtgggtagagatgaaagggcagattttttttatctcttgggactgcgacaatcaggaggaagatcaccattttgtaggttaaccaatgccttcaactcaaaatgtggaggggagggaggagagccgagaagctccccttgctgaactgaatgtcacagaagtgattaagtactacgtgatatcagcaacacgctgaaaagcttttactgcatatttattttttaaatctgcaacagtatgtgggggaggtttataacatttggcttcaggatgcataatcgcacttagacattttgaaacaatttcatagactcttagagctacaaggggcctatttacaaaatgagaaatggtttaaaatggcatacaggctgtttccgcttccctacccccgagggggctggggcgggaatccccaccaactggaaagtcataaaaagatcttcagcaaagaacataaaatctaaaaactggagtagacttaaaggtcatctaaccaaccccagacaggctggggaaagagactcactgggggccacatacatacatcgtggcagagcttacaagttccctaacttctctctttctttctaagtaaaatgcttccaccggctgctcttgaaccatctttttttttctattaggaaagagaaggtttcctagcacagacagttccctgagaatggtgaaatcgccaacatttcttggtaacaaagggccttgaaggccaaatgccatttttctgggtgaaaccaatctcgactatggatttgttcttgtttattaaggatgcaagttattagtgcaggctttggcttcagatctggtttaagtcccagctcccccacttactagctgtgtgctcttgggcaagctaattaactttgagtcagtatcctcacctcatttgaaagttgaagaaacagtaacagcatctacctcccaagatggctgtgataattaagtgagatgatgtacataaaaggctcagcatatgggcactcagagttagccatggcagtccttggtggtggcggtacatttcagtgggtgcatggatgcggaaaggaattttctggtgaatgaggacacttttatttataactgccccatctgaagagcacctaactttcattcagctgaacctaagccattgctcagctttgacaagctaagacaatgaccaaatgctgttgccttcattctcacccaacgggtgcaaaatctgcttacatggaacagtctttccttctgaacatggattgccagttattgagcatttcactttggagttatataatgttaggcctcgaaggggacttggagtgccttactttttagataaggaaactgaggcccagagggatcaagctccttatcagaagttgcagagaaaatgtactgaagcctattaggctctgcaagaatacagaccccttgactgtcaaggaaccatctgtaggaatttagaagggattagaagaaagagagctaggaacctgttcatagttgactgtgcagtcaccagtgggctggctccagagggatccaattagaaattctcacccctcaacacaatgcccaaggggcattaaatgatggtacttctaagtccattgccaggtccacctggatgtctctctccatgcttctctacatcacatccctcttggctttcctgtccttcaggctaggccttccctctgtactcagcccttcctgctttcacctccacttcctgcagtgtgccaaactactggcacatcacccgggtgagctgatccaatgtaaacacagctcctcgtgaattgtcgttggctctctcaatcttaaaaacatattaaactgtcacttaaagaccttaatagccaagacattggagacatgcccataggtgtataagcaacttttttgccataatagagccttgttttttaaaaacagaaattatccaagtcccttttacatgctttctaaaaacagatgctgaaaccattactttgtgaattgcagatttttgtcctaagctgcaggtgtgtctgactatgcggagttgggggctgacagttgactttcaccaatgtatctgccactgtggtagtgggaggcaggaaagagcttcatcagattatcttcaggctttaatctaagcatctcagctccaaggctaggaatttgctcagagcttaccaacactcctacgagttggaaagtggaaaaatgactttggcattcccctctgaggatgcttggtttgatcctctcttcatgctaactgaccaaaggtgacaaggatgaaaaaagaataggctgaattcagcaaaggctggggaccaggaaggaggggctgcacacaggcttttgtgtgtgtctttccttccgcccttacgcaggccacttcccaagaggaaaaggtaaagagtagagaagtaagggaatagttcctctcgcaactcactagagctgacagggctccaggagaagtattcaatttgactttaggaaggcaaatcgtcctctttttagcttgcacattcaaaatagtttgtgtctcataaagtggagatttgccttgataagtaacagaccttgagagctcttatctcccaaccattcatccaacaccatttaaatctttattttaagaacagatttctggcaggggcgtgagtcattataataactgcaggcgtttactcactgggtgactttggataggtcacctttcctaggaagtggcagaatttggatgagaaccagggttccttctgcctccagcccactgacttttcctttacaccagatcatctcccaaataacaaatgattatgacaaaataggcttaaaacttcgttccactgaaagcggaattgtggagcagcttttcaggacatccaaaatgaagagacagctgttgctcttgaagagccttcgtttagaaatatcctcatatcccctaccatttgataacaggaagaggatttggccagcagctgctactgtctcaccaggtgcagggccaccagccacttttgcaggactccttcaagagcacaacatttccttaaatccacgtggaacaattggtgtgtcccaaaccattgttggatgtttacatatagcaatagcatagatctgcaaaagctctagaaaatgctctctataaaacttttatagaaagagttacatatgaagttgagtctcctgtgttcaccaaggctcctttagtggctgaaacacaaatttagtatctaatcctgtatatttgatgcagaaattgtgttttcacaaaaacagaagagacaaatcaattgtagtgctttgtgaaactcccaaatcaactccttgtctcatatctgctcttctgtatgagaagcaaacccttttacatttttttctcagaaaagagaaaggagtctgttcttacttttattatctatttggattcttgcctcccaacagacttgttctctgttaggacaggcaagtttggggctaggcaaaagagaggaaggaaagacatctctaagggtccggagatgattgacattttcctgtgtgttagctctttagcttcaaggactaccatgcaaaaatattggtgtccttttttacacatgagtaagttaagactaagagtttgaaacgacttgtctaaggtcacataatgacagattaagaactcaaactcaggcctctctgactccaaaacttcagttcttttcactctgcaagaaacagaaggcattcgtagaaagcagaaatctggtgaggagggactatgattattactgtgactttcatacacagatcaatttcttccagcccactgaactcattgatagtctggttcagaagcttcccagcatttgcaaaatgttgctaggcacctgtatctctttgatatctcttggtcaccaccaggagtatactgtcacctacaccaaatcagagccatttctcgggtatagaataaagactttcttgatttctcctggttttccagaaggctaatggacatctcccggcagaagactagtagagagaccttttaaagaataatacatgttatcctaatactctaaaaataattctagagaccttgtcccagagctttcaggaaactctgccctggggataaggttggccttgacatgtgcatttctacatgtctagtcagcctgacccatggcctacccaataatatataaatcatgaccaagccaaacatggcctgggcccccaccgggacatgctttaaaaggaaatataattgctaagggagaagaaacaaaggctccatttggcaagtaactctattgaaggacaaaggagtgccagtgtccaactcaaggtggctgtttcaaatccacatgctttgtgtatagattttgtctcctcctcctgtttaaaaaatattgaatcctttgtaaaatttatctctggagacaaaggctaatgagccattgtctaaaagagctgagcagaatcttgttatctgctcattcaaccccttcatgtcacaaatgggacagggggagaaatggcatatctgaaatttacaaagaaaaaaatggcacatctgaactttacataagaaatggcatatctgaaatttacaaacttacatttacatgagtggtgccacaaccaagatacattgactcacagcatcttttatgaatgaaggagaaaagagtgtctgctgtattctgtcacttccacccccagagtatcccagttttgtgtcaacctcataccttgaaactcagaagttcaggtggacattttggctgtgaacttagctttggccacaaggtccagaagccacttcgaggagccgttaaacacacaacatttgcaagcacaaagatctagatgtgacctgcagctcttcaatttgccaggtctgcaaacttcgccaagttactgatcctctctggacctctggttcctcatttgagaaagatagctcaccgtagttctacatttaaacgatagtttaatgaggtaaagtgcataaagtgcctggatacataatatacccttgataaacatttcctcctgctgttatggataccccctctcatcagcatgatgcaaaaatcccataggttattaagtattgggatgtggaagaccaaattcagtttacctacatcacatggggcttctaagctctcagactgcaggaccttctctttgtagttaaacttggacctagccataaatatactcaggccacatcacattgcaaaatcatgagaatagccacaattcgtcttgggtgtttggtcgctaccctttccatagcagccctcccctgctccattaccagtctttccctccaatgtcttgcttataagatagggcaacagtcactcatttctttatatagcaaatatttatttagcatctgttatgtgccagccactgtgctaagtactgaatacatgacaatgaataggaaagctttgatccctgccaagtaaacttgagtctggtagaatttatttttcataaggcaggagacaggccaaataatgtcagtgttctgtgagtctttgtgttccttgacctctcccctccccaacacacacacatacctctccttccttttccaaccaccctcagattttccaggacacacaccttcagagccacatctcaactctggtcatccctacagtgtaacagtagaatgagtgtagtagtcctcccagttgtcacattttaaatagggcctttgggaagaaaccaccagtggcactgagtgaaaaggaggctgaggcaagggggactattggcagctcttaggtcccaccagcagccagtggtccctcagccttcctacagcgatacagtggtagaccagttgtctttgctcagcatatgttttcagaggcagctgaatgtttgggttgtatttttcacagtactgatgtcagggacaccaaagggcaggagcatagggaaagggctcttggctgactaatgacctcataagaaacctgcccttagaagagagcatctgtttgggctgtatgactcagtggcgtttctaggtactgattcatgaggctgaccatcgaggtgactgacccgtgcaatctgctggctgaaagaggtgaaggcaaagtagatcccagctctgccctcatcctggaggagagccacccctcctaccacggcacacgggtgctccccaccccaaccctggctcggccagccagtctccttgttaagaggatctgacactaatgtgggcagaggtcagcatctgggggcttcttattttagaggaagtataagagagagatgttttgaaatcttgttagtgaatagaggacagccttttaacctaggatctgtagatagaattgagggtgtcagggaacttaaattaggaaaagtattgcattttttatccctaacctataactgaaatttagcatttctttctactgtgaataaagacaaacgccctagaagtttagcagctcctatgcctttgataccaatggaaagcaggtatttttatatcacattacagctgagatagatcctcatcctacaatttatactcatccctgctctgaaatggccataattatacccactgctagatcatattcattaacttagtaaaggcacatctgttagtaagtcacaaatttgtttttatatattgatactatctcagtaatattggttttctttgtatttttatcttatgcatttaagacatttcctaagaagagatattctcatgtcagatagacaaagaacctaaaaatataaagactctttccacatcaagctgaggcattagcagcattacacgccacacacacacaaatatacacatctatgcataggtaaacatatatgcacacacatacagctgtagtggattgaggtctgaggctcttggagtaaacaaactcaattcaaattccaactctgccactcatttcctattacctcgaacaagtcatattagttctgagccttagtttcttcatcaataaaaggggcctaaaagttattgtactcacaacaatcatctaagttcttggcacagtacttgacatataaggaatgtgtgttaaacacaaggcatcctcaccattaaaagacctaatgaaggtgaaatggtaaagagaataaacacattactttgttgaaactttttaaactcacctttgatttggccaactctaagaatttattttgtctaaacctgtattacacaaatattatatgccagggactgaggtgggaaatgaagaaataaaaggaaaggaattttaaaatctgatggtctcagaaaaggaatagcctaatcaaatcatcaaagaatcatagcagtgcctaaagaccttgatcggggtacatgtgtgggactgagagagatcagaagaggaaatacttaatcttacctggggaggtcaagaaaggcgtcccaaagaggggacatttgagctgagtgttgaaagacaaggatgaatgagctgttaggatcaggccatagtccagttttatgccttctgaatctgacacccatattctccatcctatttgatttccaacttggggaatatcacccatcttggactgtggagaaatacattccactgtattcatccagccacaaatgcacatcttttatcttcttatctgagaacctgttcctcttcctctcaagcaaaacccactggggtggcaggatagcaaggcctgtcaggctgcacatagaaaacttctcatgatggtgacttgaggctctcccaagccctgcaatggagttccagcaaactcccccaagttgagtttgaatttttgcaggaagatacaggtctgtgttttgacagcaggaaaaaaaggtagccaaaaatatgcaatatatatggaaagaaaggaacacacacgtatgtgcacacacatatacgtccgtgagatccagcacatggcacatgtgagcagaacatgaaaacaccgttcagaacaccacagcatgtgtgtgcaccctgagcttcactctgaagccatttaataacaagaggaaaagaaatctcaagtaagactttttgatgttaggaagtgaggaagcaaaccagcattctgaaatatgggaccttggttaacaagatctggaatcttgcatcaaaacaatttctttcacacagttcttacttcaaatatctgacttggtctgaaaatgtgagttccttcttgctgtattctagagcaggcgatgcactgaaatgaaacacatatggcttggatatctcagtgctgctaggatgattgtccttgatttttgtcagttgtacatggtacattaaacagagaaaaataaaatcccagatgattccctggcaattatctgaaaaataacattatggtgatcatccctgtgtttacaaggacatgaagaaagggcaaggtttgatggaaaagctttgtttcctctaatctgtcctcctacacagccaacagacctcaatggcccatggggaagatacaaccctataatgagattcccagctaattaaaatggctgtcatcacccaccttccacatttccatgagcccagcccagaaatgggaccatcacaggggaaatcatcctatatttatttgaataatgtttgtactgtgtatttcagcaattaaaattaacttttaagaggtaggaagaggcttagggattctctaggtcaactgccttctttaacagatgaggaaacagacccagcaaagccagatgacttgcttgaggtcacagagctagttagtgggagaggtaggattagaattcaaggtactatggcctttcaagttcagaaagacttttaaaaactgtgttgtgtagaatcacttccccataaacacaagatgagctgggcagctagttgctgtcagaataccgctgaggaacactcacacctcctgaagatgtctaatttttttaactcctctgattattggaaagctctttgttattttgagctaaaatttctctgtatgtaacttctccttattggttttctttatttccttggcagattcaaggaggtaatggccatttttttctgaagtcccagtcccagttaacctactaagtcctacatattggtcaggatgaaggtcagagcatctatattttgggtttcttcctaccttcagggagacctggtgtcagttcttagctgagtgagatggccagcacgcatcccccagggtttgtctggggatccatcttgttacttgtgccagctcctccacctggctaggataattccctctcctgtcctcactcaggtggggaagcccttctgtgccaccagctatcctgtttcttgtaagaggatttttaatgtgggaaatcatggcaagaaagaggtgccaggcagctttaaagcaccaagagaagaactccaaacccatgtcataaacactcaagaaaaatcagcactgttctacatgcatacatgtagaacatgactttcaaagaaaaaagggagggatgtatacaaaatcaaagaaggctaaggaggcaaagaagaaatgattgataaatagaggtaatatcaaaaacttttaaaaattatttgtaaagttgtcatcgcttattactatatggaatgctaaaacagtaacagggtaatcaaattttgcatgcttgtgtcttttcctctggaggcagtactcaataaataactatgaaggctggccattaaaatgaacttgctttcatgaaaagataccactaagaaagtgaaaggcaatccacagaaagaaaatatttgcagtatttatatatactgatccccagacaaaccctgggggatgtctgctggccatctcactcagctaagagctgacaccaagtctccctgaaggtgggaagaaacccaagaaatagatgctttgaccttcattttgaatatttatgtgtgtgtgtgtgtgtatatatatttgtgtatatagatagatgattgatagatagatacatacatacatacatacatagagagatctgggttgtattcagaatatataaataacttctacaaatcaatttaaaaatccaatttttaaaaaacaggtgaagacttgaataagcatgtcacaaaagaagatatctaaatagctgaaagtataagaaaacatgttcaacatcattattcattacagaaaaacaaacgcacaatgagacagtgtcacatacccagcagaatggtaaaattaagtaccaacaggacagagtgctggagaggatgtggagcaactggaactcacagacattgccagggagaatataaaatgatacagccaccgtggaaagctgtctggtagtatctaaaaagttaaatatatatccactttgtattccaacaattacacttctaggtgtatgtccaaaagaaaggatcacagatattcacaaaaaaattttgggcaaaaatatttggagccatgttattcattatagccccaaactggaaataattcaaatctccatcaacgggagaatgaataaaccaatcattttatatttatacaacagaatattacttagtaacaaaaaatctaatatatgtaacaacatgggtaattttaaacatgttagacagaaaaagaaaccagacacaaaagaatacacaccgtgtaatttcatttttaccatgttcgaaaacaggcaaaactaatcaacagtgatagaaatcagaatagcaaccacctttataagaagaggtgtttattgaatagaaagtggcctgagggaactttctgggccactgaaaatattctacgtgtttatctagatggtgatcacatgggatatacatataaagtaatcgagcgaatactggagattggtgcatttcgaccgcatgtaagttttcctttgaagtactgttagataataatagaggcagtatttgataaacagttggaaagtgatatgtatccaggcagcagattaatgtgaggccaaagcatggaaagtgagttcctgctgcagccccctggaggtgtcacgttaggggagaactttgtctccaggagctgccaccaggaccctttcaaatcttgccattgaatttagcctggcatccaggtttctttgtgatgggtcccttttcagccacatcttccactacaacattctgctgccccagaatgtcactcattccctgaacatacttttcttccttgtgggcgtgctgagagggtttcctcctccacggccccaaatcccaccccttcctcagtgccctcctccataaaaccatcagttctgactaagttctctgtcctgtgaagtcctcgtgtggacttactctcctgctgaatgcacgtttacttttctgaatggccctgaagcatctacagtggctgtcttgcctgcttaactcctgtaccatcatatcctgtttatgctgaaattctccatgttatgctccttgagaacagagaccattccgtcttcccctttgggtgtgccctggaaccctggcacatgttatgggctcagtgataataatggatagaaaagggagtgggatggaatcgggaaataggagacggaaaggcatcaaaagaggtaagagcagctttgttctcctttctgacagggacaaggaattctgaggggttagaaagaaggaaagagaccctaagagcgggggatacaaaaacaaaacagctgtggaatagaggaggggagaccattaacctatttaagcacccctcagtgtggccccttcccattctgcaccaagatcagaactggcaaagtaggagtgggtggggggagtggggaggagacttcgtggtagcatttaggaggaatcttaagatgaaaaggaaatgaaagtgagagaaattggggaagccagcgcaccaaaccagaccctgaatttttttatgctttcaagttttattctccttcttcaagcttgtctacaaaaagatgggctttaggatggtggacgagccaggccttgattcatttccctttttcaaacaactaacttgaaccttcatctgaacctcgaggccctctctttctggctggacatctcttgagaacaaactctagtgatttccgtggtctggggaagcggttggcctggatcacggaacaacagcagctgcatctcaggaggcttggccctcctgagagacaagagccggagggacaaccgaaaactggctgaaatttagtgcaaacctctcatagctcagacagctatctactttaagtttctagtccttgatgaatatttataccaaaatagggccagtggaaaagttccatctgcctggattttaagacttttgcctttcctcagccacgttgaccaaactcaggaaagtggcggaatcattgccaagtacatgctctttgaagtgcaagaaatcctgagaaggccttgaattcatcatatttcttcttatcctgaaaacttagagttggcactcctttaaaaaaaaaatgcttaatatcagcacctctcagtgctttataattttagccaagcccttgacaccatgttgaccacaacactcttgaaggagtggataggtctattcaaagttttgcagggagaaattgctttgttggttgatatttttaaaatccgaatgatccaattattcactttaattctcctctttagtttgctagtaagaaaaatggccccaagttttatccttagtgttattagtcatcctctactcctcagaaccaaaacaccagaaatttcaaccatgtcgtacctttgatgtgtgaagataaaatagaggccttactctagcacgaggcatagtgagtgctcttaccaagcacaggccaggtgccaggcattgtgctacatcattttttgctgaattttacaatcatcccattttgcagatgagtaaactaagatccagagggattaagtcccatggttacatacttagtcatggtgaatgtgaatgaaatgtgggcaattcaacccatagctcttccttttccttctgtacagtgggaggatcccttgtatgaaaatctgaaatgctctaaaatctgaaacttcctgagtgctgacatgaagccatgagtggaaaattccacacctgacctcatgtacatacactttgttttatgcaccaaaattatttaaaatattgtataaaattaccccccaagttgtgtgtataatgtgtatatgaaacataacaatttcaggttaaggcttggatcttgtccccaagatatcgtattacatatatgcaaatattccaaaactgaaaagtattcaaaatctgaaatacttctggtcctaagcattttggaaaagggatgctcaacctgtactatgtctaacctatatctaacatgttttcagtgttccagaagtttgggtcgtggacttgttggtctaaagatgaatttagttgatacacaggcatgcactgacaacattgaaccatgttagtcagcatctttctctcatttcagttctttcattcttctgattatatcaaggaggaagtctccttctgatgctaaaacgcctttatcatcccaaacacttgctgaacttcactttaaacaattggcaagtagttcccaggctcagaacttttaaaaggcaatcatacctagctagaatttaatgactcatatttattgcatttgttgtggttaccatctaatttttatacactttagagataatttttttcaagaaatatgtttttaaacatgtgtttaaagaaaagtcaataatcacacagatggtatatggagaacaaaattcatgaaggaggaacatgaggttttataaacatataatgcttaattattcttggttttcaaagcatcttacgtacattaaaatatttgattcctacaaccacctcatgaagctcatagggattatgatccattttaaagatgaaaaaaaaaaacaaggttcagagaacagaaactatttgccagggtccacacaggtagtaaaaatgtagccagggctcaggttcaacactaagctccaacatgcacagagctcccccaacactttgtcagcaaatcattcaagggcaggagtggatcaagggatattccaaagcaatgagcccagaccagaaatgccatggaaaggctgcaaggcttactgactcactgattgccttgagttttcacgatttcccagtgcttgtctgtattctatttcatggagaagcctgcagcagagtttttctagagcagtctgattttctctctctagtgagtcatcttccagaaggtcaagaaactggctgtcccatcagagggtcatctcctgccttctgagtataccacacaagggatgacacaaactagaaacggaccacttgatgaggaaaactgggttctgcagcaagaagacagcatttctttccaagtctccttgccttgagcagttgactgggattcagatgtcaggtctgggtggctggacaggcaaggataccataaacataggagaagcagggagagagcgagttggcagtctcatccgtctatccatgaagagattccaggagctgaaaacactcctggagataaagatgagagctggagagaatagttgaaactatgagtagattctaagaagagaggagaagagccagtgggagaaccttggggagagaagaaagttattgaggaaggcagagaaaggggtagtcagaggggctggcgtaaccagaggaggctaggatcctggaaaccagaggaaaccagggtgcctctctttccttctaactccccttttgggcatcatcctcagatgcaggatatctaacatatattagcttttgatgtgccaagaagcatagatgatggcatagatgaagcatagatgagggcatgggtgaagcatagatgaaggtgttttatataaatgtttattgaggagccactatgtgcaaggcattattctagacactggtaatagagcaatgaactagacataaagtgaccctgccctcatggagcttacagtctagcaggaaacaatgacattgaggagttatatacataattaaataattaccatcatggtagatactacaaaatacaaggtacggggttttctaagaccatatgataggagtgtctgagggataaatagaagtttgttaggtaaaggaagagagaaatggtctaaacagaaggaactgtatgtgggcaggctcagaagtatgcaggaatttggcatctttcctgggacatatggttaaatgaataattctgaatgtactcaagagataattttctggaaagtaacttggcttctgtagttctgttttacatctgaattgtggcaaatgagttttaaaaacaagaccttgaaagtgaattatttgcaacgtgaaggaccgttcactagtttctgtttcataaaactgagcttagaaaaatgtggcctaaatactctgtaagttccttttagtcctaaagatctatgactttcttacatgcagaatccaagtatatatagtgtgtacaattagatcattatgcagggggaaaatcaaggaaaggataaaacatctgaaccaaaaagtgtatttagtgttagttttaaaaacatatgatagcaaaaaaaaaaaaagaaaagaaaagaaaaaggagtcttttataagaaggatgcttgtttaaaaccaggaaaacatcttgctgaaggcactacactaaaacacaagtggtattttaccatcaagactccaatgttggttgaaggaaatccttttccatgtgcacacacgtgtgtgtgtgagagagagtgtgtgtgtgtgtgtgtgtcaatgcttccattgtcataatagttaacccaggaatttaggtgtgagattcccagcaggaagcatttgcataagcaaagccttaagacttttaataatagtgctgtacgtttatacaacacatttccttttaagatactaagattcagacaggcaagattaaaaatccaccaacttggtgtgttatgtctcccctatttccaaaattaactccaataaaagtgtgttatccttggaaagatcagtaggactgcaaatttggaattcagacacatgcatgcacaaacacacacacacaccaaatgacattcctacaggatgacattcttaagacatcaggctgctaaaatcaggagcatcttataaaactagggaggtataataagtaggtattgctgacctcaagcttacagatatatccttgagaaggagtctgttaagggcagaaacctaagaaccacaaaaccaattagattttaatttccaagtgtaacctgaagacactaggcctggggacaccaacagcttgttctaatttaggaaaggcagggtgggaggggagtaaggggtccccacagggaccttattttcttctatcttgatttccctcaagctacttggtaaatcactaaataagattcccagggagtttggataacttgtggctcatagtgatgctggtggctttactacattttccgaaaggctgacagggcatatctagggaaagaaaaagacaactccaagagaaaaaacaattgtgttggagcctctggaagcatttagtttggcaagaaatgccaggtcaacttttgccctataggaatccctttcataggcaattaaaacaatgcccaccctttgggactctgagtgatctcaaaagattcattaaaagtccacaaatggaaggagatcagaggaccatcctctcactgactgaattaagcaggtagcccctcaaataacgggctgacttttctagaaacgtggacaattctgaaacagcggaaaatggttttgcttcttggctgttttctcagtctgcctttgtacaattcactattcacgttagcctgagcagtgtctgtagctagttcaaagggagctggtgtcaaaggaaaatattagttcagccttaaaaatcctatcacttcagtccagtggggtcccttatacgtaagatttgtgggcctgctttggatacaacaacatgtaaacatcagctgtcagcaagaagctggcagccaaaaaggctggtttcctttccccctcagtcatcttcgtgttcgccctgccaacagaatgttcaacaaggagcccgtgtcctgggccaggactgccagattcctagatgttccatgtgccatcacacagatccagtcacccagcaatgaatctttgaatttagaatttggaactttttgcctcgttccatactcctctttttcaaagtgaccccaactccatcccctttgacagataaaagagagatcctgtgactttttccatgcttccccttctcaaaggctgtcgcccatgccaactgggagaaggagcccagcctgcgaatgattttatagaattgcttatagctcctctgtccaaacgtccctcacatcaggctgttccaagagttgcaaacccttgaaaaatgtgctgatttgagtcttatcacctctttgtctatttttgatggaagtgctaaaaatacaaaagagtaaaattatccaaaaggcagacagaagaaaaagaaaaaggggcagatagtctcctatcttggctagcagagcactcatggtgtcttctcccttatgccaagtgatactgtgatgataggtagacagtgctggtagattcggttggtagaccagatgaccgagggaactgtgattgcaatcatagattcttaatcagaaggagagttgttttttcattttggttttggtttttgttttttttcaagatggatgcagatggtggggtcagcttctcaggtggagtacagttttagaaccaccaccatcacccaacccctcaaaaggaagcacaggcttctatacacttacttctttcatggcccagggtctgggtgttttggctttcctggaaccagtctcaaatcagtgaagcttggctagcagagatgggttggggggaggcaggagcaaggtcttaaacagagaaagctttcattttgtatttccctttccacatatggatttacttttctactctgtttttatagccagattaaccccttttgttcacagatgatgtcagccttggtggtctccaatcatcccctcccctggaggggaaggcagagctacacaagtgattacaagctcagcagtgttccatgaaagggcatccatggtggcttggagactgcagcggggaggagagtgggtaactagtctaggaaagtcaagagtctgccctgcggagctgataggaggaattggccggccttttccagaactgccccaggggtgtgttcctcaaggagcctgaacacggtgattggaacagagacttcagggacagctgctgtgggagtcacagaagcaacagttcccttccatcagttccccaaagggtctgggactaccatgcttcactccagcctctcacatgctccaccttggcaggttgggcttctgtgaatttattcctcctttgtgaccaacctgattttaacttaatctcacccattagacatgacatgtccagagagaggaacattaaggagaacatggtatatttggccccaaacctaaattctcccttgagttgaacctggaaaaactaatcctgagagaggaaagaaaaaaaggaatgattgaacaatttaattaatttttaaaaattaaaaattaaagggaatatatcatttgtcatagagagtaaaaactattctttcattcagcatttgcttaaaattttatttgggacaccagaaactcctgacatcacgagataaatccatctgactcttccaactacaaccagtccacgggataaatttaacacacacaaaccatgtaataggaaaaatcatggaatctttaccctgaagggctgccgattcaggcacttctgccatcagcacattatccaccaattgtgttctcattctgttgctttaaatagtattgatctttaaaagcaaaacaaaactaaacaaaagtttccatccatagaattctaagtactagatcagtagggctcatctcaatttgtttagtctgtgcatttttatcttcattacacaattcaggaaaagagtctctaaattaaagggatttcttcacatttgtgcttgtccagacagaggaataggaatgcccaaggagcaaccctggagtagaaatggtagatttgaacacacatacacactctcacacatacacatgcacacacatgcacaagcacacacagctccctgaagagcatctgtcatatgaccccaatgtaaacgaggtctttgttgctgtctgtgtgagactcactgtgttttaggatgcactttatccaagtcatttttttggttgatttctgccataaaagtgggctgcaagtctcactctttcatatcatacttgggaagacaggattctcttggccacagcctgaagccctagcgtgggggcttcccaaagcttggggaggtgagtgagcaagaagccaaaggataaacatggagcagcggttctgctttaagattggagggagcaagatggggaacatttgttttacattacaacaggaaaaatatagattgtggaataggatgcaaaaagtcaccctgatgtttaagagcaaatagactggaaagagtcattgttcaccttccctcagcatccctggctttccaaccccctggcatcctcctctggtgacacacaggacctgtctcaggaggagaggtcaggcagaggatttactttcaggaagggcaacaaatgtagactttaagttatggacaggcagttatcgtattggtaagtatgttgattccattactctgttaagattgtgtaaccctgttttggcaattccttgcttcaattcttgggagcttcaaacaatggaagaagtccagacccttgtcaagaccccagtcttccttttttttaaacttttaatttttgtgggtacatagtaggtataggccccaggattcttaagtgggaaagtgaaaaaagccttcctggccagggcactccccagaaaaatcatacttcttaaggaaaaaaaaaaaaaaaaaaaagacttcccatgcagcttgcaaccatttgggtgttgcacattcccaggttgggccccctcatctggtgggaatcctcagtcgaagcttccacctgaagttggggagggtttggggaccacccctcgcctcaggcagggcagagggtctcagtatccatgagtgccccagagaggagtcagccagtcagtgaaatttagaggaagaggaagggttgtggtttcccttcggtctggttaagagaatgactgcatttggcaccaaaacctgtggggcaggcttgtgccagggctgatgctgaaatgacaacaataaaagccagacttgctgtaaaaaactctccttgtagggaatggtggtccacaagctgcttatgaaaagggaatttttttcagccttattgaggtataactgacaaataaaaattgtatgtctttaagaggtataacttgatggatttgtgatgttgctgttgttgttgttgttgagacagggcttcactctgtcatccaggttggatgcagtggcacgatcacaggtcactacaacctcaacctcctgggctcaagcaatcctcccgcctcagcctcctgagtagctgggaccacagaagtgaaccaccatacccagctaattttttagttttctgtagagatgaggtgtcactatgttgcccagactggtctcaaactcctgggctcaagcaagtcaccctccttggcctgccaaagtgctgagattatagacgtgggccaccgagcctagcccaaattgatgttttgatattcatatacattgtgtactaatcaaactaatttttttacatggtgagaatacttaagatctaccctgttagcaaatttcaagtatagaatacagtattgttaactatagtcatgatgctttacattagatctccagaacttactcatcctgcctaattgaaactttgtaccctttgaccaacatcctcccatttctcttaatcctcagcctctggcaaccacagttctcttctgtgtttctatgagtttgactattttagattccacatataaatgagatcattatttgtctttctgtgcctgacttatttcacgtagcataatgtccttgagttcatccatgttgtcatgaatggcattattcttattcctttttgaggctgaatattattccattgtgtgtgtgtgtgtttgtgtgtgtgtacgtgggtgtatgtgccacattttctttttccatttatttgttgacagacacttaggttgtttccatatcttggctattgtgaatagcgctgcagtgaacttgggaaggcagttatctctttgagatactgatttcatttcctttggatgtatatccagatgtgggatttctggattgtatggaagttctacttttaattttttgaggaacctcatactgttttccataatggctgtaccaatttacattcctcacaacagtgcacaaaggtccaggaagggagattattaagacaatgagctgagagcctaaaagtccaagttggaacggttgaagttacaatggtgagaccaaatgattcccaaacttgtctgaacattggcatcccctgggaactttcagaaatactgatgcctgtaatcaacccccagagattgtggcaaaattggcctggaatgcagcccaagttttggaagcattaaaagatccccaggagagtttaatgttgcagacaagttagggaaccactgttgtagcccctcgatactcaaagcgtggtccctgggacagcagaaatggtttctcctgggaggtaggtagaactatatgtcaggcttgcccagacttgctgaaccagagtgtgcatttgagctagatcccaggtgattttgtgctaatcagagtgtttacttaatttaaggagcactcccctcctcacacacccagaacaggcaaaatcccctgctaaaggacaatctcatgacacactgtttctccttcctagcactgattccatttgtaattttacatttgtgtgagttgagaaaaacgtgtgagggccccaaaatatctggaagaggctctttggcatggaactgtagtgcattggttaaattaaaatgtggatctggaattcagatacctgtgtccaaatctaagctctagcactttaatttgacccctttgaaccccacttaactagagatactggatttttccaggcttttctggttttcatactaaaaagttctacatcctaggcaccaaacagtctagtgcaaaccaggacagttagttacccttcagttaactcatatgcaacctagaggcactaacaatgtatcagtggtctcaaactttaattgtttatcaaaatcacctggaggtcttgaacagcgatgtctgggccccacctgcagaatgtttgatttcataggtctggggtgaggcttgagaatttgcagtgctcacaagttcgctgctgctgtgctgctgcttagagaccacaccttgagaaccactgcaacatacctcccttgtagagttgttgtaagatttgtacaaggtcagccttcacacagtgcctggaaaaccacaaatcctagtacttgttacagctactattgttacttttgattatggaaaagatgggactaaagatggtccctaaagagtcggcaggttttaagttctctgaggtttagatgagcataagcaaaatcccagagtttgcgtggatttagttctgcaagaggctcaggtggttggaaagagaatctgggtggaaacagtaaataatatggaaatagagacaaatttggacaggttactagctgttgaatcttgaagaagagcttaacctctctgagcctcagtttccttatctgaaaatgaggctaatgaaattatctcataaggttgtcaagaagtttagatgaaatatcatgaaaatgtttggcatgtgcctggcacataggaagtactcaataaatgttaactatgatcatgatcactgggaaagataaaacacttttgattaaaggccagtataggaaaaggtagatttaggataccccaccaccactgccttcaaaggagctccaatggagaccatctggatgggcaagttgcttctccactctcagactcaaggtcattcatcatcttttgactgggaataatgatgataataattatacttcagtgggaagtcatattattaaataagagaattactaagtaaaatcactgagtaaaattcatggcagtagggtagtttcagggtcatatttttaaatacaattccagtcctttcctggaccttctgataattttattccactcaacccatctcactccagcttctctcccagaacccctagggaagggtttgttttaaataacaagtcatgttgaccaataatctttaataacatgtatgcttatagaacttaacctgtaaaagacacgtctgcattgaatagaattttgtgtcaatttggaacgcaccacctcagaaaggaaacctgtgagtaatcattagggcgtgtgatagtactaagataccactttcaaaaagatagaatcacaactgttgtgcaaatatgaagtgaaacttaacaaagattgtgttctacccattaatgagggaacccgtatgatatttaggccagtttaaaaagcgcttgaggagttaggtatttataagtaatttaatgttaggacaagattgatgggttagttacaaaactagttaatgtcttccagaacagtaaaccataacatttggggttatcttttttgaaaggacagaaattgtttgtgtctctattggaccaagatctgcaagttaacgtgttacttcagaaagacttggagctgagcaaagtaaatttctctagataatcctatggggatgaggagagccagtgccatattgcctccatatgacattgaaaggatgtgccactcacctttctgccttatgtctgagttttaagtacttttctagggggccggggggacaggatggagtgcagtggcgtggtcatagctcactgcagccttaaactgctgagttcaagtgatcctccagcctcagcctctcaagtaagctggaactacaggcacatactaccacacctagtttttttttgttgttgttttcctgtagggattggggtctcactatgttgcacaggctggtcttgagctcctggcctcaagcaatccccctgcctcagcctcccagagtgctgggattacaggaatgagccaccacatctaattatttttttaacaatggcaaatacttatttcaatttactgccttttaatgttacgtgatgcttacaacagccctattgagacaaagaaagggcagggataattcatttttcagaggaggcaattgagttactccatgaggaagaagctgagctggaaggagaacccccattttctaattccaaatcccatgctcatccctaaattcccagttgcattttctcttttacattcctcttcctctcaaccctacattgttcttggtgacattttttttccctctaagacttcccttgggattcacctgaaggcaaatgcttgagagaggagtcccagagttgcccctgctccttgcatccccaggggtctcctggtctaatctaagtccttttaagtccctgccaccattcagtttcacgataatatcaaatgaaccacatcctactaacccaagccaaggaaaatcgtcaaaacatttctttctgttctcgggagaaaggacagattagatgctgcattccaagaaacctttttttaagtgatggtttcttttaaactcttctattctcagctactgtgagacactgtgccgtctttcaagagacagagcccacatcagaaaaacctactgtttataaaccagagtatctcacttgggactgtggctgactgatgttttcccctcctcagtaaacaagatcgttctctctgtgttgaagatagcggggtctgtctggcttctggatgaatggcatgcagtggacaaatgactatttattgcattaaacagtcagccaggaaactagctgcaagtgtggcctgatgacctgaatcaatttcttccttgcaaggccatttatttttctctcccacatacttctgttgccatggaaactgtcccactagcagatggagaccagggccaactctcgcttcctgaacctccatttagtttagcgttcttgcccaactaggccagtcgcctgtgtcttcacttgcctgactgcatgggctttctttgtgcttgttgagattttaacgtcgattctcttcaggtgattggtagcagagcaccgcgagggcaaagggctagggatggcctcacttaatgagttaatcattaagtatgggacatgtgtgagcttattttgtttttacattttgtaggaaaacctagtcagagaggcaactctttttacaagtcaaaaaagtagagaataagaaagtatagggggtgtgtatttagaaaaaatagttcctctgaagtcccctagcattttgaagctagaaaaaaatgtgttgagaatatctaattcagggtctctcaaacttttcttcacaagatgtaattaatgacaacaacaaagaacgctcagtgcataataagtgtgtgccaagcccttttcaggcagcatcccgtttaacctcctggtaaccctgcaaggcaagttgcattcttgttatccccatgacgcaggtcatggaactcaacaagcctacttgcccaagtacagtggaggaaaggggaaaaactgagactaaaacccgggactaaagcctgggtctccaaacccgaaacagttgcttgctctctacctcacttcttgcttctaacgtaggctggcctgttaaaggctcgggagcctctacacatccagtgcctgccatttgtatttgatcaggtaattctctgtcccactcccaaccaggaaccacttcgtaacatctcaccaagtgaggatcctgcagaacagaatgtgggcaaccccagtgcaagccagttccttatttttcagaagagatgctttaggctgggcaaggaaatgactcatctccagttacacagctaataaatgccagagttggcacccaaaggccagacccccgcatcaccggcgagtgctctgctgtgctctgctgtgctacctacatcactattctaaatcaaaccccgagtttgcagacagattgcagctccactctccaagccaagcatcagaactaatccccttgtagaatgagggttaaatcagcctctcattagaagaacaataaagctgaagtgtgcagggtgctttgccacttggaaatgcttccacctacctctccggtttccagccttctgagtatatctgaaatggtccaacaatgaagccttattcacaagttgtatatctcccaaaataaactttgagtgactccaatattaagtgtgtaaggatcactgcatttcaactaggagaactgaaggtgtcaaggggaggtggaaatgagcaaggttatatgccagtggctttagggagcaaagtcctacctgtgaaagaaagctcccagcttaggagaatgagttagcagtgggtgttgtcttaattttcacttttcacatgaatctagcattgaataggcctaaatataaacctgcttccctccacactccacatatgtgcaacatgactctcactccctgaagctgtaaatatgtattgaacaaaatgacaaagtgtgtggggacatggtgtacacagcagtcaccaaatagaaggcatggagtgaggcattattgtgagaagatttggtgctgaagagaagtattgtgaaggacagctgtctctttccatacgtctgaattctaccactggcaatgaggatggcttcacaagtttcactgcttgtattttccctcttaaatgcaaagagagtagactagtagcatccaaaggacatgctcacattgcataccctactcatcatgcctttcataccttttttaccttgcacattttcttccttctgctaggcatctcctttcccttttctgcctgtccatcttgcacagcccaaatccaaagtcacctcctctaagaagaagtagtctgctctaataaactcatatttcccatatgaatttattaacactttcccctgtgcttctaaaatctgtggcaaaataagagcagttaccatgtctagtgcctaatgtggtcctgcacgttactatattatctcggtatccacttggcagataaggaaactgaggctcagtatgtccaaggctaggcagccaataagttactgaaaagctcgatttggaatccaagtctctcagactccaaaattcgtgcctcttttactacacaacatgcagcttcctttacctcagacttgccccttacaggagcaggagatgaatgtgtttttctctccatatccccctagctaacagtgagttccactagggcacacctgagtcttatgttgtattcctgtgtctggtacatagtagatgctaaataaatggtatgtttgttggataagaagcttatccctttacattactagttgattgagccctgcttcaggtgaaatcataataaagtacatccctgtaccaagtcgtccccaccccaaccccaatggagagttgggtaagtttctcagccagcagatccatattactaacccacttcttctccaatgttaatgtaatgcagatctcctgggaattttgttaaagtacagattctgattcaaacaggctggagtcgggtctaagggtctgtatttctggcaagccccaggtgacgcttctggtttgaagatgccatttgggtttaaacacctcagcagcagcagcaaatgcacttttggtacctttggctggtagcaagtaataaaacctgtctcatgcattgttctccttccaaaggagattttaagtgctcatgtgatttttcagtgttttagcaaaatatttaagttatgcttcaagctataaacatttggcaaaatgcacatttgtttgtgcctgtagctttggtttaatcacactctatcaataaatcacaaataaatgagggagaggagacactcactgaagattccattccagtgacaagtgagagtgggtgagggtgggggatggaatagatagatggtcactcacagcagggcgtttccaaccagtcttgctgttttgaaacagcactggaggctgggaaagaacccccattgcattcttattgggaagagccccacccttccacaattgcctaccctctggccccattccatgttcctgtttggtcttctcagttcccggtaaacagtttgtgatggcttattgatctcaagccctttgaaccccacacagtccctttgccagcacgccaagtcttttagaggtcaagcatctccggtccaagatgtttggaaggaaaacaccctcttttctgttccttttccagatgtccctgggccagctgcagtcagcaagaggtgtggcatgtttgggatgcaaggggacgtgttcgggcttcgagccacattcatggaggtaacagattttgtcaggagggtccctgtctgcctttgttacttggctgtcctctcggggaaccctggttgctttcttcgctgagactgctttggttgtatgcgttgtcagggaaggatggctgcagagggaaggcactcctgcttggtccaattcagaaacgaaaaaagtccttgggggagtgtggcgggggcagtaaagatgtgaagaaggagtttagcacttcctaaaccatttcaaggtagagtccaccaaacccagcccagcaagaattgctctgggaagacccaagcagaggttagctggtcccttgtgcctttggggtatgcctcggggtttggtggatggggtgatctcccctcactgcaccaacttcgctgtggatgggttttggtctagagtggcccctgggacagaaagagaggtcattctgtccacagtacttaaaaaccaggacctggtattcatatctgcacaggaggaccataagatccagctggagttggattcgcagaggttttctttctttttttccactgaggattctgaggttaagaatgaggctgccacaatgcagcgtccctgggcagcattcatgtcagcatctatgtggatggcacctctggagtgtgcagggaacagactgtaagtctgtccctgcggccctgggagaggaaagttaagttctgtggagcacatagcaaagaaagagtttttatcaccactgctgtagcgttgccttgagcgctcagtggggggacaaagtttggaaggtgttttcgcagcaatactgacttccattatgagatgggaattataaaaataactacgtatgaactgaatgaaatcttttttatttaaatgttgaaataaacctaagcagtaggtattagtatctccattttgttgatcaggacattgaaggtaggcaatggggcaacaactaccagatggcaggatttgaactcagatctgcatgaatcccaatcccatgctcctaatcgttctgcagtacacagggctatgagctttcagagcagaacactgttccctgactccattccctgacagttcccaacctcagaggagctcgcaccgtcttctggttgctagggaccttcaaggtcctccaactcaggcttctatccccttcaaaaactccttctataatttaaacactcctaggaggagttctccacacttactatattttggccatttgagctctttctggcctggaaagaaagtcaacttccttatcatttcaaccccactggtcctgaatctcaggacagcgttgattcctcctcagcaatttgaagacagctaggacgtctccttttatatttcttgagccaggggaaaatgttatctaaatgcacccaccgagtcaattcaatcagttttcccttctctcaaggacctcaatcctgtgctccctgctgtccaacatctgaaaatgatcatttggtatattttttctggttttccagttgttcaggaagagaggacaattctggaccctatttttcatggcaacaagcagaagtctcttagcattgttttaatccctccattttcttgtcatcgtacaaatgatttgaacatcaagtgaatttgtctttgagaaatacagattgaagcttgcaggtcctgcatatcaagtgtcatccttggtttgaagaatccaaatagggacttaaattagactcaaattgaagcagtaacatcacagaagcttaggagggaaatcctgttaaacttttttatgctccaggttttaaactctcaattgtttgtaagacatttaaatgaccaaagtgccaaccaacatggtttaataggaaagcccttcaactaatcatcacaggacagaattcagtcccagattaccaatgacagattacagaaatggctgttttaataccgttgaggatattttggggtgtgcctgtgtcctctataatctgggcacctggaaagagtggggtggggtgagaggggtggatcactcatgtataaagtcctagaaatgtgcctggccacatgaagagtgtgaataaaaggagaaattgtgttgacaccatttcaaggaacatctcagatctgttaacttttttttgttttgaaatgttttgcattcccagcctctctaattatcatcctgaaattccacattaactgcaaaagctatgcgcagcctcctcatctagttccatttatggaaagtattggggaggtcagaaggtcagatgggacactgaagagtcaggttcctccatgtccctctatgccaggatttccttcactttctgcctcttccttctccttccacttccagccctgctgttctcactcccctgatactgcctagtgcctgtcttcttaaagaagcaggcttctcatgcctggctctgaaaatggataagcaagagaatattattgattgtgaataaaatgcaaaacaaaacaacccatttttatttttatttatttaattttttttgagaaggaaaaccttctcatttattccctgcagcaccctgagggtcattttctcctttttgctactggaacacatccttgagattgtcaattttaacatctctcaaattgcagcccactgaatgtgaacttgtactgcaagcttctccagtagcattcaaaatgtcatgctgcacatcaccgtatcaaagtcaaaggagtagctttgcactaaagagaggtgtttaacctcccttaacccactgttttccaaactcatgaccactaagcaccaagcctttttctatgtaccacatactaatctcctggagaactggcccaggccagtagaactactcccagattttaggcaactctcttctgccctgaatgtattctactttatataatttccatctgattttctctccctgtcccatcccaactgtaagctccttaaaggtcacaacaaggccttcttctcttcatattcagtaaggggttcccaacctctcagcacaattgacattttgggcctcataattctttgttgttggagctattctgtggaatgtagaatgtttacagcatccctggcctctacccaccagacaccaatagcactcctctaccccactgggacaatcgaagatgtctccagacattgctaattctgtcctttgggacagaattgaccttagttgagaaccactaatttagaccatcagggcttgcccccactagccccacaatcaacgtttgtgatattcgatcagacgtatttacctcctgactgtaggagggaaaaggagggttccctcagccttgccgatcattcagctgcagtgacctcccttgctgggcctccctcatccctgcagttggccttgacattgctcactttactgtacaagctctcaagttgcatgcagaagagcatctgagacccagcacagcctgcccatggtgacaggccggaaagggaggggagcgattttcctctcacgccgtggaactctcttgatttctaaaccttaacagcatgacaccaagtagccacagatttttgtttttaattgtcaaagagaagcatgaggctttttagtaaatctgaaccctccccaggatgtgtttccttcttctgacaaagccttcccaatacacatccatctccccagccagaggggttttctgacctctctccctgctgggtcctgttcacaaatttcttgaagaaaatattcactgcattctaacggcagtatttatgctaaagagtttaaaagttgctgaagctccgaggctatgatcttggaaaacaattttaataattctttagagcaggagtttgcaaactttttttgtaaagggccagaaagtacatattttaggctttgtaagccagatactctctgttgtaactactaactctgctgttgttgccccagatcaaccacagacaatatgttaatgagtggtcatggctgtgttccaataaaactttatttacaagagcagattgtgggccaagtttaggctatgggccacacagactccagcccagctttagagcatctctgatgaacaaatcagcctttgccgtggcaaccaccaggagggaaaacataccactctttttaccagcacaagttatatcctacattcctcactgatagattaatacaaacactgtcatttcccaaatgcagttcccaattccaaaggcctttttgtctcaggttaccatttgtccgctgctagtttttccaacttaaagttttagcttgctttcaaaagggtagatgctgctagcaggagaatgtgcctctttttcctggaggttaatctcactggtccccatccacccacccccaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactggtaagagagcttccccaaccaagcagttgttttcctatcctcataaatactagccatgtcaagtgtttctgaatttcaaacatggggtggcaagagctcaaggtcacaaaaatgacaggagtggctgtggttttagccctgcccttatatcatgtgatgttgagaaatgaagactatctgggcctcggttttccttatccatgaaatgggtagaggtgttcatatggaccccaagaggccttgcagctctagtacaggggcatttattgttccatttgggctcctcacttctgaacaggagatagtttatcactcaaaattctgagtgcttatctccatctgcaagatattcattttcccttgaagtagcctgggatatgccctttgcaaacctgtaggagagcagagaaacatttctctcttctgcctaaatgctgaaacctattggtcttaggagggagagccaaactggttttatataaccttgaacaaaagcaaccagagaaatctcaagtaaatgatcagagaaaccctgaggagggcagaaaggacacaggtccagagagagcaagtgactcacacaaggttacaccctagctgctcgctggaatccccgggacctgcagaaggtctccatacccaggtctcatcccagaccattgagtcagaagctccagactacaaaatccaaatcatcagatgtgaccatttaaatgactccccgtgcagccaccttcaagatccaatgcaccagatcagggctcctacaatctcaacatgggtagatatcacctggggagctcatcagaatgcatccagcaagttcagggccatcctgagataccgcacgcctgacatactcccaggtgatgttgatgctactggtccccagaaccttacatgtggagtaacaagaggctggatgatttctatatgttaatacaatttgtagaaggttcaacaattttaaaaatgcaagcatggcatttaattgaatatctgctggaagaaaaggagtgcctttggagcccttcatggccctatccttcaggctcctccatggctcccatcactgtgctctcactcccaacatctcaacaccttaagacactctgacttcctccttccagtgctagaacacaccaagctcctgccctccttggggccttcgcacgtcctgctccttttctgaaaggttctttccttgctcttcccaaatagtccttctccagatattcagtttacaatagatgtcacctgccatcctatcacattttttatttcttttcgtttctttaacaacttttattgcaaacagattatcttttttctgtgcctagatatgagggcagacaccctgcctgtcctgtaaaccgtaacatccctgcacccaggacggtgcagggtgcaggacaggtgtgacgagtgttagtgcaatgtcaccttttaggccagagatgctctaagtgtgggctgtggactggagctcttccgcacagtctttgtgacctggacccaatgaaaaaagttgagaaattgagaatatatgttgggaaaatgttacagcaatttgacatgcaactgtgtgatgggatgagaactcatatcagaacagaattccactgtggtaagactcacactgaaatctcatggggtatgcgctacattctaatcacatgagagagaccacaaatcactctgcaataagtaaaaaacaaacaaaccttgatccttcgccatagagagtttcagaggcacagttctaagctgttgccttaggggggaaaatcccttccagataaaatgaaaagagactaagatttttttcttaatctgtactttttgataaagaagagcacattttaaaagaacacttcagcatccatggactcgatcaccctgtaaggccgagttgttttacatgtaaggaaacacagaatggttaattggctttcaaaagtttttagtactagacaggggcttgtcccgggccacagagtgtggccacagaacaacagcagagccaggacatgcccggtagttcagagctcaggtctccctccagccccaggtctgggtaagctatcaagcacgtctccaggatgtcagtggaaactaaagcaagcagctcatgaaagagctggctgcgggcttcagggaccggctggtgaaaaccccaaacacattgaccccagactaatcaggggaagccatcgtcaggcagtgattaatgctggctcataaaaccacatggctgtaaagaacccctctgtctgctcttcatctgggcgtccagggcaagtcccatttctgagattggacaactcccccttcccactcaccttcccaacatttttattattattattattattattattattattattattattattgtactttaagttctagggtacatgtgcacaacgtgcaggtttgttacatatgtatacatgtgccatgttggcgtgctgcacccattaactcatcatttacattaggtattctcctaatgctatccctcccccaggcccccaccccaccacaggccccagtgtgtgatgttccccatcctgtgtccaagtgttcttattgttcaatgcagccataaaaaaggatgagttcatatcctttgtagggacatggatgaagctggaaaccatcattctgagcaaattatcgcaaggacagaaaaccaaacaccgcatgttctcactcatagctgggaattgaccaacttttttttaattaccgaatgatcaagactgattatattttgggaatgggaccgaattttgctatctctcatcctttgcaaccagaatgaaagtctgagcaattcttaagccttcaaatgctgataacaataagcctaattgtggatatttgttaagtatttactgtatactagccaccatactaggagctatccatgcacaatctcatctaattatccagcactgttagaagtatactatcattaccctcagctacaaagaaggaaactgaggctcagagagatgatgcaacgatgcagctagcccaatgtcccacagccgatgtaagtgacagagccaggtcttgaactcaggccaccctgactccaaagtttgggctcttccctaccaatccaggccaggccaggcgaactggcaggtgggaggggaggcaggaaggagcagataccctgggttagcattttcagggaaggctatcatgaacaggaagcagcttgagtgtggctttgaaagctgccaggatttgggggaaggaaagagggagaagacaaaggagaccagcatccactgagcatttgtatgtgtatctcatgaacacctcaccgcgccctatgtgctgagtatgttacaggctcattttacagaggagcagacagaggcccgtgaggagccaatgcaggggtggcacttactcatacctcgccctctgcttccagacccatggcaggcattacttatcagtcagagtactgtttcccattgacttcttatcggccctcaggatccttcttcacatagcactctcggtcaccactatggactggggttgacttgtcagatgaagcccatttactgttcttggctgccagcagaagaatcaggaagagaagaatcagaacagggtctccggattccagagcccatgtgtgtttcactgcctaatccagggtacaggagtgccttcccttccactttgctttgcatttttagtttctttcctgatacaggcagattcctggaacctctccacccaagatgtcccgaccaggttgcagagcaccaagtaactcagaaaggtcctcagggggccaggtgcagtggctcgcacctgtaatcctagcactttgggaagccgaggcaggtggatcacctgaggtcaggagtttgagaccagcctgaccaacatggtgaaacccctctctactaaaaatacaaaaattagccgggtgtggtagcaggcgcctgtaatcccagctacttgggaggctgaggctggataatcgcttgaacccgggaggcagaggttgcagtgagccgagattgtgccactgcactccagcctgggcaacaagagcaaaactccatctcagaaaaaagaaaaatcaagaaaggtccttaggaaaaacataaaacctaaaccaacctttccaactggtctgagaaaatgcttcctgctaaaggttatgggaacaagatttagctcctatgacgtagtcaggtatgagacgtagataacatgacgtagtcgggtatcagagagatacctgggagattctgtttcagagtcagagcagtgccaggtcgttgactccggcccaaacctctgtccctgtcatccccttcccaagtccgtgccagtcaatagtggttgcttggagggctgtgttaagagggattctgagggcttgattagcaacgtttgtgaatagggagcagtggtggaagtctcagaccagccaggcaaggccaggatcacaaagtacacaccagtggcagctggatgcagtggcattgaccatgcaaagacagagaggctggagcttttttttttttttttttttttttgtgactgcttcttcctctgtcgcagtggcaggatctgatctcactacaacctccgcctcctgggttcaagcgattctcatgtctcagcttcccaattagctggggctataggcacacaccaccatgcccagctaatttttttgttgttgtttttaagtagagatggggttttaccatgttggccaggctggtctcaaactcctgacctcaagccatctgcccgccttggcctcccaaagtgcttggattacaggcatgaaccaccatgcccagccccagctggagctttgagctgcaaaaggatcactgggtccttgggaagggaaactccctttctccaaggctccagccaggaagcacattagccctgcagccacagacacccaatgccagtgcagagccgtgaaaggacaccgtgaacgcaggggtcaactaacatctggctggcgaagccgctgccccaggatccctagcacaccatttattgtaaagctcagaagaaaagggtgcaggccctggaaagccagagaaacagacacatccagggaatgggggatcctgttaccacttgatgcttacccagcccgctcactctgaaatgatgacaaaaggaaatgcctccagagattggggaatatttttcctcttggaaaatcatccgtcttctagagaggcagcagagaagggcttgagacccatgctgctgggttcatagctgtctctatcacatactagctgtgtgaccttggggaggttacttaacttctctgtgcctctgttttccaaaaggtaacattagtaccttcctcctagggttgttgtgagaattaaatgggttaacgtgtgtgaagcacttggaagagtgcctggatcatagcaagccctccctaagagttggctgttcctatcatctcttcaactgctgaacatggataagtcagcagtcttcccaggaagggcaattactctcccatgagccgaatcagcctggatggggctgcttcggaacttggtgttagtaagatgctagtcaggcctgatccccactctggcagagtgagccaagctcttctttccacttctccgaaatccttctttagattctggaagcaggggcaggccctgggcaagaaataggaaggggacggtgtgagcaaagttgccacccaaggctacaccctaacgcatctctgcagggctctgtgcctgccctcgcctgttggccgtccggctgccacttctcactgtctctgatggtcacatcctctttccccactcactgcccccagagaagccccaaccctggggtatcctgtgtcagagccacccaggagaaactgttttaaactgctgatagatagatagatagatagatagatagatagacagacagacagagagatagacagacagacagatagacagacagacagacagatagatagatagattttgagacatgctgcccaggctagactgcagtggtgtgatcatagctcactataaccttaagctcctgagctcaagcgatcctcccacctcagccactgaagtagccaggtctacaggcatgtgccaccacacctggctgatttttcagtattttgtagagatgaggtctctctgtttcccaggttggcttcaagcaatcctcctgtgtcagccttggaagtgctgagattacaggcatgtgccaccgctcctggcttaaagtgctcatttctagggctctccagacctcctaaatcagaacctaaggatagacccagaaaacttttcacaaggtctcccagtgattcttatgcaccctaaagtttgaggttcttcagacctacctgactgacatatttgtgctaaaagccacctgtaatttcatactgatcaagaagaaaactaccagataccccagtctcctaagacggggtcaggacgaagcccttcccagatgttgctgcagttgtgtgatgcacaggggcttctgctcgtccacatggttggtggactatcttggcctctttgacaggaatccaccgtctccttcccctttcctgaactgtaacctcgggttagtgatattgctcttctctctctcttggttatggtgaccattgaatgagattgccagggacttctcatgacggtcagaaccctagggattacataatctaccctgaactttgtagatgaggaaactgaggcccaggagatactttctcagtctgacatagagagcagcaggagaactggacctaaaaccctgacttccagacactccaccacccaggtcttctcttctgtctgagaaagcaccttgaaaagcattcagaggtgtgcagacatacctgggattagctgggtatgctgtgagcttacagtgccagaaggtgtctcagataggtgtcctctgggatttagggcagagtgaccaatggggcgtctgcagccacccctcaattggagtcccacaggagctcaggtcacctgcctttcccctttctatgctgtttcccagaatttatttactatgaatcccagcaggtaccaagccctagacttgtactcccccaccccacaacaaccctagcttcctcaccactgctccctaaaatcagacagcaacagggtctgtacaatatgcatttcagcatgaatttccatgttcactcccacagttcccaaatgagtccagccccaagcgataagctatgggccagatgggttctaggaggatgaacctagcagcagccacctcagtgataggaatcaggagactgggtactaaggttcagagtcagggtcaggcacagaaatggaaaatggttgtccaggatgagcaatttgcctctcacggtttctcaggccgtggtcctgacctgtatcttcccctaatctccccgtccctgggactcacccatgcataagaattacgttcaataaaaacaaatatataaatgaggccaaattggacagttacttgtgaacacattaatattcagacagttaccagtcatattaatggggaaatgttactgacctgagaccttgtcgattctactattagaagttgactttgcatattttttaattaataaaccatgaaataccttatgtccataatgatttaattatacttttctaagaaaaagcgattttagacaaggttgactttttttttaattaggaatgttgcccaggaggtaaatgaaataaaaatattcagttttgagagaaacaaaattcatgttgcaaagccagcaaatctaaaatgatcatctacttaaattacaccattctgatcaagaatgtgaatctctgactataacttggagcagagtaagagctcatttaggcatctctcaggtattagcaaaattcatatttcttccttgagaattcttacattttgcaaaagcctgaagcagctaggaatcgtcctctggcctttcctcagatctctgtccagtgctcgagaatcccagttgtttatctcactaatttttttgtttgccagtattttattgaaacagtagtgcaagtaaagtccaggagccaacttcttgcatcagatttaccaggattcttgttaaaaatgcagattcctgtaccccacacctcacctactggatggagatcttgactggggcttggtgcctgggaatctgcatgttagtaatttttcgcagggttattgtacactgtgtccattgagagacactactttgacatatgtagctggtgagtctaactgtaatcagagatttgaaaagagaaaagccacagatagaaaagcaaacagggtcaggtgcggtggctcacacctgtaatcccagcattttgggaggccgaggttggtggaggtcagaagttcaagaccaacctgccaacatggcgaaaccccgtctctactaaaaatacaaaaattagccgggtgtaatggctcacgcctataatcccagccactccggattctcctgctgaggcaggagaatcgcttgaagctgggaggcagagattgcagtgagctaagatcaggccattgcactccagcctgggtgacagagcgagactctgtctcaaaaaaacaaaacaaaacaaaaaaaaagagaaagtcagtagcatgtagatcaggagtgtccaatcttttggctcctctggaagaagaattgtcttgggccacacataaaatacaccatcacctaacgatagctgatgagcttaaaaaaaatcacagaaaaatatcataatgttttaagaatgtttatgaattttttacaaatttctgttgggccacattcaaagctgtcctgggccatatgtggcccatgggctgtggttggagcagcttggtaggcgctgtggttcttttaagtaatcctatagccaccctagggtttacgatcctcctttttacagctgaagaacctgtgcaaagagacggcatgacatggccacagtcacaccgccggcatgcctacaaccaggatttcagttcaggacaagccgattccagagcctttgctcttgctactatggtagaagggacatggcctgccctcagggattgaactgtcccgctagagggtcagctcaaatacactaggaatggttaaggactagggagagaccaaagcatacagtgctgcttgtaagaacaggaaagaagagagagggcttttccttccaggggcagggggaggtgtaagtccatgagtgaaggtagaaatcaagcctatcaattgtggggccagtgagaagagagcgccgagtgggacacaggttttgtgagggcagccagctggcataacttttgtcattatactgttaagagttttatcaactggctaccgtctagcaaatgatactaaagaagaggtttaaaagcagcaacttttctttggtgatagaggcaaactagtaaatgtaattattaccattaattgaaagtcagagaacagagcaaaatgagctttattcaaattctgatggaaaacctagcccatgagtaaatgtagactcctttttctttccactgccatccaaaattgaaaactacagtgttccttggagaataagcaataaaataatgattattattagcaagtagacagctagctacttaaccaacagatagagcacacaatagcagatgcaaacaagtgtctctttctcacacgcaagattgttccctgtcccacaccatgacatgggctggcccagtcacaggagaaacagaacccactgaccaaggactcatgttaaatggtacacacgcacagaaaatagcatttaaatacattaagtacaaccctacttgttatttgttccaggcagaaagaagactgggtgcccttatttaataaatatactattgtctggaacgataaacacaaagttgttggcaagctgttaccatgagccaataaggtgtaagtttttaaaatcctttttaaaacaaaggacagtcatacaccacttaatgctggggtttcgttctgagaaatgtgtcctcaggtgatgttgtctttgtgtgaatgtcaaagaatgcacttacacagccaggcgcggtggctcatgcctgtaatcccagcactttgggagaccgaggcgggtgcatcactaggtcaggagatcaagaccatcccggctaacacggtgaaaccctgtctgtactaaaaatacaaaaaaattagcagtggcgggcacctgtagtcccagctactcgggaggctgaggcaggagaatggcgtgaacccgggaggcagagcttgcagtgagccgagatcacaccaccgcactccagcctgggcaacagagcgagactccatctcaaaaaaaaaagaaaagaatgcacttacacaaacctagatggtgtagcctgctacgcatctaggctacgcagtatagcctattgctcctaggccacaaattgtacagcatgtgactgtactgaatactataggcaattgtaacacaatggtcagtcagtatttgtgtatataaacatatctaaacctagaaaaggtatagtgaaaatagagtatgataatcttatgggaccactatggtatatgtggcccatcgtggactgaaatgccgtcatgtagcacacgatcatacagtatgcatatggcaaagtgcgtgcatctgatgtgtacagcttgatgagctttgacacagatacatttccatggccctttcaccaagattgagacacagaacactccctacatacacaaggtagctaagggatgcgtgtttttcctttactaaagttttttctctcatgtgtgttttatttgtcacaatggacagtattgcttttgtaattttctaaaattacaaaagtaatctaactgcattaagttaagaaaataaagactgtgggtctttcagttgctgagaatgctggaagagaatgcattttcagttttaggtagattctgtcatagtttctttgactgatgaagccccatccacatcatgttgtctcttcctcctcctcctccctagggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtaagtttctcccatgcttccagccaggctgaaaccatgcaggcccagggctggacagtcagggccccatcacggggctttgttccctcattcatgcatttattcatgaatttgtgcattcagcagatattgattgctcatttagtctgtgccaggcactgtcccatggaaaatgatacaataccactgcccttgaaaggctcatagtccagtggcggtcacaggcaaaaccgaaacagtttagagaagggacatctaagcctgcttggtggtgagggtaagcttcaagaagttggtgaggtacaagctggtctacgaagaatgtctaggggtcatccaagccttcaggctttgaggggaggatgtgtacccccttaaagaggtgagcatttgcaaaaagagccaggagttcaagaaagcacagtgcatttagaagattaaaagaagtcccacgtgattgaaagtgtggcatgcttggggagctggggacatgaggctagggagggcagcagaggctggattcctggagggttcattccatccatccattcatcagtcaaatactgattagcttgtattagctgcactgccccaggaaatcaaacaagcagaggacactgtccccaaactgcagaatgccatgaacttagttaggactttattccaaaggtcatagacaggcttttggtcagaggtacatggtccatgctgtgcttacaaaagtttcctctagcagtgtcttagtacattttctgttacttatagcagaatacctgaaactgggtaatttataaagaaaaggaatgtatttcatacatctgtggaggctgagaagtccaaggccaaggggctgcatctggtgagggacttcttcctggtgagcactctctgcagagtcctgaggtggctcagggcatcatgtggcaagggggctgggtgtgctaactcgggtctctcttcctcttcttagaagccagtcccactcgtgtgataacccattaatctattaagccataagtggattaatccattcctgaggacctgagccctcacgacccaatcatctcttaaaggccccacctctcaatactgccatgcagaggattatgtttcaacctgagtgtttggaggggatgttcaacccataggaagtggcagtgtggaagaagtgctgctgaggagtgagtcactgggggccattttgagaaaacagaaaggagaagccagagttggggagatgaaagcctcatggcttggtttgtcttaaactgccccacagaaggcgaaaggaatgcttgaggctggaccacgtgggtctagcgtgtactgcgtttctggtccccagcccctgttttaccttttgctcctcctgccccatcaaccaagtgtcttcatttgtttctatggcaattaacttttggagatagaagtcccagcacacgagatccccaagcacattatctaccttgctgaacaggctggcagtcacacatgagccaggcgacccagggaaatgccagcccaaacaaagctgctgccacatccagagagggccggactctttctcccttgtagtcactcaagctaatcatccaaaacctgcatcctccatctccaagccccatcttattagcaccatctgggattgccaaccaagaaactgttttatctgagaactctaagaccaaagaacaagatttatttcctctactacagatttggcagtgacgcataaaaggcccatttctcaggaagaatacatgtcctaaggatgtaaaaaagaaaaaaatattagatctagttaccatggtctataaactggtcttttcccgccccaccctgatcctggcttctgtccaccctcaaatagctgtttgttcataaaccctaaatactagataattctaagttggaaggagacctctaagtcactgtagcatttccaaatcgccattcccaagagacatgtggatctgacatcgtgttttattcttgactgagcctcgcatatttgttctgtgtggaacaaaggcaaaggcagcccaagaacccgggtccttgcctacagtcagctttaggaaatgattgtgaacttgggaagcatttaaatagcaatactagacagtaaatggaaaaggccaaagtcagaaaataagtagggattccaaaggaagcctttattggttgggctaggctgggctagctgtggaagatagacttctatgtccctgccccaaccacaattttactttaattattatgtaattagtgaatcgatgtctgtcaccgtctgtagatgctgaggtcttgttcatctctttatttgcattgatatacatagccattgctcaataaatatgtgacccatgaatgaaagtttgaacttaagccttaaaaaatgggatctatttggatggccaatttgcctaggcggacggtgcgattccagttccacatttattaagcccctgctctgtgccaaacactatgctcacactgtcagggtctatctttaattcttacagttgtctggtaggatgaattttaccaaacccattttacaggtgagattcaaggataataggtaacttttctaagatcccacggtttctatggggcagaacctggatccaataccctttctgtgataagatgctaagttgtaaaacccggcttgttatttgttccaggcaggaagaagactgtgtgcccttatttaactccctttttacctccttgaagcaggggaggtaatcctgaaaagggtagctagataggctgacaggccacagacagtgtgttcccagcaaccccgccattaggagtgggtgtgggctgcactccctgacccgtctgccttgcctcaccagcattcacatcaagtggacgtgtgtgctggctgccctgtatgcttgcaccctctcctttctcataaaagggcagcatagaacaattaccagagccaagcatcaggcaggaagcctgacttctgctcccctggtaaagggcaatgatttttgcaagaagtggtccaggcattcaacttgagaataaaggtgtggggaagaaattgtaggactcagcctgacaccccaaaaccgaacagagattaacgggagaaaaacgaagggcaaaaagagacatgaacatacgggaactgtatcggtaacacctgcctgtttatcatcttaatcgtgttcgttgtgtttgtcgttactgtcagcaagtccgtgggcattgcctgaaccaaggacaggactaagcaagtatctgatttaaagcttacaactgccccaagatgtgaagtggctgtgcctccccaggctgctgggcctcagaactgggattcagttgaacgtctgcctaaaatcaagtctatgttctttcccatttcccaaagcttattcctgggagagctaccagatattctggaccataaaaggatcatgtggctggctcaggagacgttagagtgaacatgaaactacgtgagtttctttacagcagaacttctcagagcctttagtaggcctatgctgtggtccttacactgaaatcacctggaaggcttgttcaactccagaaggctgggtccccttccagagcttatcagtaggtgtggggtggagccttagcatgtgcattgctaacaagtcctcgggtgatgctggtctggggctacactttgaggaccgctgctaacagtgttaaaaagtgccttacatgtgagctcaacagaaatgatatcaccaatttggcctatagtgagagtctagatggtaacatgggcattttccagatgtatttggcctgctggctctatgtatgtatgtattttgagatggagtctcactctgtcgcccgggctggagtgcagtggcacagtctcggctcactgcaagctccgcctccgaggttcacgccattctcctgcctcagccttccgagtagctgggactacaggcacctgccaccatgcccggctaattttttgtatttttagtagagatggggtttcatcgtgttagccaggatggtctcgatctcctgacctcgtgatccacccgcctcagcctcccaaggttatgtatgtatttatttatgtgggatagggggtggattaccccaagcgagcccacctttgagaatactgcataaccctccctgttcctggagagctctggaagcacaggtgcagaatctaccacactatgctctgtaacctaccttgacggcccccatccctgatgacactaagtctctgcaatctgaggccagggccccactttcccctacacccaccccccgacacacacaccagctgtgagctccctcggctccctcccaccttgtccacctgctgggggacgtccttcctctgagtccttgggaggtggcctattggagcaatggcagggtcagcctgccaagttctcccacccagccccccacctaaccatcctcattggaaaaaaatgtccacaccagagaagcgttattgcaaaaatgcctgtatggaattcctactaaggggccatgttctgagtgagcccagataacagtggtggccaggttgcaggacacactgctgtctgagcccagcccacctgcatggccggggctgtcagttacacagatctgaacacagtgagcagaatctgaccccacccccagcttcccaaccccaggccagcagacgggccctactgacgagacggggccacctaaaattagccttggcacctcggtccacttcagaaatgaaccaaaagctgtggctgtccatgcctacctcagggcagtcctctgaaagtgttattattacactgaggttaggagaggcaggatatcatgggaaggtcctccggccaccaagttgtcagagttgccctcttcatggggcaataccaagcctgaaaaatcccagtgccagatgctactgcacccactgtcacccctgaagaagcgagcccttttccatcagtgaggccaatacaattcaaaaatatttagtctccctcttttcctcacatgtcccattgtgcggggatggagggtaggaaagaagacaagttgagaatcaagggaagaaaggggaaactgtgaggctgcagcaggcactgtgtaaggtctcaatctctttatttttatttttttagatacacggctctcactctctcacccaggctggagtgccgtggcaggatcatagctcactgcagccacaaactcccgggttcaaaccatcctcccgcctcaacctcccaagtaataaacctctttaactcttggtaacaaccagtgagagaggttggggttgtgatacccatttcgcagatgaggaccctggggcgcagtgaggttaccccacgtgctgatgagagcggggcttcggttcaatccccagtccttctgcttcaccggcagagtgaagtctgaagccgtgttggggtggggcctcggcagggtgggtccgaccatgccaggggatatatatgtgagtgtttaggttctccagggtgggcagccgtgtatggggtagcttgcagctcagcccactgagcatttgggagcctcttatctgcgtactgagaacaatgaaaggattcccatgtccacccccagttccacccactgtgggttcttgtgggccttttgagtatcagagatctccgtggccagggagctgccgactccagcaacctggacccattcacaccaggctggtgggagcccctcgcgcactctccaagccctgcgctccccacctggatggaactgatgggcccctgagctgggtgggcaatgatcttcatgttctgactcttagcagctccaccaagccattgccttgcgtttagagagctcgctgaatattttctcagaaattaaatacacagatttcccgggtatggtcattttgcccaggaatttccgcctttctccacaccccgaacttgtaactgaagaaaggggaaagaaagccagagcatagcctttaatgtgatctctactctttagcatttaccattcctgccgggcgcctccccgtcttgccccttccccaaccactccttcctcaggccaagtgactgccccaaaagagcaaacttaagaggaggacagcccattgagagaagtgaagatgttccccacagtcataaaaacgcgtgaatatggtccgaaatcatcctccaggatcctgggagcacagtctgacccctctgccccatttccccacaagaatgctgagagggggacgggaggcctccgtcccctccctcccccccgccaaaggtctgcttttcagatggaaacttacagcagctggcggctcagcccaactccagccccaatagaaggacatatttgtgggcaagggacttccaagtctttgtctaagcagatgtttggcttgtgggctcggcaggcaggctggctggctttcctgccagccccacttgggaatttgaaactgccactcctccccacttagtgagccccatctgagctggaggacaggagggtaagaggcccagagacaagcctggggtcattcacccagaggaatccctgctccccacagtcccgccacccctggctcaggcaccatgggcaggagcctgggggcagccgcaaaatcactatggttaccagcttctcggcatctgcctgcctcttgctttgcagtggagatactttagtgactttcagggagatctttttttttgttccaaagaaacttccctttctcccactttttatactatactataaatacttttccatgttgccacatggccttcaacgagcttttttttttttttttttttttttgagtgggctgcatattattccattgattaaaacagggattggtaaactttttctgtacagggcatatagtgaatattgaaggtttttcaggccacatggtctctgtcacgactaattaacacagctcttgaagcactaaagccgccataggcaatatctaaacagatgaccctggctgtgttccaatcaaactgtatttacataaacaggcggtgggctagatttggcccacagatggatgcagtttgctgacccctgaactggaagaatcataaagaatagttttagctttttattaatctctttggttttactcaattttgttttgctaatatgagctaaatgatgacgatgatgatgatgctgtcatctcccattcattgactacctaggttatgccaggcactgtgccagatattttgcatgttattttacttaatcctaagaattatcctacaaagtatatcatcctcctttttacaaacaagggaattaaaagacactcttagcaaagttaaacagtgttttcaaacttcaggtcacaatccgtcagtgggtaatacatcaatttagtggactacaaccagaattttttttaactgaaaagggaagagtgtttcaggagtagtaaatatttttccaggaagcttttttttttcaggagtgtgtgtgtgtatgtgtgtgtgtgttggatcaggacgtgtaatgtatttgctactgtggattacagacaaaaacaaaaatttcaaaaaacaaagctgaggaaattgtctagtcacctagatggtgagtagttaatccagaactaggatccagacctgcctcactccaaacctgacacagactctaattaacaggtgttcccatctctggagcacccacgcagttctaagccccgggcaaagccgttgcaattggaatgaacacatctgagactccgtccctgctcagctgtggaccaagcagcatccttttgcaaggagccagtccttgggcccatgcttgtcagagctggatttgagaacaacccacactgatgttctcttacacgtgtagcatttatgaagcctttccatctccctcacttcatcacataaccagggagggagattcagttagaaatgtttaatattttgccttgcttggcagagagccccataatggataatctgccccaagaagaaatgtaaggtgaaggggtcagttaacagtagtgaccaccaacaccaggctaaggcatttcgtatgagccagggcctgccacgatgtgctacagatgagaaaactgaggttcagagggttggatgatttttccaagagcttcaccagtgatgaagccatggcatgaaccatgttccaaagcacatgacccaaaccgttgcctacccaccctgcccattctgcaccatagggagccttgggaagactatacagtgtggggaaacagaactcaagagagctaaagatgccagaaatgatgttagactacagaagaaagaaacacacacataaaaacctctgggatacatgaggctgcaaagcaaagatggtaaatagtcaccataagaggaaatggagagatgctgtttataaacaaattgttgagtatttgtgttggaaagaacccagtgcctgaattcaaggcccttgtgttaatatttactgtattgtagtagtgagatttccacgaggcactctgggtttagactggataggcctttggataagagccttttggaggaaaacaacacaattcagacagaacttctggcaaacccgagacagagattattgctgatttagagccttctcatatctgctgatccctctctgaaggccaacacagttcagtccttcgagacagttcttcagctgagtaacccttggccattgtcccgagtctgctgttgcctaaaacactttgtgtcttggttactcctatttcagaaaccttaataattctgcatgtacacatttgatgtttctgtcacctagggctgcatatcaaagcatcccaaggcatatggctgaaaccaacatgtattttgctcacaaatcaccattttggcagggttcagtgaggacagcttgtctctgtccattcggtgtcacttggaggagcttgcaggccagagactggaatcacctgaagctcgttcactcatgtgcttgagctagaggctgggaagacacacacagcagggaccctccattgacctccttgacctccgaggtctctccacgtggttgccctcagatggaagcttcaggataccaagacttctttcctgtcagctgagggctcccaaggtgtgtgtactgagagagagagcccaggggaaaacactgcctttattactaccctgggagctgcatagcatcacttcatccatgttctgttctatagaattgagtcactaaggtgggaccatattcatggaaaaggaattaaattctatgttggttggaagggtatccaagaaatttgccaacatgacttaaacacccatggctgagggaaccccacaactctgcagggtcttagcttttgagcagctgaatctaaaatgttcctcagctttcttgaggcaggtgtttacaaattgcaaaggccccaatattcaaaatctttcatttcaattaagaatctcatgccattagaataaggaacaaggcaacactttactggcacaggaagaaacttcccatttgttctatttctgaaaggtttgtttcacacatcctctacccaggtgggaaatagtctgcaaacaaggtcacatgacaaatgttggaaacgttctcacgagcaagctccaatcttagatatttgggaacatgaacaagaaacaactgatatgctaattataaagcattcttctccatgccttttaccatagtcccaaagaacttccatttgaccatactagctccttaataggggaagtaacctgagaatggcctcattggtctttcttaaaaaatagtgttgagtttaaacatcccaggaattcaaatgagcctttgttgtaactgaactgaattggtgatatcagttttgctgagcttatgtataaagttatttttaaacagtctataacagcggttctcaaagtgtggccccaaccacaccagcatcccctaggaacttgcaaattcttgtgccccaccccagatctactgtatcagacactgtggggaggtggtggcggtgggggagcagagatatgttttaaccagccctctaggggatactgaggcaggctcaaccctgagaaccactgtctccaggggcaggatcagatatggggaggagcaggccctccaagcaggggatgagtggagctgagtctggagcagtggcaaatgatgaaaaactcacacgactcgattctctggccttgcacaaatggagagaactgataggggaaaaaatagagctcatcagtggcaggaatgacttcctgctagtctacatgcccttggtatcatggaaggaaatccaggcctccaaacctgccttcaacatatctttgtcattttaggaaagtggtttaatccctctgggctttacatttctagcctgcaaggtgggcagagttaaggaatacacgagattttagcaaatcattattgagcccttataaagtccaaaaattccattatgtcatttaactcacaccacaatcctatgaggttgctatcattactatcgccattcaacaggtgaaaaaacagaggcacaggtaagttagttcatttgcccaaggtcacacagctatgaacccaggcagtctgacttggtatctcccctctcagccacctgttgcaatttagaaattgcaaacctcgctacaaagaattgtgggagagactaagtttgtgctgagaaagggccaggatgatgagacccaagtaggctggcattctgactctcggctgctagcttgtctctcgtggctgagggaccaccagacgatagatccaggacaacctcaggtctctcatcctttgagatgactgagttaaggatacagaaaatggcttagaggcaagaagagcacatttcatcctgacacatgttgagagggctccttacctggacatcttgttttcatggagtgataatgatactgtttgcttaaaggggctggctactggtagaaaccagtccaagagccagggatgctagggagaacagtgagggaagaaatgctcctccaagaggggcttcacaaagtgctttccaacggatgagaaggttgcaaacaagctctgtgaacaagaattttccttccttccttcatactgctgcgagaatatctccctacagtgcaaattagaaccttgaactcctcatctcaagaaccagtaacgggttaggtgcagtggctcatgcctataatcccagcactttaggaggccaaggcgggaggatcctttgagctccggagttcaagaccagtctgcgtaacatagtgggaccccatctctacaaaaaatttaaatatttttaaaatgtcttaaaaagaaccagtcgtggctacccattgcctccagagtgaagtcccaacccataacctgggttcaaagccacccatgatcaccctaaactgccttttggacctgatatccccctccttccttcagtgtatcatcagggtgcctgccggtgctccccagaccaatccaggtgcatttctatccctctccctttccctactttcatgtcaattcacatttgtaaatgtggagtggggagccccattgatatatcatggtgttacccaatggggtgtagtttggtgaactgacacgaagtcccttttgtgtgggagggaaagagctggaaatttcattctgtagaaataagaagccagacagacaactcactttgtattcagacagccctggccaaagagtttacagttcccagctatgcaggagggagggtgaaaataagtagatgatgactggtcactgattttttgtctagaccccctgatgggctccaagccagctgagtctcaatcatgtgaagaggaacagggttttcatttgagcgaaaaactcacaccactcattcttgggggtgtaactgaaaccacaaatctagcatgttctaaggaacattatcaggcacagtcaggatccagttcaagatatatctagttgaccaaacacattccttatataggcagtcattcaagagctcctacgctcagaaactgctatcagtacatgacgttccttgttattcagtgttcttttcctaattttcaccattttaatgtttatttcctcttcaatatatgagtatattaagtatgtaatcaaagtatataagttaagaatagtaagtgtgcaaactcttatgtgcttccctgtcttcacatggcaaaaaagtaaatatttctattttggctgaaacatagttgatacttactaagtttaaattagcatctaaagccaggctcagcaaacactttctttggagggccaggtgataaatattttaggagatgtgagccaagagccaaaattgcaatatcatgtgggcactttatgtaacaagagagaaaacaactttccatgggttttttaaatgaaattcaaaagataataataattgagcacagagtttttttttttttttttccaatataggtctactaatgagaaaagcagaaggggttctttcttgggagaaaacatttcactgaattggagggcaaatgtaaaatccagtcttcattctcatggggcttgcgagaacagacagtggctgggtttggccatgggccgtagcttactgatgccggatctcaagtccacatgatggagtagaaagaactttggctttggagtcaggtttggcctttgttcaaatcctagctttgcctcccatcagctgtgcattactgagcaaatcactgaatctccctgaccttcagttttgtaatttctaagagagaagataatgattttccgaatagaaaaataactctagaaggagaaataactctctcgggcttatgtaaggggtaatagtaatgcgagcaaagtcctgagcacagtgctggatgcagacacgctgtagggacatgacagccattgtcgtttccatcatcatcggggcttacaggagcaggggataactccaaaatgactcaaaagattgtgtggattgagaatgtcaagttcccattctttagaggatgagaataggcaagttataaatgtgcgatggatggatacctgaatgaaccagtgaatgaatgagcatttagcaactttcactgctcctgggaactggcagaagacagaaatctagagctctcacagagaacttctcccaggcacactcaccctccccacaaagccccaatcctaactgaagctgaggaacaacatgagttgaggtccaccttgtcatggtttctgagcaggccagtgaaaatgttactggcagtaaaagacagataaaggagccccagatggaaagaggatgacaaacagccaggcactggctacattaactgctgagaggccctgtagggaagctgcttctcacctctagccattgggcatgctgctcctttgccatgccagaatgcattctcctgggagccctcctagcccttcagacaattccctgagtttagtctccccacccgacccagctcagttcccatagaaagccacagagccaagggcggcagtttgaatcccagctctgtttcttggctgtgccccccttcacaagctattttgtctccttgggcctcgctggtcttatctataaaatgagtgcatttcctgtgtacctacatctcctatccagaggattgctgtgagataaataggaatgtggttgatccctagagcccctcatccctcagagaggcctctcctgctaaggtggtccctgctatccacccccaaagtcactctccattcccttaccctgtgattgttttcctagtatttatcacactccatgattatctcatctgtttttttatatatttattttctgcctccacacacacaaagctccagtttccctgaaggctctggcattatctgcctgggtcactgctgtatccccagcatctagtccagggcctagcacacagtagatgctcagtaaacatggatgagcccctgaaaggcaagagtgttttgaaagctcccaagaactttccacaactgtctctggagcccagctctctgctgcacttagtctaaacctgtctctaaggtgcagacagatgcatcatctgctagtgtcttccacactcatctgttgtcccctaagtaggaagtatgaggtgggagggcagaggtttccaaatatttattgttcatctactatgtgcctggcaccgaggagatgtgaaagcaagcatagttggatgtggctcctgcttccatctagtgtagaaagaacaggtatcaaacaaccatacagagaaaggtaagcagagaagctttattatggacttaattgcccctggaaggaggtcagagaagatttcccagaaccaaagatctttaagtctcacatctgaagaatgaaagggagttaatcaggcaaacaggaacgggaacaatgtaccagacatcctgaacagcaacggcaaaggcctcatggcagggtggagcattccttcattcagcaactattgatggggaatttatgtgtgcggggcccagtagagggtcctgggtcagagctgcaaccaagcagcctctctctgccctctgcagctagccgcttagtggagagaacagatataaattagataattccataggtatttaaaaaataatgttagctaacatacatggagtccttttgggggatctgccaaaatcatgcatgggttccaaataacttatgtagatacttggccctggaggagatggagcactctttagacatggagggcttggtgacttccttccaaagaggatagtatggaagtggggagaagagtcactttacagtgaagaatctgacaaacactgcctccaccagaaggtcaaagtcaaccgcaacagtgacaagtgagggcgacagtatgtacccttgaaggatgtgataagaggagcagtttgccccgtgatcttcctcccaacgtactcatcatagtaacatcaggcaaatcccaactgagggacattctacaaaacacctgaccagtactcctcaaaactgtcatggtggccaaaaacaaagtctgagaaactgtcccagctaggaggagcctcaggagacatgacagttaagtgaatctgggatcctggaatagaaaaaggacattgggtaaagtttatgaacacgtgaataaagtttggactttagttaataatagcatatcaatattggttaattaattatgacaaatataccttattaatgtaagatgctaataactcaagaaactgagtgtggaatatatagaaattctctgtgctgtttttgcaatttttctgtaactctagaactactcaaatattattattattattatttgagacaaggtctcactctgtcacctaggctggaatgcagtggcacgatcatagctcactgcagcctcaaactcaaactcctgggctccagcagtcctcccacctcagtcttctgagtagctaggactacagatgagcaccatcacaactggctaatttttcaatttttttgtagagatggggtcttgctatgttgcccaggctggtctcaaactcctggcctcaaatgatcctcctacctccagttcccaacgtgctagaattaaaggcataaggcaccacttctaggcaaaaatattatttattaaatattatttaaaactcttcatgcacgggtaaaaagatccattcaaagtgcaaggtaaacaaacaggttttaatgtaaacaaatatgaaaggttcactgatgtgctttcagatttcacactgcaactaacttgagaaagtatcctgtgtcaaattttactgtagtatcaaagaagaatatccacagttgcctggaaggtcctttaaaatgcatcgtcctcctttttccaactttatgtcagtgtgagttcagattttcttcatgtatttcaaccaaaacaacagcatgcaaaagatgggctgcagaagcagttatgggaatccagcaatcttctgcaagtcattgaagagatttgcagatatataaaacaatgtcttaaaattttcttctactttttttgttttgaaacatatagttattttagtaacaagataggtatgttaatgtattacaggtttagtattgtcatttttaaatgaattaaaaaaatttaaattgttctcagttttaatttctcttatggtaaatatcaatagctattacccacatgaacaaaaactctgtaggggtcttgataatttttaagagtataaagggtactgagaccaaacaatttgggaatcactgtgctaaataaataactttatttagtcctcgtgaatagcctgttaggtaggcaatattattgtgtcgctttgcagatgacaaaactgaggcacgaagaggtatagtgacttgcccaaggtcacccaggaagtagaaaggctggagctggaattcgaacccatgtcactgtgctctcctgacttccttgtctcctatggtccttccccatccttccaggtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgaggtgggagatagccgcgagatgggttagggggcttgagggacactgctgagggtaaaagcccagaggccaagaggagcatggctttgtggatgatgtgttctacagattgggaaactgaagtcaggcctcactgcatgctctcaaccttcattttctcatctgcaaaatgaggcagacaaccatgggattgttgggaggggtcagacacagtgccggtgaatcttgtccttggcataatgcctagcacttagtaagtactcagaacatagcaggatgaaccaggaggcattgcccacgttcaaacctgtatctgcatctcttattattattatcatgtggttacctaactccggagcctcagctgagtctcagttttactacttataaaatagggatgagaccagcgcccatcccatagagtggctatgaggatagatgagataatgcatgaaaatgcttgccacagggcctgacctaggaacttataaatggtagctgctgttagtcttacgataatatactataatatgagacttaacattaatatgacacaatacaatacaatatgatagagatgctatgaaagagattcaagtctctgatactggtttgatgaaagtaactctaaggtgtattaataatggcaatactaattatgatcatagtatgtactatttgcatgcctttggttgcaggcaatatactaacttcatctttggcatgtatgaaggttagaaatgtcttctttatattgaaccaacatctattttctaccaccttctacgaattggtcaccatatgaagttaagaccctgtagtcctcttacctaataactctgttattaagtgatattaagaaggaaaaggactgtcacaggcctgccctggagcctcatttttgaagtgacaacagtatatgcacaataacaattctctatcatttattaagggcttacggtgggtcagtaatttgctacatactttacgtacaacatgctatttatatcacaacaatcctttagggagagataagcatgattttttctcatttcacgtttaagaaaagtgcagctctgaaaggtcaatgctaattagatagccctgactttgtgtcagtcaacattctaagcctttcatatgtagttggtcatttggcaatcatagaaccttgtgggatggaaagtatttatatccccattttacagatgtggaagctgaggcacagggggattaagtaatttgcccaaagtcacaaagctggtagatgtcttaagtgaaaactcatacccagttcttgtttgactccaatactagaaggcccattaaacattatgctcctctgcacttcctgagcctcaggggatccttacaatatgtctattccaagtgtcacttcattccaagcccaagtgaccctctgtattcttgctcttgatgattggccattggcagtttatctatccttaagctttcttcaccagggtgtgtaatcccaccttggaactaaactttagatttgacccaaagagtatcacagatacctagataagtaaaacctgcctgtagtggaggattttttttattccatctgagaagctaagatgcaaccacaaccttcaccaaatattatccttactgcctcaaatttatgccagatttttccactaaggctttaaaaggtcaaaacaagaataggatgggatgaaccaccaccctataacttgtcctagatataccgtctctacctagggacagaaactgagtcatgcatttctcctgctcccctccccagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccacatacacccttatctaattatttacaccatggcagtgattttgcaacacccagtgctggcagaaaatatagtaaaatactaatgagcctctctatcaatgtatctcatcagacttccactgggagtgtaggctttgggacagaacccccgccccacctgcctattccagatactcccagatcactaatgtaacaaaggtatcatgttttatggtacactgaaaagtggcctgctgggaactgatgagcttctctttagccagggacctgactcagctgccctcagagcccaggaaaatagcgaatgaacccctctgggaataagaccagtactgggaaaccactgaacaggggccacctaagctccaccaatgggtgccacatgggatgtggtgactaatgtgggcagatctttaaaaatacagcactttttcaaatgccaaaacaatcagaaacaaaattttttcaataaaaattaatctaaaatttaacaatgccacttttatgagaaatctcaatttttaatgttgccaactaaacattgaatgagtcacgtagaataggtctttgggccaaattgtatctccattttatggtctctctgaacattttcagctcttaaattaatttctttcccacagtttctaagaaaaacatatttttctactgggagtataaggatgaaaaagacacaagtcctaggagcttacggtctggtcgccagtggttttctttcttgaacttcctcatctgctgccagttttctttaacctcaccatccaaatttcactctgaccatctcgtacctagaaaacccccattcatgtgctttataagtttcaccaaagccattgctatatcctcccaaggcagtggttttctgctcccagctcctttctctagtcaccctcagtttcctcgtcatgttcatcttctcaaagataagtttcaagtgtgtcatttccttcactcaatctccatggctcttcattgcctgccaagttaacaaccaagtcctcatggacatttgaatccttccaaaacttggcttatgtctttctggccttggagccctttatttccctagatttctagttccctatttcttcctaagcatgcagaagctccctctgatcaagcccttccctttgcttttgctagttgaagactggctacctgaagaccaactctggctgttgaaattctattcatcctataaggtgcttctcaagcataacctgcttctctggcactttcctgaagcaccagtgaaatattcaccaattcatcattcattcatccattccacaagtatttcagtgagcacggcaaagttccaattcccatgctgaatataggggatgcggggtgcacaaaaagaacagtgacccctacgcccatagatgttacggtctgtgggggagatgggcctcaagcaaatattctcacaagtcaatgcaaaattacactactgtgcatgctataaaaggaagatttgtgttactataatgcatgtaaactggacttaggaatatcgagagaggtgcccctgggaaagtgatgcttgaactgggctgtaaaggatgagtagccttgccaggcatagtggctcaggcctgtattctcagcactttgggaggccaaagcgggtggatcacttgagcctaggagttcgagaccggcctgggcaacatggcaaaactccacccctacaaaaaatacaaaaactatctggcatggtggcacacctgtagtatcagttactctagaggataacctgagcccagtaagtcaaggctgcagtgagctgtgatcatgccacagcactccagcctgggtgacagagtgagaccctgtttccaaaaaaaaaaaaaaaggataggttgcctctaagttggcaaagagaggaaggacaatggttaaagatggatacatgaatgcatgtgcaaaggccctgtggtggaagccccaccagtttattcaacacctatttgctggtgttggagata

SEQ ID NO: 13376 - DNA, 40641 bp, Human
ggtaatgaaataatctatacaacacacccccatgacacaagtttacctatgtaacaaatctttacatgtacccctgaacctaaaagttaaaaataataatttaataataaaagcacagataggtaagaggaacagctagatatttaaaaggtagatattttggaggagatctgttttctttggggaagggtcttactctgttgcccaggctggagcagtggtgccatgatcgctcactccagtcttgaactcctggcctcaagcaatcctccacctcagtctcttgagtagtcaggactacacgcttgtgccaccatgctcggctaatttttaaaaatattttgtagagacagagtctcactatgttgcccaggctggtcttgaactcctggcctcaagcgatcctcctgccacggtctcccaaagtgttgagattacaggtgtgagtcctgtgcctggccagaggtttgtcagtcttatcatctatgaattaattcaatagacatcacgaccacatttccaaaacaaacatcaggaattatgatgtgacaagtcaaaatgcattggttggggacagaatcttttaaatagaaattgtcccataaaatttgagacgtatagtttctgtacctaaatgaccattcagtgatcttggaaatctatagtgctgctcgtcaccaactcctgatatgtttcaattctgtttgcaatggacaataataaaataatatgtgagtgtggcctcaggtattctgagtttgggcactgctgtttccatctgaggaccaagacctacacatctcagtagcactgaaaaagtgaacaaactggtatagagtgccagaaaacttgatcagaatacattatatatactctaaacctgaaaaccacactccctaatattgcgctggtgagctggcaggtaaaggaaaaaacattgagaaagacagcagcccccagaagagaaacaatcctaaaagaaatgtccaaattgccaattactttctgtttgtcaaagtctctactggaggtgcatggaagtttggtgagaagaatgaacctttgtgcaagatccctcagctgacagacctgtgagtgcctctgggtggctgctttgtcttacagaaggcattttgtttcctgacactttttcctgtggcctttgctcttcgtattctgtatgttaggcttctgtttctatcaatatttgtcattaatagcatttacattgctccttcagaatttatttattttgagacagggtctcgctctgttgcccaggcctgagtgcagtggcacgattatagctcactgcaagcttggacccccggggctcaggggatcctcccaccttagccgcccaagtacctggggccacaggcgtgtgccaccacacctggataattttttttttttctgagtttcactcttgtcacccagactggagtgcaatggcatagtctcggctcactgcaacccgtctcccgggttcaagcgattttcccacctcagcctcccaagtagctgggattacaggcgcccgccaccacacccagctaatttttgtatttttagtagagacggggttttaccattttggtcaggctggtctcgaactcctgacctcaggtgatctgcccgccttggcctcccaaagtgctaggattacaggcgtgagccaccgcgcccggcccaatttttattatttttattttatttttttatagacacgggatctctctctgttgcccgcaaactcctgggctcaagcgatcctccagccttggtgagagccacagcgcccagtctctctttaagaatttaaaaagcagtttcagatcacaatatcatctatctcgttcacagtccccttgctttttactgtcaccctttaaaaagcattatacaattacagaaacggtggtttagcagtgaagtaaccaccaaagactcttggcactccaatcctctgccttcttcaggcgataggattaagaatgggatcctaggatgcttacatgcaatgatgaacccgaaaacacttgcaaagtgctacgcaaatattgatcacgaagaaggaagtcctcttcccgcctggagactgtgtggggtatggcggggtggtggggagaatgtggtgtcttgctccaccctcctggcgaggggagggcctggcctggaccgcagaggaatcgagtgactgcccctaaaatctcctagaaccgatcccgcggccccgcccctcccgcggccccgcccctcccgcggcccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggtaactgcaacgagccggggaggctggggcgccctggggccggatgcgcggatttcccggccagcccccgtttcctgtgttctgcagcgttgacttgagcacaagacagtgacagtggagagtctaaggttgtgtgtgtaggcaactagcgattctggggcaacgcgagtgcctccgggcagggatgggtagggaggaaaagcaaagctgatgagttgcgtggtaggatcgtgagttgttttacccgggccagaacagagttcgcaaagtactggtgggggaagtcgtgcctctgttaacttccttttttgtttgttttgtttgtttgtttgttttttgtttgttttgagacagggtctcactctgtcgcccaggctggagtgcaggggcaccatctcagagctcactgcgccctctaccttacgggctcaagtgcttctcccgcctcagcctccctggtagctgggattacaggctcccaccaccatgtccggctaatttttgtatttttagtagagacgggttttcagcatgttactcaggctggtctcgaactcctgagcttaggtgatcctcccgcctcagcctcccaaagtgctgggattacagccgtgagccaccaagcccagccaactgttcccccttttaaaaccaggactgatgtattattgtcttcaaatgtgtgcataggagaggaattctaaaagaacggggcggggttgtggggaagataatcatttgtgctgggaatgaaggaacgctcacagatagtttctaatgactacgaatgaggactttgtctccacattctaatattaaaatatttctgcacattaatcagaattgggaaaggaaaaaaccccacctttattcagtactttcttccccagctttattgaagtataattaacaaataaaaattgtatatacttaaggtgtaaaacgtgttgtaatgtatgtataccttgcaaaatggttaccacggtcaatctaattatccattgcttctgcatagttaatggctttttttggatagtgaaatatttaagatctattcttttagcaaatttcaagtatatgatgcagtattggtaaccatagtcaccatggtctacatgagctctccacaatttattcatcttgctgaaataaaactttttaatccaatgcttaatgtgtgctaagcactgtgctaggcactggatttactctgggaactctgaaggtcacagagataaggaagaaggggctttttgttttggttttgtgttgtgtttattttgctgggttttatggaatatatgtggggagaaaaatgtaaatattttgtgtaaaatgtagccagagcaataaaactgatttgcaggggactggagaatttagtatttgaccatccacactaaaccacagagcagtgacttggcagagccagaaggcattatcacatctcttctttatataggaggaaacagcttctctaccccgacttaatcctgatacaaaagaaagaaaaattgctctttgctttaattgcctacagtgtgtgtgatcctcagccaccgcctttaccagctggctattcaagtttgtaacagaaattgcagatttgtgaaatctccctggaaagagtcccaggagttcttgtgaagaggatttgctgagttggcaaacttaaagaattcttgttggtagaggcagtacagtccttgggctatgggcctagaaaaactgattgtttcataatttgcaccagaatagggagagggaataaaggtggaataagaaaaggaaatctgggaatttttgagaaaaaaaaaatgttcctttagggttgccttatcctgatattactgcttattaactatatttatcaagtatcaagtagtatgatataacctacatagaatatagacaagggatttacagtcagagtttataacccaatagactgattacttttgactttcattttacaagacccctgagattctgagataatgtttaggagtgttgcaaaacttaatcagaagttaatgttagtaaactcaactgtaaaatagtagagggcaggggttcttaactctaaatccttgatgagtttagggcaggggacatgacattcctgtaattctgttatatgtttaagtagatttttctggagagaggtctgcaacttttatcagactcctaatgtcaatgaccgcaaaatacagttaagaactgctaggccgggtgtggtggctcatggctgtaatcccagcacttggggaggcagaggtgggtgaatcacttgaggtcaggaatgtaagaccagcctggccaacatgatgaaatcccgtctctactaaaaatacaaaaattagctgtgtgtggtggcaggcgcctgtaatcccagctactcgggaggctgaggcaggagaattgctggaacccaggaggcaaaagttgcagtgagtcaagatcgtgccattgcactccagcctgggtaacaagagcgagactccgtcttaaaaaacaaaaaaacaaaacaaaaaaacctgctagtatagagatggtcactaaatcaaaccatacataaaaacaagaagttacggtagcccacgcctgtaattccggcacttcgggaggctgaggcgggtgggtcacaaggtcaggagatcaagaccatcctggtcaacatggtgaaacccggtctctactaaaaaatacaaaaaattagctgggcgtagtggcgtgcactggtagtcccagctactcaggaggctgaggcaggggaatcgcttgaactcaggaggcagaggttgcagtgagccgagatcgcgccactgcactccagcctgggtgacagagcaagactccatctcaaaaaaaaaaaaaaaaaaaaaaagactactactaagagaatattgatagataatattttatttaaatatgtggcaacaatttgagttaaaactgatgtttccgctctttataggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggtatgttccaatttatttccttccagaactcagacattgctctgaggtttctttgtgatgtttgcagttcgactttgttgcaacattaggccgtaacgtttttataaaatggaaaaacatttccacatgctcaccttagtatataaaacaagtttttgttcaatacttcccatctggatgttggctcttggacatctcctttggcaggttttcatgtttgtaaagctttgttttgaattataatgcactctttatagctcatcgtcctttttttatttttattttttttttttttggagacggaatcttgctctgtcgcccaggctggagtgcagtggagtgatctcggctcactgcaaccttcgcctcccgggctcaagcaattctcctgcctcagcttcccaagtagctgggactacaggtgtgtgccaccatgcctggctaatttttgtatttttcgtagagatggatttcaccatgttggccaggctggtcttgaactcctgacctcaagtgatccacccacatcggcctcacaaaatgctgggattacaggcgtgagccactgtgcccagcctttctttctttttaaaccatgtggtttacttgtttcctttttattctttattttgatgattctcaagtctacctttctttttcagatttgttttcagatagggttttaagtatcgttactttaattgggaagatttcatagatttgtagatgttccctttaaaaaaaagagagttaaactttttttttacatcataaatatatacaatttttatttgtcaactaaaaaaaattgtaaaaacaagtatttaatactcatcgcaaaacataaaaagcctgcaatgcaaagggtttctgtggtgtagtagttaccacgctggcctaacacacggaaggtcctctgtttgaaacttgacggaaacaaaaggtttcttttgtttcccagaatctgaccaggctgcctcttcctgggagtccagagctgcgaggaacaagtgataatcctgcctccttttttttttttttttatacttaagttctagggtacatgtacacaatgtgcaggtttgatacataggtatacaagtgccatgttggtttgctgcacccatcaactcaccatttacattaggtatttctcctaatgctatccctcccccagccccccaccccctacggccctggtgtgtgatgttccccaccctgtgtccaagtgatctcattgttcaattcccacctatgaatgagaacatgcagtgtttggttttctgtccttgtgatagtttgctcagaatgatggtttccagcttcatccatgtccctgcaaaggacatgaactcatcctttttaatggctgcatagtattccatggtatatatgtgccacattttcttaatccagtctatcattgatgggcatttgggttggttccaagtctttgctcttgtgaatagtgctgcaataaacatacgtgtgcatgtgtctttatagtagcatgatttataatcctttgagtatatacccagtaatgggatggctgggtcaaatggtatttctagttctagatatttgaggaatcgccacactgtcttccacaatggttgaactagtttacagtcccaccaacagtgtaaaagtgttcctatttctccacatcatctccagcacctgttgtttcctgactttttaatgattgccattctaactggtgtgagatggtatctcattgtgggtttgatttgcatttctctgatggccagtgatgatgagcattttttcatgtgtcttttggctgcataaatgtctttttttgagaagtgtctgttcatatcctttgcccacttgttgatggggttgtttgttttttcttgtaaatttgtttaagttcattgtagattctggatattaaccctctgtcagatgggtagattacaaaaattttctcccattctgtaggttgcctgttcactctgatggtagtttcttttgctgtgcagaagctctttagtttacttagatcccatttgtctattttggcttttgttgccattgcttttggtgttttagtcatgaagtccttgcccatgcctgtgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttcctcatttcttgtttttctcaggtttgtcaaagatcagatggttgtagatgtgtggtattatttctgagggctccgttctgttccattgttctatatctctgttttggtaccagtaccatgctgttttggttactgtagccttgtagtatagtttgaagtcaggtagcatgatgcctccagctgtgttcttttggcttaggattgtcttggcaatgcaggctcttttttggttccatatgaactttaaaatagttttttccaattctgtgaagaaagtcattggtagtcttgatggggatggcattaaatctataattcatcttgtgcagaatggccatttttgcgatattgattcttccgatccatgagcatggaatgttctctcatttgtttgtgtcctcttttatttcattgagcagtggtttgtagttctccttgaagaggtccttcacatcccttgtaagttggattcgctgggtattttattctctttgaagcaattgtgaatgggagttcactcatgatttggctctgtgtttgtctgttattggtgtataggaatgcttgtgatttttgcacattgattttgtatcttgagactttgctgaagtagctaatcaccttaaggagatttggggctgagacaatggggttttctaaatatacaatcatgtcatctgcaaacagggacaatttgactccctcctaagtgaggtgacctgatttttttctcctgcctgattgccttggccagaacttccaacactatgttgaataggagtggtgagagagggcattcatgtcttgtgccagttttcaaagggaatgcttccagtttttgcccattcagtatgatattggctgtgggtttgtcataaatagctcttattattttgagatatgtcccatcaatacctagtatattgagagtttttagcatgaagggctgttgaaatttgtcgaaggccttttctgcgtctgttgagatagtcgtggtttttgtctttggttctgtttatatgatggattacgtttattgatttgtgtatgttgaaccagccttgcatcccagggatgaagccaacttgatcatggtggataagctttttgatgtgctactggattctgtttgccagtattttattgaggatttttgcatcgatgttcatcagggatattggtctaaaattctctttttttgttatgtcttggtatcaggctgatgctggcctcataaaatgagttagggaggttccctctttttctaatgattggaatagtttcagaaggaatagtaccagctcatctttgtatctctggtagaattcagggtttttagcttctttgtgatgggttcaaacatcatcctttacctcagagaagtttgttattaccgatcttctgaagcttacttctgtcacttgtctaagtcattctccgtgcagctttgttccattgctggtgaggagctgcgatcctttggaggagaagaggcactctggttttgagaattttcagcttttctgttctggtttctccccatctttgtggttttatctacctttggtttttgatgatgctgacctacatatggggttttggtgtggatgtcctttttgttgatgttgatgctattcctttctgttagttttccttctaatagtcaggaccctcagctgcaggtctgttggagtttgctggaggtccactccagaccctgtttgcctgggtatcaccagcggaggctgtagaacagcaaatattgcagaacagcaaatgttgctgcctgatccttcctctagaagctttgtcccagaagggcacccacctgtatgaggtgtcagtcggcctcgactgggaggtgtctcccagttaggctacttgggggtcagggacccacttgaggaggcagtctgtccattctcagatctcaaactccatgctggaagaaccactactcttttcaaagctgtcagacagggacgtttaagtctgcagaagtttccgctgccttttgttcagctatgccctgccgccagaggtgcagtttacagaggcaggcaggcctccttgagctgtggtgggctccactcggttcgagcttcctggctgctttgtttacctagtcaagcctcaggaatggcagacgcccctcccccagcttcactgccaccttcgcagttccatcttggactgctgttatagcagtgagcaaagctccatgggtgggggacccgccgagccagctgcaggatataatctcctggtgtgccgtttgctaagactgttggaaaagcgcagtattagggtgggagtgtcccgatttcccaggtaccatctgtcacggcttcccttggctaggaaagggaattccctgaccccttgtgcttcccaggtgaaccagtcctaatgagatgaacccagtacctctgttggaaatgcagaaatcaccgtcttctgcattgatcacgctgggagatgcagatcggagctgctcctattcggccatcttgattctggactctgatagttaaactttttatagtcttaaagatcagaagtaccagatgttcattatagaaagaaaattcagaagagaatacatcaaaataagaatcatggatagctgagtggtaggtctgtggtgactttttgtcataagtatgttacgtcagaaactgtgacgggtctgagagtttccctgctttcaagagtgtgtgtgtatatgtgtatatattacatacatatacatataaaacacatataatatacatatacataattatacacatataagctatgttatacacatagaataatatataatctatataatatacatatattctatattatagttgtaaattacacaattatgtgtaatatatgtatattttatacatatatatattctagcaagagacatgaggctttttggatcacagagaaggatggtttattacagcaaaatgcagcagccatagcaataccttagcactaatttctgtttatttattattattttttttttgtgatggagtctcactctgtcacccaggctggagtgcaatggcacaatcttggctcactgcaacctccgcctcctgggttcaagcgattctcctgcctcagactcctgaatagctgggattacaggcacatgacaccacgcctggctattttttgtatttttagtagagacagagtttccccatgttggccaggctcgtctcgaactcctgaccttaggtgatccgcctgccttggccttccaaagtgctgggattacaggcatgagccactgcatccggcctagtttttttgttttcaaagcaccggtcaccacggtgagtgaggggatgggatgagaaccaggtgagatccctgtgcatgcaggaagttgcaccaaaggagaagaaccctaaacttctgagattcatttaaatagaaactactggcacatctgcccatcctcttctctggggagagagtgagagagattgagattacttattaagcaaatctccagggttgagagggaaggtatcactaagtttattatcctggagtataagcacatgtttcaggaacaggaagtaaagaagtttacatttctaaatttctccagatttgtttatctttagggagatactgtctctgcctttcaaggcctttgctattcaatcaactcgtcagtgtcctttgcttggaaagccctgaccatgcagaaatatcaaaatattcatatagaattttctcccaacgaagtattttccccgttattaaaaatttatttttaattcgataaaccaaagataactcaaagcagataatttattattttcatttgcccattttttttcctgtgaatgagcagcattgtagggctgttaagaattggctcctttattgttaggaaatgacttttattgatcctgggtaatatctaataatattttttgctctgaaatctgttgtctgatactaaatttcatttctttttactttaccctcccctttacttttcctttgatacctgtgtggtgttttattaatcaaaaacccactgcttattattaagtgtttattaatcaaaaacacttgtctgattatcgtgctctgaacctgccttcaccccaatttattccataactgaatagatcccactctgtgaccacacctacaatcatattagccctcaattttcttttaagtgatttttctagttaatcaagatctgcagttctttgttcttttttgacagggtcttgctctgtcacccaggctggagtgcagtggcacaatcatggctcactacagcctcaacctcctgggctcaagggatcctcttgcctcagcttcccgtatatgtgcaccaccatacctggctactttttgtttgtattttttgtagagataggtttacgccatgtttcccaggctggaatttaaaaaaaagtattgctgtaaacaattattttttaaaatattttaagaataaggtaaaatatttcacatttgtccacatatttaccatttctggtgctcataagtcatttgtgtagacccagatatctgtctgctgtcattttctcttctgctagaacgaatttcttcagcatttcttttctgttttgttttgttttttgagacaaggtctcgctctgtctccccagctgaagcacagtagtggaatcatagctcactatggccttgaccttctgggctcaaacgatcctcccacctcagcgtcctgagtagctgggactacagactcatgtcaccacacttggctaatttttgtattttttgtagagagcgggtttattcatgttgcccaggatggtcttgatctcctgggctcaagtcatcctcctgcctcagcttcccaaagtgctgggactgtacgtgtgtgccactgtacccagcctagaattaatttcttttcttttcttttctttctcttttttttttgagaggagtctctctctgtcacccaggctggagtacagtggcatgatctcggctcactgcaacctccgcctcccgggttcaagtgattctcctgcctcagcctcccgagtagctgggattacaaatgtgtgccaccatgcctggctaatttttgtatttttagtagagatggggtttcaccatgttggccagggtggtctcaaactgctgacctccagtgatccgcccacctcggcttcccaaagtgctgggattacaggtgtgagccactgcaccccgccaggctagcatttcttatagtgcaggtctgttggtactctttcagattctgtatgtctaaaaaagtctttcttttgcattaatttttgaatgaattgtaggtaaatagttttttctttcagtactttaaagatgttgctccactgtcttctgatttgtattgtttcagaagagaaatttactgtcatttttatttttgtatctttgtatgtaatgtactccctctaccccccacccctggctgttttaatatttttctccttatcactggttttaagcaatttgattatgatgtcttttggtgcagttttcttcatatgtatttttcctgaggtttattgatcctcttggatctgtaaatttgtttcatttggaaaaaaaatttggccatgatttctttagtttttttttttgccccctcttccatcacttctccttcagggcctccaattacacatatattgggctgcctgaagctatcccacgtcactgatgctcagttcattttccagtttttgggtgtgtttatgggtttttttctccttctgagccttccctcccacccgctgtgtgtgtgtgttttgttttcaggtaatttctattgttatgactcaagttcatcggtcttctatagtgttttatctgctgttaatctcatctagtgtattttcatctctagattaatttgggtcttttatatatgtgttctgtggctctccttaacatgcttatgtttttctgtgccttcttgaacatacggagtatagctatcataacttaatgttcttgtctactagttctgttgtgttatttctgaatgtgtttttattggttagtttcgcttcctggttaaatgttacggttttctactttttgcatgcctggtagtttttgatcactagacatatgatctctagtgaatcactagggcacattatattgctgggtgctggatagtcttgtactttaaaaaatattcttaagctttgttctgggacacagtgaagttacttggaatcagtttgatccttggaagatttgcttttagatcagcaaatttcgccatgttattcaatacccttctgactgcttaaccctgtgatccgggtgttaatgaggttttctcactatggctggtgggaacatgaactatacctggccctgtgtgagttctggggctttttttttttttaaaaaaaaaccttttcttcttgggtagtccttttcccagtcttgggtagttttctcacactggtactcaaaggggaatctgcagatttctggggttctctatctgtgcagctcttttcccttccacactcagtcttgaagaactgtagccactcaaagttccctaaactcccaccctatcttctcaactcatgtgtctgctgggcgccacctagcttcctcctccctgctctgtggcctgaaaactttctctaggcagtagactccagcaattgtagggctcacctcattggttccctcctccagggaccactgccttgagttgcttaatgtctgatgtctgaaaatggttcatgtattttatctggtgtttttagttgtttaaggtgggagagtgaatctggtccctgttaatccatcttggctagaagctcattgattcctagtggaaatgaacatttttttccatattttctcatttttactttgaatcctttggtacttataccagattgtatagatcttgtctgtgagacccagtcatttttcagttggagaccccttgtgaagtagctatcatttggattaaaagaggagggagaatgttacttaaaacaatgacaaaactatctaaataaagaagagattgtgtatgtaggttatcttcttgcctccagccctggcccaggttggtttgtcttgtacagtgccaccagagtggtcctcctacagaagcacatttgatcatggtacatccttgggtaaaactggccatggtccccctccttaacatggccctcaggccctgtttctccagcctcgtcttttctcttcacacaccataagacccagctctcctgcactactggtccttcctcgtttaccatgtgtatactgtcacacctcatgcttttacaatgccatgacgctgagtttggtgctattcttttgtttttcttgcctcttgtgcttacatgtttagcatttagtggtctgtactgtaatttatccctccctccctccattttttccttctggacaaggtgattgttgtacataattgtattagcaaaagcatcttgagatgtatatagctattttacctatttgagaaatgagaaaatgctcaaaaaggttaaatagcttgtcttagatcatataactagtaagtataagagctagtctgttgggcttcaaagctagacattaagccctgctgaggggttcaaagtgaaagggagaagtgagggacctactcttggcttctaatctttcatcccagtgaacacctggtcaagtcatattgtaaagcagggtgatatagaggaggaacagggttgggaacaacacatgtatttcctaagaaatacttgtagcagtatgttgttatggtgaacaattttatcttatggttactcttgcaatagtagcaggcagaaatttttgtcagagacatctttgataatccttacgtactatatcagaagatctcctaatgctcttagtagataactttttttttgtaaggatggagaataatagaataacacagaaaaaatttcccaaggccatctaattaactgaattttctctgagagttgaaaccccaaaacagcccccaaaaccacttgcctatccattattttaaaagagaaaaaaatctccagagtaaaagtttctattctcttagtaaatgttccagggcttagcagcgatagaatcacagattacttcctatttgttcactcttacactaaagtgtaagcagaaccgtgtttcactattgccagtgtaatatctcttccctgtatttgaaatgttctgtactgattcatcactttattcaaccgattaatgcactagcctctctagggcctagtttcctcttgaattcaagaaacaaaatttaagctacttatggttgattatacctttggaaaactattttgtgttaattatactcaacaaacttaagaatggggaataatttatgcttggcgtaagaattgatgtatgttttcctcttagggtaccctctttctagggtcagcatactgggaaacaagttaattgtcaaaaggttgttttgttgagtgtagagtcaggaagggagaaggtaaattgttggtttaaaagagagtttaatttagaccaggtttgaatgtgaacagattatcctttctgaaggaaaatgtctattcaaaaatttcaatattgatttaaaatgtgctgacttgcccttttagaagtaagctcttaaagggatagacaggactgatactcttttccctagtaatgaatgtagaatgaatgagtcaaagcactttatacctctggcctttataagaaatacagcatgtccaaatctcactatccaactgtcctttcttgtatttcatattggttttcatattcctactttcatcttttctgagctttgtactgtggatagatgcttgagttagtttctgttgcactccattttgcttctggccagccttactgcttatcagttttataaacagaatgttccttcttgtcagttgcttaatcttttatgtatgttctgatagtcaccctattatttattttaaattggacccataatagcaactgcctacttcttacatattcaattcttttatgttctttagaccaaagaaaggcattatttagctttctttcttaggtctaatttcctaaacctttaagctcatcaccggaccatctattgaatttctttatccttagtaagttgtggagcccagaactagaaacagtatttgaaaatagtattgattgaatgctaagtattagaaaatattagaagagaatatgctgcaattctttgggtgacttaaagtgacgcatattacaacctcttaaatgcaattgtgtgttagaatattttgtataatttccctaagaactgttttctcttaccatatatgagcaaacatacatatttacgtacatgtacgtattacattcattttccaaaatgaattattcttccacttgtgagccatccattttctctccattctctacccctcacctcttcaataaatatacacttcaaatcagaatgggcctgccctgtgactttcagagcctcagagggcatgggttcattcctgcctggtcttgccccttcttttactaactgatcttgaaataaagtagcggtcttaaatctttgtcgattaacgagggaagaacagggctgctgttcagctataagcctttatctctcttctaaatgtaacactgccatttcttttcatttaaagtgaaagctatttctagttttaaaaattgagcagtgtgttctatttaagcattaattacatcaagacatattggaatatgtcttaaatctagtcttctgctttacccaaaggaacgggaggatgaaattgctactatggagtgcatcaacaatggcaagtccatctttgaggcccgcttggacatcgacatttcctggcagtgcctggagtattatgcgggcttggctgcatccatggctggtaagtcctcacctggtgtctgtgaccagctgataatgaggcagaagagcagggcctagtggtgaagggcaaagattttggaattaagacaaacctgggtgaaagtcttgggtttgtcactttctacctgggtggcctgggaattactttatctttcctaatctaaactggagataataattcctaccttcttgggttaaggattaaatgagatagtgcatgtaaagcacctagcatgatacctgagctttagaccaaattgctgaaaaaccagttttcacaagaatcggtttgtcatatttaccagttttatctatttagcaaacttttttttgacagtgtataaagttttcaacaattgatattggaaggttggtagggcctaggaaggttgcaaggaacttacatgcttcccctgctgttgagtgttcctctcatttccattttgtttcatctaagctatctaatagaggctcagtaaattcttagagaattgttaaatcaagttagatgaacatgtgtttgaaggataggcagggttctctatgtggagagaatacgtggaagccagtggaagactgcctggaacaaatagaagaatggagacagggtgagcctggtgtattgggagaagtggggaggctgcgttgactggagtacaagtcagactggtacagatgttggtgaaatcttggggagcacagacctgcatcctcctttactcctgttttccccataggtgaacacatccagctcccaggtggatcgtttggttataccagaagagaaccacttggggtatgtgtgggaataggagcatggaactacccctttcagattgcctcttggaagtcggctccagcattagcctgtggtaagaatgaattatccctccatttgagagccattcgttcattctctcgttcgttctctccccattctctacctttcacctctctataaacacacactttaaatcggaaggggcctgctctgggatattcaaagcctcagaggacatggctcgttcctgccctgtcttgcccctcaaggagcttatagttaaggttgtacacaatcatgtctagatattctcaggttttatttatttaattttgtatatgaaaagaaatttaattttttcttattaaattgaattagatttgtgctacttataagttctcttcctttctggacaagaattttaaggtaggagttagcacttaggagtttgacttcatttacgaagcagaagataaactcctttcttcatttgggtcttaagagaaatgataagcaaggctttgataagcttcttatcaaagaggagctttggctgattgacataaaatagttttcttacagtatttaaagagaagaatctttgaggaaagaagactaattttatcttagaaaaaattgtaatgttagaaagcattactgttaggacattatattgaaatgcagcttttgtcctgttgccattgcatgttcttgttttagcctatttctctttgagatacagctgtgaaagaggaaaaatagtcactagctttaatagtcaccagaattaagtcactagctttggggactctcatcaagtgaaccattctggtcttcaatgtcaacttttataaaatggagctaatgatacctacttcatactgctgttgaaagtgttaaatgagataatatatgtgaaaaggcctagatatgcaaatgtgagactgggcaactgtagggtttgggatctgtttaatgagagaaaccaagatgaaaaggacaagagttgtttacttattgatatggtttggctgtgtccccacccaaatctcaacttgaattgtatcacccagaattcccatgtgttgtgggagggacccagggggaggtaattgaatcatgggggctggtctttctcatgctattctcctgatagtgaataagtctcatgagatctgatgggtttatcaggggtttccgcttttgctgctgcttcatttttctcctgccgccaatgtaagaagtgactttcacctcccgccatgattctgaggcctccctagccatgtggaactgtaaatccaattaagcctctttctgttcccagtttcgggtatgtctttatcagcagcatgaaaacaaactaatatggttattaataacatttttgatgtaggatttggttggggaagaggaaacaattggaatcatttttgaattgtcctctagtcctgttttcaggggatcactggtcttagaaagtctttttatgtttgtgtcttgggtttatgcaggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaaggtgaggacaaaaccagtattggtcaacacacatggcatttggatgtggcaaatccggtcctacccagagtatattttggaggcttctcttttgattttacctagcctgaattgggaatgggaaggagattttattaggcagaggtgtgaaatttcctgtaaaagtatgaagggggaaagggagtacacatggggtgatttgtgttaggccaggtaggggtggaaattaacagccccagcctaaggagaggatgtgtcttagtggacaggggcctgggctgccacttgtattgtttagtgacttaatttcttgtatagaagaaaggatttttactcaggctatttcagatccattattttgacattaatttgtgttctgaactctgtcagccttaaacacagtaacaataacacaaaagaatttctggctatgacaatcctgtgaattgacaatattttttatttttatttttttgagacagggtctcaccctgttgcccaggctggattatagtggtgtagtcacagcttactgcagccttcaactcctgggctcaggcagtcctcctgcttcagcctcctaagaagctgagactacagtcatgtgccactgtgcctggctaagtttcttatttttctgtagagatagggtcttgctatgttgcccaggctgggacaatattttttaaatgaactccctcttctaatgtcagtgcaactctgtggattctcttcagttttctggaatagaatattttaatagccaaaaggcaaaggatattgacaagaataaggctacaggtcacaaacagttcaagatgattttgtaggttcagggcctagttgacttagcatgcaatataatttgtgttaaagttctgaataccttgtccttgttctgcaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtatgtacctgtccctggaagaggtgtaaaaggaatctctaccccctcatccaacagtgtgttttaaagctttttgttttacaatactttcagacttacagaaaagttgcacaaatagtacaaagaattcccatgtacctttgaaccagatttctcaaatattaacattttaacagattcactttatcatcttctttatctgcctgtacatacgtaggcatattaagtttttctgaaccttgagagtaaattgtagacataaggcccctaacctctaaatataaagttcctaaaaacaagtgcattcttttacataagcacggtacacttagtaaaattaaaaaattaacattgatatagtactgttactgaatctatagcccttactcaatctatagcccttattcaaattttgccacttgtttgactaatgtcctcatagtaaaatagaacaaaaatggttttttttccggtctaggatccagtcaaggatgatgcattgcctttagttgtcttgtctttaatctcctttagctgagaacagttcttcagttattcttgtctttcaggacattgacattttgggagaacaggccattcattttgtagaatgttccttagtttgggtctgtctgatgttttctgttagattcatattatgaatttttggcaaaaataccacaaacatgatgtcatatcctactcagtggtgatttaactttgatcacttgctttaaggtaagtcttcactgtaaagttactgttttttactttgtggttaataagatcttgtaggaggtattttgagactatcctgttcctcatcaaactttcatgcagtaaatacttctatcaccactgacgattcttgctgaaaacaatttttattatggggttgcaaatggtgattttccaattccatcatttcttctatatttgttcaccttctactgtaagaaagaacttgcccttcacccctgtttgttttccattcatttatttatatcagtatggacccatggattcttatttcattctatgtgttataatccaatactatcattatttatttattttttatttttatttatttacttacttattttttgagacggagtctagctctgtcccccagacggtagtgcagtggcacgatctcggctcactgcatcctctgcctcccaggtttaagcgattcccccgcctcagcctcctgagtagctgggattacaggtgcccgccaccatgcccagctaatttttgtatttttagtagagacagagtttcactgtgttggccaggctggtctcaaactcctgacttcacaatccacccacgttggcctcccaaagtgctgggattacaagtgtgagccactgtacccggcctttattttatttttttattgagacggagtctcactctgtcacccaggctggagtgcagtggcacgatctcagctcactgcaacctccaccacctgggttcgggttcaagtgattctcctgtttcagcctcccaaatagctgggactacaggtgtgtgccaccacggctggctaattttttttttttttttttttttgagacagagtcttgctctgtcgcccaggctggagtacagtggtgcgatctcggctcactgcaagctctgtctcctgggttcatgccattcttctgcctcagcctcccaagtagctgagactacaggcacccgccaccacgcctggctaattttttgtgtttttagtagagatgaggttttaccatgttagccaggatggtctggatctcctgacctcatgatacacctgccttggcctcccaaagtgctgggattacaggcatgagccattgtacccagcctcattatttattttgatgctaaaataattgcagatggctggtgggaatccctttccgtgaccttttgatatgccctcattattctttgaatacttcattactttctggcatagcaaagtgttccagactcatacttcccctggctgtgctctggaaccagccatttctctgaaggaggcctggttccattattgtttatctgtttattattaatttttgagacagggtcctgctctgttgcccaggccggagtgcagtggtgctttcttggctcactgcaatctcggcccctccaaggtcaaacaatcctcccacctcagtctccagtgtagcacaccaccacattcagctaatttttgtattttttgtagagacggggtttcactgtgttggccaggctggtcttgaactcctgggctcaagtgatccaaatgcctcggcctcccaaagtgctgggattgcaggcatgtgccaccgtgcccggcctgttttttattttttgtaaatttttttttatgatttagaaggactatcttcaaaccagtacaagtatttcataaataatatctgattgttttctaaccagttgagtaatttgttgcacgataagccacctcacatctttcagcaagaaaaatactaagtctgaacagtaaagacattacacaatgagttaggacacaattaaaatctgctttaaatatttttttgggggagaggacaccacacttctctactaaataaagagaaacaattttgcagtccagaggtcttttatttttttatacctatcatgccatgaattcatagggaataggttccagcatctcaggctccttcccgttggttctcacacagtgggattccctgggtggagtaggctggtgcttcagctgaaaccaggtacctttctctttggcttccttctttttctgatcatcttctttcatgcatttcagaagctatcttgggtcttagagcgcttaatgtgctcaatgtgcacgttaattctcttggcaagaattttgcccttaatttgtttacagcagtgccaacaacatgctgggtaacattgtagactcttccagtttttcccaggtaatgcttttgggcattcctttttgaatagtacccgttcgcttgatgtctacagtattgcctttcttatagatttgcatgcacgtggcccaaggaacaactccatgttttctaaaaggcctagagaacatatattgggtaattcttctctttccctgtgtttgtcgttttggtgaattactggaagacggcagtaccaaccaaaagccctggttccatttagtggtaaatggtatttagaaaccaagatctgagtgccaggtgtgcttgttgctactggtgtatcattgcttctaggccctctcagaggccagtgctgggaaatacatgtttgtatatatgtctgtgcacatatctagttctgtatctgtctgtctacataataataagttcatccagatactttaattatagtctaataccacagggttcatttctgccttctccctttccatatttgtatttgttctctgacagtaagaaatttgactcccattatccacaatgtttatctaattgctcatcatagaatacacttagtattctaataatagtagtttcagatttgtaaatccatacctctgtggaaaataaaccttctaattagagctcagaatttttttacagttgtttttatattcagcgtgagagtatagtcagaatactgtgttcaaaagttacttgggtcagttctacctttccttcaccctccttcagtgtggttatgatactcatttaaaataacagattcatttgtttgtgtttgtattcatttgggttttatttcccccatccttgctgattttaaaattttattttgattaggcaaaacacaaacatggttctaaacatcagaattttacaaaaacagatactcagaagtgttactgctccccatcctgtgtactctgtttccagtgcctccttcccacccagttttgtccatctcctgtgggtagccagtctgatttgtttctggtttttgcttcctgtgtttctttttccacaaatgaataggtacttgtatatttcttattcttctttcatacacaaaaggtagcacattagaggtactcttttgtactttgctttctttgctatgtgtgtgtgtggatgaatatacacacacaaagaatacatatagtatagaatatatagaataaatatatagaatattctacataatctgtactatgtatactttatatatatagagagagagagagagagagcactaaaaataattgtgacgtaatgtgaatttattttattattattattttttcgagatggagtctcactctgtagcccaagttggagtgcagtgacacgatcttggttcactgcaaccttcgcccctggagctcaagcgattctcctgcctcaccctcccaagtagctgggactagaggcatgcgctaccacacccggttaatttttttgtatttttagtagagacagggtttcaccatgttggccaggctggtcttgaactcctgagctcaggcgatccacccgcctcagccttccaaagtgtgggattataggcgtgagccaccacgcctggcatgagccaccatgcccagtgtgattttaaatatgtatcacaatttatccgttcatctggcaatggggttatttccttatcttggttattgtgaataatgctgcactgagcatgggagtgcagatatgtctttaagctactgatttcatttcctttggtatatacccagaagaggaattgctgaatcataggatggttctatttttaattttttttttttttttttttgattcggagtctcacttagttgcccaggctggagtgcaatggcacgatctcagctcactgcaacttccgcctcctgggttcaagtgattttcctgccttagcctcctgagtagctgggattacaggcatgtgccaccacgcctgactaattttgtatttttagtagagacggggtttctccatgttggccaggctggtctcgaactcctgacctcaggtgatctgcccacctcggcctcccaaagtgctgggattgcaggcatgagccgctgttccctgccaatttttaattttttaaagagcccctatcctgttttccttcatggctatactaacttagattctttttttttttttttttttttttttagtgaaaggaagtttattaagaaagtaaaggaataaagaatggctactccgtaggcagagctgccccaggggctgctggttgcccctttttgtggttatttcttgatcgtatgctaaacaaggggtgggttattcatgcctcctcattttagaccatatagggtaaaatgacgttgccatggcatttgtaaactgtcatggtgctgatgggtatgtcttttagcatgttgatgcattataattagcatataatgagcagcaatgacgaccagcggtcactcatcaccatcttggttttggtgggtcttagctggcttctttaccacagcttgttttatcagcaaggtctttatgacctgtatcttgtgctgatctcctatcttatcctgtgacttagaatgtctaacttcttgggaatgcagtccagtacgtctcagccttattttacccagcacctacttaagatgaagttgctctagttcaaacacctgtgacatttcccctctcccttttataaaagaacccttaatcctaagggttgcagagggacaaagatccatcttctgtaaactttttcatgctgaataggggcaatgatattcctgtctaattattagggtctcttgtattcaggatagagaggagctcagtcagaaagcgtcagggtgagggtcgcttataactccgagttccgacaaaaggtgatatccagagttggccaatcagtgctgcagtctatttcttttgggtcgggaggatctcctcagtattgtcccttccatggtttgccagaaagatgttactgcaaaggggccctgatccagaccccaagagagggttcttggatcttgtgcaagaaagaattcaggacaagtccataaagtgaaagtaagtttattaagaaagtaaaggaataaagaatggctactccataggcagagcagcctatactaatttatattctcaccagcggtataccaagatttccttttctccgcatcctcaccaacacttgttatcttttatctttttgataataaccatgctaacagatatgaagtgatacctcattgtgattttgatttgcattttcctgatgattagtgatgtggagcatcttttcataaacttgttggccatttgtatgtttctggaaatatgtctatccaggtcttttgcccattcgtaatcagaggttttttttttttttttttgcaattgaatagtgtgagttccttatatattgtgatgatttttttgtgtgtatggtaaagcctaatgtaaaatttaccaatttaaccgtgtgtgtgtgtgtgtgtgtgtgtgtgtgtgtgtgtgtgtgtttgtattttttttattttttatttttttattttttggagacaggatcttactctgttgctcaggctggagtacagtgacatcatcccagctcactgcagcctcaacctcccaagctcaagtgatattcccacttcagcctcctgggtagctgggactataggcatgtggcaccatgcctggctaatttttgtattttttgtagagatgagatttcgccatgttgcccatgctggtcttgaactcctgagctcaagcaattctcctgcttcagcctcccaaggtgctggaactacaggcgtgagccaccacacctggcctttttgaaccatttttaagtgtagagttcagtgacatttaatacattcacgttgtgtacaactatcatcattattcatctctagaactttttcatcaccccacattgaaaactgtgtaccccattaaataataactctgtttctctctcccctcagcctctggtaaccactagtctaattcccgtctctatgaatttgactattctacgtaccttttataaatgcaatcatacaatatttattattttatgtctggctcgtttcacttagtataatatcttcaggttcatccatgttgtagcatgtgtcaaaatttctttcctttttaaggctaaataatattccattgtatgtatgtatacacacacagcacacatacacacacacacagcacacacataccacattttgtttatccatttttttatttgtgaacacttaggtggtttccacttttggctgttgtgaataatgttgctatgaacattgatgtacagatatctatagtagaagtatctgctttcagttcttttgggtatatatccagaagtggaataagtggatcatatgataattcagtgtttaattttttgaggaaccactgtactgtgccctacaatggcagcaccattttacatttctacaagcaatgcacaaagtttccaatttctctacatccttgccaacacatgttattttcttattttcttgctttctctgtttttgataatagtcatcctattgggtatgaagtggtatctcattgtggttttgatttgcatttccctgattattagtgatattgactgcatatgtaattttataagatattgccaaatccctctctaaaaggaaatgttgcattcttttttttttgtttgttagttaagcaattattttattgctcaagtacatagacaaatttatgcaaccagggcagaggctgtatatgattcatatttccagttgggagagaggactcacttggtcttataatatcgagccaaacagtgaatccggctctctatcagaatcagacagaatttagcatcctcatcctttctcttcctctcaagaagcttttgaacagcaactgctgccttaattaaatggtagagatcttcagggagattaggagcggtcccttagacttaagaattcttaagattttattgcctgtcacaaatcgtacttgtgcagcatcatgtgaatctctcaggatcccaccgatttgtgaaggagtcaggcccttcttggccagtttttaaatctgctccttcatgtcgtcagatgtcaacttcagcccctacttcagcaaccccacttcagtggggatgctgcagcgatagagcaaagctgactgagacagacccttcccagaagcgtgcatgtgacccatgatggcagctgtcaggcagcaaaaggaacattcttactaacgatgcatgagtacctatttcttcatagcctttcttaacagcatatatagtcacaattttaaatttttatcagatagatgagaagtggtatttcagtatagttttaatttcagtttgtttgtttgtttatttatttattatctttgagacggagtctcgctctgtcgcccaggctggggtgcaatgggacgatctcggctcactgcaacctccatctcccacgttgaactagttctcccaccttagcctcctatagctgggactataggtgtgcgccaccacacccagccaattttttgtatttttagtagagatgacgtcttgccatgttggccaggttggttttgaactactgacctctagtgatccacctgcctcagcctcccaaggtgctgggattacaggcctgagccactatgcccaaccttgttttacaattatgaatgacattgaacgtctttttcaaaactcacatataataaaattcacatttttggtatgttatattatgagatatgattttccattaattgttaagagttttttaaaattagtgatgatagccttttatctgaggtaaatgttgcaaataattttattccaattttttaatggtcttggcttagtttaaggtatttgccatgcataaaatttttatttttctatagtcaaatttatcaattttttttctttaattgtgtctagattttgggtaatagaaaacctttttctacacctaggttttagaggaattaccagtattgtctctttttttaaaaaaaaaaaagtctcgctctctcatgcaggctggagtgcagtgacgcagtcagggttcactgtgtgtatccttgacctcttaggctcaagtgaccctcccaccttagcctcccaagtagctgggactacaggtgcgtgtcaccacacccaactaatttttatgttttttgtagagatggggtttcatcatgttgccccagctgattttggactcctgagctcaagtgatccgcccaccttgtcctcccaaagtgctgggattacagatgtgagccactgcgccctgatttcttattttatattttgattcctgatacatttggagtttatttttatatgtgatgtaagatatgtatcttattttatgttttccacattactgatgatttgttctagcaccatttatttagttcatctctgtcctaatagtttagctttcacttttatcatagactagatttccatgagcacttggctgtgtttttggacttttctgttctgtgttcttacagcatttgaacagtttttatgttcctttctataggagggtctaaatagtgattattagtgatttcagagacaaattttttaacaattagatttaagaccacagttcttgatataggtttactgttaagttcccttccattcttaaaatatacagccagattgagccctgatatgaggaagtaggagaggtgctgtgggttatatggatctagtaatggcctttaaaaaatttaaacaagcaaaataagaactaacttttacctcaaagggcagattttgcttgtggagtggtatgtccacaattacgtgtgtgatccttcttattcagtatggagacaatttttagaaatggaaatatccttttaaaaaatgtatagtgtctcttttcagtttaaagtttttagattgtgttcatttttccttttcccttttttctccttacacacatagaaattgatgtcttgtgtttgtcctttaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcaggtaagaaataattggcagtagggtggggttggggaagattatactactcctaaatcacatgctttgtgcccttttcatgttaatattcgtatgactattattcattggactattagcatccctggctgtgttctgctttgtacctgcactgggaagactatgtgtttgttcgggatacaattaacatttcaggaatgcattttggggttatatttttaatacaacatatcttttttccttttcggcagggtgctaaagtgttatgtggtggagatatatatgtacctgaagatcccaaattaaaggatggatattacatgagaccttgtgtattaagtatgtcctctttttgtttgcttttagatgatttgaattaaatactgaatagatagagatgaatatttataaaatatgtacatgatataaagcaagggctggcaaattatgtggtcctactacccaagtttaagaagtagaactgctccattatctttgaagccttctgtgtgcccctcctttagggcacccatatgtattagtttatccaggaccacaactattgttctggaagcaaggagctcaaaaatatgaaagtgcatatttgattaaaaaaattaataaatttaattccttgagaaaataaagaatgtttttcatgtgacctgtagatcattgtattagacattttgcattgctatgaaggaatatctaagactgggtaagtagaaaagatgtttatttggctcatggttctgcagactgtacaggaagcatggcaccatcatctcctcctgttgaggcctcaggaagatttcagtcatggtggaaggtgaaaggggagcagacgagtcacatggtgaaagagagagcaagagaggcaccaggctcttttaaacagccagctctgtgtgaactcacagagtgagaatgcactcattaccatggggaggacatcaaaccgttcatgagggatttgccccgtgacccaaacacctcccactaggctctacctccaacaatggggatcatacttcaacatgagatttggaggagaaaggcatccagaccatatcagtcatcaatataataaaaccagtatgtcagataatatactaatctttttagaaattacataatttaataatttttagcacctccattcagtcttaaaaatctagttttgacagtcaaggtgtatatgggcatcctactcccacccatctacttccctcctacttcagaggtaactactattctcagtgttgtttttatcattcttatgcttttctctatcattttatagtgtatgttagtatcccctacaaaaatgttgatagttttgtaggctttaaacaattatatgtaggttgaaccatgttgtataattccttacatcttatttggagataaattaagctggtttttgcccctaaggttaatagtggtgtcagtttttaacaacttcatatttgatgcagtatataacctttaatcctcactagaaagaaccattgacatttaaaagctgaaaacctaatgtccatcccccatgaattaggttgcagttattacatgaatatttaataaataggaaaagcttacaatacattgttaaattaaaaatattggggctaggtgcagtggaacacccccagcactttgggaggctgaggcaggaggatcgctggagcccaggtgtttgagaccagactgggcaacatagtgagacccgatcttcaaaaaattagctgggggtggtggtgcacactgtggtcccagctgctcaggaggttttattttaatgtttgcagctaattgcagagacgacatgacctgtgtgaaggaagagatctttgggcctgttatgtccattttatcatttgacactgaagctgaggttctagaaagagccaatgataccacttttggactagcagctggcgtctttaccaggtatgtggagtgggacactgagagcagttttgaaggagcggggctgcagtatctgcttagatatttaattgatcctattctctcactttagtttgccctcataggagccatcagcactttctgtttgcttcaggttaagtcagaagacaccaaagcagcattttgcagtttgctgtaaatggccagagaaccctgctattgagttttaaattgagctcgtttaataaacacttaagattctgatctatgtaaagcattgggttagatgtcttttgaaaacacacatgtcaaggaatttagaaacctgtaagtatataaattgtgggcagtattcttcaaaaacatgatttttagtggcattatagtagttcctaattggaatgcattataactcatgtagccattttttctgtggttggatatttgggatattgtttctattttaaatattatagtaatatgattaatatctttgtgcataaactttactattacaagtaaaaatgatttgggagtacaatttctttgaaaccaattgcagattgcttggttttatacaaactttgattagtctttggcagtagaaggcagtttgctaaagcggctttacacttgggattatgctgtttctttggtgatacataaagttcacatttttttttttataacttcatggtcaagagcttgggaagaaagcccaagtctcacttgaggacctgatgtaattgcttctctttgagctccgaagaaaagattgaggagctgctcttttgatttggggagtgagcaggttaagtgctcttactttactttgccaccctcgtacagacaaagtccggttacaaaggcgggtaactccaatgtgctattctttttttcttaccagctttactgggataatgcacatactgtacaattcacccacttaaagtgtacaattcagtggttttagtttattcatggagttgtgcaaccatcaccataatctatttttaggacactttcatcatctcaagaagaaaccttgtgcccattaactgttgctcttcattcccactccccacccccagcccctggcatccactaaactactttctatctccatggatttgcccattctgaacattttatataaatggaatcatacagtatatattcttttgtgactggcttctttcacttagcataatgttttcaaggttcatttgtgttgtggcatttatcagtactttattcccaaataatattccgtggtatggatatgtaccactttttgttcgtccattcatctgttacaggcatttgggttgttttcatttttggctattatgaataatgatgctatgaacatatgtgtacaggcctttgtgtggacatatattttcgtttctgttgggtgtatatctagtagtgaattgctgggtaacatggtaactttatgtttaactttttgaggaactgctaaactcttccaaattcgcagcaccattttacattcctccgaacaacgtatgaaggttctaatttgtccacatcctcaccagcccttgttattgtctgtccttctggttttagccatccttgtgggtgtgaagtagtatctcattgtggtttttatttgcatttctgtgggttttcttttcactttcttgatagtcttatttgtagcacaaaattttaaattttgaccaattctaattctgttttttttatctgttacttttggtgtcatagtctaagaaatctttccctgacccacggtcatgaagatttattcctctgttttcttcaaagagttttatagttctcagtctgacatttttaggtctgtgatgcgtttaagttaatttttgtgtatggtgtaagaaagggctccacctttattttttgcatgtagatatccacttgtttcagcaccatttgttaaaaagactgtttttcctccattgaattttggtacccttattgctgttacttattttaaagataccatgtgcatgggactataaaacccaatccatatctgttttgcctggatgataaaagattttaaaacattttgaagaaatgagaatttagtaagatttgagaaccctagaactggcagtgtaacttttcctgttaaagtagtagcctaagaaactctcaataatgcacacattttttttttcttcatagggacatccaacgggctcatagagtggtagctgagcttcaggctgggacgtgcttcattaacaactataacgtcagcccagtggagttgccctttggtggatataagaagtcaggtgaggagctgggaggtgtgaatgcaaactaggtctctagagctaggtcgtaattcagaccttataaaccagtattcctaaacctgtctgcatatctgaattacctggggaaatacaggttcctggtccttccccagatccactgtagcagtctctgggaatggaagtcaagcatcttcccctacccaacactccctaaatctttctggagggttctgatgtatagcctggcttgtgaactgctgatagatatctcaaaaaggtttatcttgtgggtagaatactttttcttcacagcctgtgacttctgtaagcataaaatcactcccttaggggttctgtatcagggatgtccatcatcatccactgtggagtttttagattccatttaggtaaagtgtctttcaagtaatagctcagtaactttgtttcctctgttatgtcaaattaacaaaatctttaaatttatcattaagcaatcaattataatcgttttcattacccttgatggcatataggagtgtgtttccttagccactgctcattcatttcattcattttatagtcagacatatgttaccacaacatataaatttgtaagtctggtatatcaggagaaggtttgaggcatcaggagtatagccagaaccttgaggttctttctttggagtttgttgcctgtaaatattcatttacatatttctcatgctgttcttctagagtgaaaattggtttggactttgtcgaggcaccattctaagagtctgacctctagtttctgtggcaaatatttacagccatcacagtgttggcaaatatataaactctgatgaacactgatgagatggtgggtgttaatttgacagtcttatttgtcccggtggggtactcagaggagtcgtacacacaggcacaagtgcaggtgggaaccaaggtgccatcttattaacatgtaacatataacattacatgttaagtttctgatagtccctcagtgcagggaattatttgtttggaatcagcagcttaggcctttggagggcctcctaactttccctttcctttggaccagaccatgctatgtggaatgagagagcgagaaagatggccagacgtgcagagcaacacctggcctaacaggcctgaccagctgtgtgcttaggggatttggaaaggaacaaaagacagagtgaggttttcccaggacctttgtgtgtgataccatttgagtggtgctccctggaaatgcacatatttgggacctcggccttgcccttggaaggcagagcctacctaagtctagcacagggtgtacaggcagggccaagggtgggatactacccttttagcacagtaacctcacccactagtaattgggcagtgtcttgaactctgagtaatcagagggaccttcagtgacccctcaccaacatgagtgggtaggttaagttactaggttgctcttataggtgtttaagaaatggtgaataagcctattgtgtaaagttttaaattagcatcagctttcaagggtgtcaggttgattattgtagagattgcctttaacacttgatataaaatccaagcatttttcagacctcaacccagaatagtagatacctgaaattaagattcctattggtgagaaacaagatctgtatatttccctatccctatccccaaatgccagtgggtcattttccccatgcctagctccattcacagctaatatgtggattgaggctttattccaaaacatttaggttctatattcttccctagccctgattagcagtgctcatctttgaagatcattgtgacttttcagactattgtagtgatggctcaacctgaccccttctcctcctttcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattcgataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgttaattgttttcctatcgtgttttgaaactaaacgtatcttgaggttatgggaggacagaggatagggctgatgttagaagcacaaagcagggggatttgatcttgtagtaagaacaaaagaacaggtttggttgcagtgatgaactttatggtccaggtaagcatttaggctccatgttcattctcacccggataagcagtgcctgtccctgaagagttgtcaggtcactgtggcttttcagactattgcagtcatgcctcactctgcctccttctcttcctttcaggagaagagtttataaatcatagctaatttagtagtcagagataagggatgcttgttgtcactgggcctggatctaattatgtattatgatgagcaagtactgtagttttagagcataagaacaaccaaatcagcctttcttggtatttctttgcacagaggacacatatgtgatactggacaaagccaatagcgttaccctgtgtccaaggggatcctatgcaccttaagcagtaggagctgcctgggagaagataagtttctgatagtccctctaaagcaagcttgtccaatccgcagcccacagtccatatgcagcccaggacagctttgaatgcagccaaacacaaatttgtaaactttcttaaaacgtgggtttttttttttttttggcaatatttttttcttttagctcatcgactgtcgttaatgttagtgtattttatgtgtggcccaagacaattcttcttcttccagcgtggcccagggaagccaaacgattggacacctctgcaagagaaaacagcaggggaaagggaagcaacatttaagtactcactgttcctactgctacattccttctcatttaatacactaagcctaagaaagggattatctctgattttcaaatgaagaaacagatttggagacatcttggtcccaggcaagtgtgatattttgtgcctatatataaaattatatatcttttcatccatggttcctggctcataagtcccttggtacggttttttgttacaatgttggggcactttaggcctcagaaaacagaatgtccctctctgcccttctgccctcctttttacctgcccaaggctgggctctaatcttccaccacttttctgattatgggtcataagaccttcatttcagaaggggtcctgcctgctgccctgcaggaaaaatgccgcacaagccaggaatctgaagacccttgctgggtttccccgctcagcctcctttgtattagatcatacccctttagtccagtcacatttctacatggtgtctgtgcttcagtcatgcctctctaatgaagtctaagaggcccaagaggacgggcttcagggagctcctggagagctgaacatgtggaggtttataggagggtgaataagaacatgtgcatgtgccaggaaggtggtgcaccccaactccacgggaacagaggctcctgtgcttgggacccttgcagacctggccgtatgtatcccttcatttagttgtttatttgtgtcctttaaaatactctttttttttcccccagaaacagggtctcactccatcatctggggtctcgctctgtcatgtcactgaactaaagtagagtggtgtgatcatagctcactgcagcctcgaccttcctgggttcgagtgaacctcccacctctcagcctccccagtagctgggactacaggcatgtgccaccaggcctagctaatttttgtgttttctgtagagaaagggtttcaccattttgcccaggctggtcttgaactcctgggctcaagtgatcctccaacctcagcctcccaaagcactgggattacaggcatgagccactgcacctggcctaggatattctttttaataaactagtaaatgcatgtctcagttctgtgagtcactgtagcgaattaaccgaccctcaacttgaagccagttgatcaagttccagaagcctggacttgcagttggttggg

SEQ ID NO: 13377 - DNA, 22334 bp, Human
gttcaagaccagccaggccaacatggcaaagccctgtctctactaaaaatacaaaaattagccgggtatggtggtgcacacctgtagtccctgctatgcgggaggctgaggctcgagaatcacctgaacccaagaggtagaagtttcagtgagctgagaccactccactgtactccagcctgggcaaaaagtgagactctgtctcaaaaaataataataataaatacataaataataaaataaataaaaagtgtgtcaacatactgttttcatagtcaagttactcaacctccttgagcctcaatttcttgattcctaaaatgggaacaataatagttctctatcccatagggttgtgaggaccaaatgaaatgaagcatgtaaagtatttagcacgtagtaactgcttaataaatgctatcatcatttattttcactagaggtttatcaatgtactatttttttcacaacctcatcaacattggatattatcaattttaaagatttattctaaaacagttggtataaaattatactgaagcgtgactgctgctgttccttttccccctcctcccctttcttctttttcagttggaggagaccaagaggagaggatcagtaaccagaaataaaaatgaccctttacattgagacacactgtatttttatatgtaatccttgctttctcagacaacagagctagaaagatgatcataggaactaggaaataataactattttattaaatgcatgctgttatattgaatgagccttgcccaaggtccccttctttcactaaattcattgcatctattatttattgaatacctactatatgctattcagtaggcgacattgcagctacagctgcgaataggaccaggagagtctctactttcatggagtttatatgctatcagggaggaagattatgtgtgtgtggcaggaaatgaggtgtagacacataccatacgaagataatgtggaagtgggggtggcatgaagaaaacaaaccagtgatctgaatgaccaagggctactttagattaggtctaatgttgcctctcaggaggtaacatctggggtgagccctgaactacaaggagcattacttcccacacgcataccccaaccaacccccacaatcccccgccaacccacattaagttctggaaggaatatttcagacagaagtaacagctattacaaagccctaaagagaggagggatctcagtgacctggaggaacagacaggtcagagcacagtaactaagggcaagtggtacaagatgaggtcaggtacgtgatagccagataaatgcactgtagggcttcgtatgcacggaattggattttattctaaatatgggaagccaggagttatttttaaaataaataggaagcacaagagttattttaaaaataaaaaataaaaaactctagttgctttatgggaaatgaattggaaatgacaaaactggtagcttttgtggcagaacaaacattatctattgtcctgacttagaggaagggatatttacttagcaagcctgtacgtgccaagctgttctaaacgctgaggatgaacaaaccagagttcctgccttcacggtgttcacactagcgggcagaagacagacagcacgtgtggcggtgcagagggcttggctgcaagagccgataaggaggaccctggcgactgcctagtccaaaagtcctagctagagcaagatcaacttgtactgcccttagtacagccacgtgagtggggtgaccattgaccttaaccaaaaagatgtcaaggctttcctcctcctcactcccgcgtccccagtgccaggcagagtctctcagctagaccctagcagtctcagcacacaccgcacggggcgacagcttccgggggcggagcctggtctcgctccacgtctaccgcgcctgctccccggacgaaatccgcggaccgggctttaggttcgccggaatcccacgctcccgacttctgcttccgggtcggagccatggcggtggcaaattcaagtcctgttaaccccgtggtgttctttgatgtcagtattggcggtcaggtgagatccaggaggctgcccacacctgcgccgaagggaaactgctcggggctaggcaggcagaactcacccagagagagcggactcgggaagccagccagaaagtgaaattgcacccgaacctaccgacctgccgggcggggggaaaggaggaggaggagtctccccaatcctagcgccccgcttctggaggaactgggcggttagactagggaggcggaggtgggagataccgagcggcagggtggtgggtcagcccatcatgccccctgctccgtgaagccctcatggtcttggactgggccttctgacactctcccgctgattgcaggaagttggccgcatgaagatcgagctctttgcagacgttgtgcctaagacggccgagaactttaggtaaggacgtgctccagctccgctggattagctgaggcagaagtcgggctccagtcagccgcctgaaatagcctgtctacctctgtccgtccgctcactgctcttgagacctgattcctccatgcattgctctgtctggttgccgtttggattgttcccgtgttaatttacgttgttagtctgtgtgactgcgtgtctggacgtctggctggccgattggtggacttgctggctccagtgtttattctttcccgtatttagaggcgctcacgactgtgacatcatagtgattgaatcattcattttttgtccctttcaggcagttctgcaccggagaattcaggtcagtttcagatgtgtttgacttctttgcctgctccagaggggtgttctggggctgcagtgagggtatcggtgaaccacctgctggccttgaatgattgctggtgacagtgatagaaggtaatgccccaagggtctgtccctagtttatttgccttctttatgtctgtcaaccatctttaggagagtccttttggctccagtgcatggtaaactggaaaggccttgtgctacctgctgtcactccaagtctctttcttttcggttataggaaagatggggttccaataggatacaaaggaagcaccttccacaggtaaggctcttggcaagccatcctggagtctttcagaaatatttcctgggggattaggctctttagaggaaaataaaaccagagggtaattcttacatttcttgagaagaaatgtttttgtggactcaacaactgaagatttattaaatgttctaactctacttacactcccccacttcttaggtctttaaaacagaaactactcatctttacaatatcttgtctttttcatgcacttgtttgtgcgaatgcagattttttaaaaagtacacttgtaatcctaaagtgcatataatatatcctgctggttgatatttataactaattcctaaaatgatcatatatgattgtccaaggataatcatatttcctggggagtggagtatgtcaacacttagtctcatttcaatatagaatctttctcatggcctcactgtggttagtaacaatgttagcacataattatatcacagctttagagctttgggtctctaatccccagtaagactcctgtgaagtggtatgggtgatctgcattctacagaggaggaaactgaggataagaaaggttaaggaccctccctaggggtaatagctaacagttgttaagcccttacatgtttagcagtacatttcacataaattctctgtagttctttcccccaaatttacatcaaacccttgctctgccttttgctttggcaagtaagctttcagccccttcttcttattactgttcaggtaccagatcatgcacttgatcaactctaacatgccctaatttataacgaaaatccttttttatggttaattatcctttcagcttaatcattcaggaaaagaataatcttcaggttttttttgttttgttttgtttttttgagacagagtcccactctgtcgcccaggctaaagtgcagtggcatgatcttggctcactgcaacctccgcctcctgggttcaagcaattcttctgcctcagcctcccgagtagccaggactacaggcatgtgccaccacgctcggctaatttttgtatttttagtagagacggggttttgccatgttggccaggctggtctcaaactcctggcctcatgtgatctgcctgcctcggcctcccaaactgctgggattacaggcgtgagctaccgcacccagctaagagtaatgattttataatagccaaagtgatagtgtattttgaaatcaacgttaatctaatacaataataacaacatctatgtttttctaaaccataaaatcttctcagtattctttgctctctgtttcagggtcataaaggatttcatgattcagggtggagattttgttaatgtaagtactattcctttcctatcaaagacccgtagttttagtttttgttgttattgttgcaattgctgtttttactacagagacccagtcttcaggcttgagaacaatagccaggtttgatgtgggtgttggagagaatggtgatggggaagttcttgaaagtggctgggtacgactgactgtagataaccgactttagcactttgattgaggcattaaattccatggtccaaatctcagcctttttgagccagaaattggactttttaagaatacctatagatgatctatgataggttcacactaattagtcatatgaaacttagtcagaaatcagctgtggtttttgtttttttctgaatggaggtaagtctccttctagtgggctaaatgcttgtttcattttctcttttacttctgggtgtcacagtgcctggaaagctgagtttttcataagaagttgatttgtgggcaaggaatcagagcaagagaggtagatagttctggaggaattttgctctattcactgagagagcccagtgaaatagttcttttttgctaaccatagctttcttgtaagtagactgtttttgtcccccatatgaagcctccctccccaccccaaccttggagggtgtgggataaactacattttttctttcttaaacctgcttttgtccttaccccccacttctgaatggtctttctttactcttattaatatcatttggttagttgtgttgctgttttcttggatctgggagacatgtgttctcttttatgtgtttatttagtctgaatctcatgagtttttaagacctctttcctttcctatgcaatacagggttgcagagtggcaggttttaggccgaattacgtttttacctatgttttgattcatctgcatggtgttgtataactgtgaaatggcacaaaaaaatcctagtttttttttctctttaaaaaatggaaagtggaagtatgctgggcctgcatttctcacagtggcagtgacagtgacaattggttggaatcaaggaactggtccctttggacatggcatatctttgccatttcaccagtctccacaactgtttcccttatttacgttgcctgctcctgtgggcatttgtttgcagccccgggaaacagataatggtagtagggtttgttagctggtaagaagggctgagaagctatcctctgccttctttccttttttttcccctaggcttccctgttgccttacaaggagaggaatagctttttactagtctttgccccaggcacatctgatcacttgtcgataactctggggttagacaatagttgctcagtctgaaggccgagttaaaagcaattgctggtagggctcacatctgtaatcccagtaccttgggatgctgggaggattgcttgatcccaggagtttgagaacagcttggcaacatagtaagaccctgtctctacaaaaataagaaaagttattttttatttttttatttttggtggtgtgcgcctgtagtcccaggtacttggtaggctgaggtaggaggatcccttgagcccaggaggtcaattcaaggctgcagtgagccatgttcataccactgcactccagcctgggcgacagagcaagaccttgtctaaagggaaaaaaaaaaagcttgcttagaaccttccttggggaaggcaaaatggaatgagcaagagtcagaaaaatcagaatttgagaccttccaaagtttgaccaagaatatttgtttgttcatttatttttggttttaatagtatttattattttggttgcaaaagaaaagtgcaaagaagaaaataaatcaccaaatgaattaccctcattctcacctcacaatatactattggcattttggtttacagttgtcagtcttaccttagtatgtatatgtgtgtttatataatttttaacagacttaaaataatctatatgttttactttttttgtacttcataattgtccatattttcccttgtcgttatgtcttctaaaacatgctttctaatagccacctaatatttcattatgaatagacaagttatttgatcaattcactatagttgaagataagttgctttctattgtttgctccaaattattaattttgtaattttccctattgtttctggagagctatagataacgtgattacggagaatggcacggtaactgatgtgtcccttaggttcactgggaaattggagatgaacttgttttctctcttccttctgtattaatatgtatgtgtagttagttaatgacatattagcttatttgattatttatatagtactatattgtttgtacagtgctttttacagacactatctaattgaatcttcatgataactgtaaagagtaggtaatttcatcctcacttgatagatgaggaaattgaggctcacagattggaagtgactttcccagctctaagtgatagatctggaactcaaattcagatcttttttttttttagatggagtctcgctctgtcgcccaggctggggtgcagtggtgcgatcttggcttactgcaacctccacctcccgggtgggttcaagcgattctcgtgcctcagcctcccgagtagctgggattacaggtaccaccaccacacgtggctaatttttgtatttttagtagagatggggtctcaccatgttggccaggctggtctcaaactcctgacttcaggtgatccacccgcctcagcctcccaaagtgatgggattacaggtgtgagccaccacaccaggccaggtctttctaatatacagacttgattttattttataatatttaggcaaacaaaggtttgaatttggacagtttttctttattctctggcttatattaatggtagttcttttccaaaaagggacccttgattcctcactgggtcagtgttttccctttctcccatgtactctttctctttactaactggcgaggagagcttgatctttttggcactcctcaatattgcctttaaaactcagggattctatttaaggcactgcaaatatggccttggtcaaattgttttattacccagacttcagtttcctcacatgaaaaatggggaagatgataatgcttattcctcaaggttgctggaagagcaaggagataatgcaaataaagctagtttaagcagaaattgggagtttataataaagggagtgtttcatggaactaaaggaagaaatagaactaggaactagaaccatagagaaccaaggcagttctttatctccgtttctctagtgctcgctacacatctgtgttgtgttctctctctgttctctagcccagcttgcaaatggtagtcacatccagctttcaggtttacatgttacaaatttagcctcaaagagagcatctatcccacctccagattcccagagaaggaactctagttggcccagagtgagttaggcatccttccctagatcaatcaactatgaccaggagggtggtatcatgttgtacatacagactgccaagagctcacccaccctcttagatagtttaggggaatggggtggtagtcacttaagtgggtacttttatgtgactgaaggcatgagagtcttcaggaatggcaaggattgagtatgtgatcaccttgttgctgttccctactttgtctgcatcttaattgatcgttctagaggcccagctgtgacctcttttatccagtctataaaatgctccagccagtctttgtgggctgtaggtaccttatataaggcttgatctgattgcagggtggggtcaaataggtgcagcttccaagatgaccaacaagagtaagagtagactttaaagatgtcatgctttaggtgcgacagtgttcttcctccggtttccagggacccaacactccaagtcactaatacttcccttctctctgctcagggagatggtactggagtcgccagtatttaccgggggccatttgcagatgaaaattttaaacttagacactcagctccaggcctgctttccatggtaagtgaggtccaatcaaggttttgggttatagccagctggttcctgggcccctcttgaggcccagtgctgtctcttgggatggaagcaaatgctttccttctcttgcttggcccaggactcacctttaccacctcctttcttagtctggtttgactgagaaaaccagtaggtatgctggctcacgcctgtaatcccagcactttgggaggctgaggcaggtggataacctgaggtcagcagttcgagaccagcctggccaacatggtgaaaccccatctctactaaaaatacaaaaaattagccaggtgtggtggtgggtgcctgtaatcccatctactcgggaggctgaggcaggagaatcgcttgaacccaggacggggaagttgcagtgagctgagattgccccactgcactccagcctgggcaacaagagcgaaactccatcttaaaacaaagaaaagaaagaaaagaaaaccagtaggtaaggcccactagcaggctagcaggctggggaactaaaatctgaaccaggatttgtgtctgggcattcagccctactgctcagaatgtaaacagttgtgctttcaagacatattcatagctgggtgtggtggctcacacctgtaatcccagcactttggggaggccgaagcaagaggattgcttgaggttgaggtcaggagtttgaacaatctgggcaacatagtgagacttagtctctacttaaaaaagaaaaaaaaaattagccaggtgtggtgacacacacctgtagtcccatctactagggaggctgaggtggggaggattgcttgagcccaggagtttgaggctgcagtgagccatatcctgttcatctctgtatccttggatcctagcttaggccctggctcataataggtgctaagttagatttactgaaaaaaaccatagaggaatcagtgttacaagctcttttggaaatcttgcccttcagctaacatggccggggaaacttactgcaggtatatttggtttccatcaggcgaacagtggtccaagtacaaatggctgtcagttctttatcacctgctctaagtgcgattggctggatgggaagcatgtggtgtttggtaagtcctactcctgtctcatggtccaggccccattcaccctggatggaacctccagaggagttagttctcaaactcttaccaagaaagctcaacctgtgtaactgcttaggtggtaatagagaaaacagaaatggtggggaggtggggaacatgtgtggctagagaactagagggaaggacaaaaggaccatttgatatagtatggaaccacttagggagaaaacccagttgctagcaccaaagaaatgccatagaggcagcatgatacggtgagactttggagtcactcaggtataagtttgagccctaactctacttattacctatgaccttgagcaagtcatttcacctctaccgcatcttaatttcctaaagttagtatgagggtttaatgagaaaatagctaagaatgggctttggaagctggaaaatgctatgtaaacaagaataaagtccagctcatgctcttcctacaggaaaaatcatcgatggacttctagtgatgagaaagattgaggtaagtactgctttgatttttctgtttctctgccattgtggtctggtactgtctgactagcgtgcaggagctagagaagggggaatgagctccagtttgttaggctgtcttcattgccccaggaaaagggaagagaaccacctaagttagcctgtctggccaacactgaggtttggcctctgatgatcctgttgcctacttgataaaattctactcctcagcattgcgttcaaggtccttcatgattagtccctgtctacctctccatggccccttcttctgccattgcctcttccatgttccagtcacatcaggctactagctcttctctaaatctgccatgcatgtccctgctgcttgctctttcctgcccctgagcctttgctcacacagtttcctctagccggaatgctcttctttccttccctcctgatggaatcccattcatccttctaggcacagttcaaatacccctcttttgtgaatccttccctgacctctttaagccccaatttagttgcctatctaacccttatccaattctctcttataactttttcttatataatcataagtttgatattttctaagtgttttgcattttctctttgataggtattatatgctttacctgtctgccaggacatggactgtttctgagtgctgagtccttagcacagggctggcaggcatcagtaaaagtttgataagggaacgaggaagtgcctgagtggatgaatctccattgtgctttttttcctagaatgttcccacaggccccaacaataagcccaagctacctgtggtgatctcgcagtgtggggagatgtagtccagacaaagactgaatcaggtaagtgtgtctttctcctattaggttaggaatcagacctcagagaaggcagcatggtctagtggaaagaactttagtcttgaagacatgagattgagcccagttcctccgtgtatggccttggagtagtcactttccttctctgagcacatttcctcatctgtcaaatggaaatactgtaatacctatctctcagagtcactgtaaaaataaaaagagaaagggttgtaggagcactttacttttctatcactttgtaatgtacaaagtatcaatgtgaaaactactcaggcagtttgtaacagcactctcagactacagttccattcagtagtccccctagaaagacctggctccaggcctgagtaactctctgctgggaccaggccaggcagccaggagacacacctgtcatgcctctcatcagaactgatactgcaattccaggcctcgacttcatattcgctggcctcataggtgaatgccttgcatcttccagcctacatggactcatttcttacccgtaattaccactgcctgctctgcgctgggcagcatgctagctgcagagagggggacaaagaattgaaagatgtctcctttcaggagctcatggaaagtaagacattcccagaggtgatcactagtaatatgagtgacattgccaagtatgagaagagtacaagggagaaatccatcacttccagccaggtgaggggtagtgatgttttgtttttcttttttttttattttcaaacctgcaaaaaagttagaagataataccttgaacaccaatatatcttcacttagattcaccaatgattaacattcttgttttattgctttgccttgacatttgtttttttctttcccttcttgcctcctcacccatttccattgcctctcctcctccctcctgctcctcttccctccctccatcctttccttcctttcttcccatcttccttcctttaccctttcttcttctctttcccatttgaaagttgcagacttcttgacactttacccctaagtatttcagcaaggaactcctaaaaataagaacatcctacgtaaccacaatattatctaatatatagtacattttcaaacctccccaattgtcccaaaagtaacttttgtagcttaaaaaaaggtgatccaatcaaggttcccatatttcatttcatttggtttacacaagtaacataatacactctcattgtgaaaactttcacaccaaacagataaagtgaaagcccctcttgacaatacccacctgcaattccactcccctttccaaaggtcacttccttattagtttgatgtatgtccatcagggcctttgccttgcccatctaattttgggaggttttctttttcccaaatgaaatcatactatatttttcatgttctaaaaaatatgtcttgaaaacttttccttcttagttcatgtaaaaccaccttgtattaaaaaatgaaaacagcccggcaggaggtggctcactcctgtaatcccagcactttgggaggccaaggagggcagatagcttgagctcaggagttcgagaccagcctgggcaacctggtgagatcccgtctttccaaaaaaaaaaaaaattagccaggtgtggtggtgcatgcctgtagtcccagctactcaggaggctgaggtgggaggattacttgagcccaggagtttgaggctgcagtgagctataatcacaccactgtactccagcctggatgacatcaaaaaaaaaaaaaaaaggaaaagaaaaaccgaaactgcagtgcaggctgagcatccctaatccgaaatcccaaatgctccaaaatatgaagctttttgagcactaacatgacattagaagtggaaaattccacacctgacttcatgtgatggatcatagtcaaaaatctgtttcatgcacaaacgtattaaaaatattgtataagattaccttatacaatagctataagtagctaggactacaggtgcatgccaccacgcccagctaatttttatatttcttggtagagatggggtttcatcatgttggccaggctggtccccacctcaagtggtctgcccaccttggcctcctaaagtgctaggattacaggcgtgagccactgcccccaactgagcattagttcttaattttatatgttgtaattgttttcttcagaatatattttaagaaaaaaattagtattgtgttgcttaagtttggtgatattctttgttaaagagaagttctaaattttgatgaagtccaaattatcagtctttcactgcttttcagttttgtctcatttaaggtctttactacctcagatcacaatgttttctgtgttttttctagtatttctttttatatggtggagctaagatcatttttctagtatttttaaagtcttatttgtacatttataaaatcatctataattaatttttctgtatagtgttaagataggactttttcttgtctttttttccaaatggagatccagtcaaatacctgaccattttaatgactctacaacacacctttatctgtgaccaactctgttcagaaagctggcacttacaggcattcagtaaaaatttattacatgagttaagtagagagggagaatgtcaggcattttaggcggggaactcgtgtgagcaaatgctgaggctggaatgcacaagtgtgtgctgagagctacatgtggacctctcttgttcagccagatgatcccttctcaggcccacttgacaccctgagctttcctttctgccaatactgggtcccccttgggcccagcctgctctccctcttcaatggctgctggccattccctccgtctcctactcatttctttgctgtaactaaagttgagttcataggtcctttcttttcaaagactgaccactgatcactaccagaggacaaacgataacaaaaagaataaagtttagaaattcttaatgttggggcctcttttctgtatctttttgagtcttttacataaagttactggaagtccttgttgaggttttatttctgagggtggggatcatcaaccctccccgctctcccccactgttagcaaaagttatatgaacttttgcttccaagaaagcccttcttctcagcctgcaacccaagcagaacgcattcctcaggtggccattgtacattccacaggcccgctagaccaggactgtccataggctgtgatgatggaaagattctagatctgggaggtccagtatggttgctaccagccccatgtgacaacggaacacttaaaatgtggctggtgcaactgagggactaaactgttaactttttattttttatttattttttatttttttgagatggagtctcgctctgtcgcccaggctggagcacagtggcgccgtcttggctcactgcaacctctacctcccgggttcaagcaattctcctgcctcagcctcctgagtagctgggattacaggcgcacgctgccatgcctggctattttttgtatttttagtagagacggggtttcatcgtgttagccatgctggtcttgaactcctaagctcaggtaatctgctcatcttggcctcccaaagtgctgggattataggcgtgagcaaacattcccagcctattttttttttattgacagaactaagctgtagtttattaaatttaaattaggctggatgtggtggctcacacctgtaatcccagcactttgggaggccgaagcaggtggatcgcttgaggccaggagtttgagaccagccttgccgacatggtaaaacccatctctactaaaattacaaaaattagccgggcgtgatgacacacgcctgtaatcccagctactccagagacaaaggcacgagaatctcttgaacccgagaggcagaggtttcagtgagccaagattgtgccattgcactctagcctgggcgacagagcgagaccctgtctcaaaaataaataagtaaataaaaaaataataaatgtaaagagccagttgtagctagtggctactgtactggacagtgaactcttttaaatgtaagcttctcaatctactcgccctggcttgcttagaactgaatctcgtagctaatacttaagggcactataattaaagcagttatccttcaatgaattcttcctgtgcccggataatgagctaagaactttacttgaattatcgcatttcactttaccaaaaatccctcataggttttaaggtgttaggaaatctgggtggcagtctaatgtaaaggggttctacagatgggcaccccattttgggtttctgaataatgtgatttaagaaaaattaatgaaagaggagatgaatttcccatggagcaggggtgtggagggaagggaagtggtatttttaagccctattgggcagtatttctttctttctttttttttttttttcgagacggagtcttgctctgtcgcccaggctagagtgcagtggcgcgatctcggctcactgcagactctgcctcccaggttcaagcaattctcctgcctcagcctcccgagtagctgggattacaggtgcccaccaccgcacccagctaatttttgtattttttagtagagacagggtttcaccatcttggccaggctggtctcaaactcctgacctcatgatccatccgcctcggactcccaaagtgctgggattacaggcataagccaccatgcctggccgggcagtatttcttatactttaacgttcatacggatctccaggagatttgttataaaatagtggttctgactcagtgggtttggatggggactgagattttgcatttctaatcagctctcaggtgatgctgatgcagactgtgaggcaagtcaataggggataagagtctatcttttaattgagaacttgccatattccaaaaaaaaaaagaccaagaggaagtactctcttggtggcactagtccagcaggaatccattgcattcacatcaaggtatcacctaatcctgcatttgaggccttgtgcccaggcactggacatatgcagtgaaacagctaagaaggagatagaagacgggtcacttgatcaattctacctccctatggagcacttctttccagaacctttgtgttttgccttcctaggttctgactttggttttagtgaaaatgaagttttgtgtacaattttttttttttttaagacagaatctcactccgttgcccaggctggagtgcagtggcacgatctcagctcactgcaacctccgcctcccaggttcaagcgattctcatgcctcagcctcccgaatagcagggatcacaggcatgctccaccacgtctggctaatttttttgtatttttagtagagacagggtttcaccaagttagccaggctcgtctcaaactcctgatctcatgtgatctgcccgccttgacttcccaaagtactgggattacaggcgtgagccaccatgcctggtctgtacaactttagttatagaaaccttggttttatctcagtgagttctgggagagtttttttttttagacagggtcttactctgtcacccaggctggagtgcagtggcgcagtcacagctcactgcagcctcgacctccctggctcaagtgttcctcccacctcagcctccttagtaggtgggattataggcgtgcagcaccacacccagctaactttttagagatggggtttcaccatgttgtccaggccggtctcaaactcctggcttcaagcgatcttcccacctcagcctcccaaagtgctggaattacaggcatgaaccaccgtgcccagcccttggaaaactttttatgatgaatttggttatgtatagcataaatgaacctctacactcaggattctcctgctgtagtctgaatgggttgtttgctacttacatggacatgggagagggtggcacctctcttttgaaagcccgagttctggcagctctgctagtctgatatgcttaccctcttccctgtgatcctcaaacctggtaccagtaccaaatggtagagagctttccttaattcattgttgcctagattctccaacaggtaataatcattttggggcactcgttaaacctacgaattcctagatcccttccctggagtatttgattgagtggctttggggtgggaccaggatgttatgtttgtaacaagtatctcacatgcttcttaatagagaagtgtgggaaacactactttagttagtggtgggatgactgtcttttattttaatatttggatcttaggaaaaaatacggaattagcacaatacatcattttacagttattacagcttatagtgaggcaatattgaagttcaaatagtgattagcttaaaaaataaattgtacctgtggatgatagatattgtaacagttgtgaagatgctatttgaatgactaaggtttaggaaacactgtgtttcattctagaattacctatagatgcgagacattcccgtaggggaagattaggaaatatgtgttggtggcagttgggctggtcctctattcattccacaactaagcgctgatgaattaagatagttcccatgctgcatatgaggctacagatttgaaaagtcagttccatccttcaaggaactcagtctcttgggagaactgacaattacagtacaataaagccctgtattggaggttttagaacaaggtgaggaaagcataaatgcccggatcttcccagagtggttgagtagactacagaagagatgatgcttcagtttagtacaagaaagaatataacttgtcaggtggctaaaactgggcagggcattccaggcagagggaacagcctatgcaaagtcacaaaggcaggaaacagcaggaagtgtagaggaagctgcaaataattcaatatgactgaagcaggaagatatgaaaagcaaatggtgagaaggttggagagaggccagggccagtagtgaaagccagtgccaagtttagcagttcatatgttattctgagggcagaggctgactttcaggcatgaagtaatttttcccttttggggaaggagtccactgtgctcctgagattctcaaaaggggcactgaccctccaaaaaagaatcaggccaatatgaaccacttaaggattttcagcagaatactgtagatgaattttcatgttcagaagatgattctagcagcattgtggaggatgggctggaggccagtgaggagtctactgcagtagtagtccaggcaagagaaaagaggttttacatgaaaatatgggtctggggaacactggagatttggcagcaaatatttatgtgcctgctgggcatgtgacactgtatgttccctgtcctgaaactcagaagctctgccagctgaaaaggccaggagtggagagaatgtctggctccagtccattccagtccagtacaaaggcaaagctgcttgcattgcagccaagtcttacacacgtagaggttccattctcttcagtggaatactatacagccttaacaaaataaagaggtagatctggatgtgttggcaagatttctaaggtaagttaagtgacagtcaagatgtagtaatttatgtaagcatgttactgtttattttgaatgactttcaggaatctctgcagtgatatatagcagactgtggataatacttctgcagagtagagatagcaaagagacttttcagttgccttatttaagcttgaattttctaccttgaacatgtatcttgtaatagaaatacatactgtttatatgtagtgttaactaatcctaaatcctcccagcacttcccaggagcctgcccacagctgtggctaacatcaggtgtgaatccattgctgatccctccacctcctcttccaggtctaagcccagacagtgggtgctcccacagcacttggttcatctctccactgtggcatttaatatactgtatcacaaatatgtaagtctgtttttctctggactgagaacttgttgaagcaaggatcatgctgactaacatagtgcctggtatgacagagcttaggtcctggcacaccatgcagcttacaaagtacatttatacattttcatacactttgcttgagggcccacagttaaacttcagtctgtgcctgcagtacgatgccagtacccattgtccactggagcaaggtgtggcatgtttgaggaatggcaagaggagggggacaatagtatctgggtgtacttactctgttctcttagtatagcttgctcgacttcaaggccataaacccagagtgtggacttccctttctctttacctctgggaccgaaacctgcaaggaagaaggattgctttttgttctggacctccacagagagccatcagagtctgacaaaaaggacaaaggctttggagccaagtagaccaggaagtctcatcactgtctaattctgtgacttcagtcaagccatgaaaccccttgggaccctactcctttgcataattagataatatataatgcatggagttgtgaagggcaaataaatgagatagtatgcttgaccataaatgttagttgctttcttcctggttcttttgtaatttactgcccaactttgctctggggacctaaaggtctgacctatggtgagaatctgacctgttctacccttttgggaaaagaggattaggagtgtagagaatagctgggagtggccgggcacggtggctcatccctgtaatcccagcactttgggaggctgaggcagggagatcacaaggtcgggagttcaagaccagcctggtcaatatggtgagaccccatctctactaaaaatacaaaaattggctgggtgtggtggcaggcgcctgtattcccagctactcaggaggttgaagcaggagaattgcttgaacccgggaggcggaggtggcagtgagccgagatcgcgccactgtactccagcctgggcaacagaatgggactctgtctcaaaaaaaaaaaagagaatagctgggagcattgtctcatatgggatgtccccttccagttcctctgaggtgcttacctccccatcccacactgacctccatgtctctgccattgtaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgtatgttttttttttcttttggttttgtttgtttgtgggttgtttttaaatagttgtaatagccctgtctcctcacacctcagctttagctaggaggactggcactcctcagaggccagcatggaccagagccaagcttttgctgtgtatagttaatgcctcttgacttgcaggcagttgtagcaaacctaactctcttaggttaaagctgatggacaaagaaggcacagccccaggactttacagctctacttattccaaggatgttcccagaaggatcaatttggttagttctggattgagcccgtgaggaaagggtcactaacttgacctatctacttacctcagagcatccttgaaagagtcaaataagagagtggatatgaaggtaatttgtagtaaacagcaacaataccttagaaaatgttagttttgggaccgggtgccgtggctcacacctgtaatcccagcacttggggaggccaaggtggacagatcacttgaggccaggagttcaagaccagcctggccaagatggtgaaaccccatccctactaaaaataaattagctgggcttggggcacgtacctgtaatcccagccacccatctggtggctgaggcacaagaatcgcttgaacctgggaggtggaggttgcagtgagccgagatcgcgccactgcactccagcctgggtgacagagtgagactgtctcaaaaaaagaaaatgttagttttgaaaggaaacagttcaacatataaagatctcacttagctgggtgctgtagctcctgcctataatcacagctactcagaagcctgaggtgggagaatcacttcagcgtgcagaagttcaagacctgcctgggcaacataccaagaccttgtctgtacacaacaaacaaacaacagcaacaaaaaaattagctgagtatggtggcacatacctgtagtcctaactgctcaggaggctgaggcaggaggatgcttgagcctaggagtttggtgttgcagtgagttatgatcgtgccactacactccagcctgagtgacagagtgagaccccatctattttgaagaggcaaagaagaaagttccctgatgtttctttcatgaggcactttctgtttgctctcattcttatttgctttcttctgtcttgtggatggggatgcctcttaactactggcagcaagatactgcaagagcaaaggtagcaaacagctgaattctatgacaatagaacttggttaaaagtgttgtttcagtgtatcagatgacaagagatggtgataagggccctacagtacagacatttgcaactctagccaaggaaacatacttcagaggacattgtagagaaaggactgtcatctagtggaggagagatttttaagtaactatatagggtgggattgtaaagagatggggaggatgaacagctgtgatccggagttgacattcttgagatgggctggtcagctgcactctgttacatctggcacctacattctatgccagtctctgtcctaggccctggagctaggtaagatgtggctcatgcttgtgataggagacagggacagtttcaatgcatggtggtattagaatgtgagcccgtgtgagggcagggcaggatatttgggttttttgtttttcgttttgagacggaatctcactctgtcgcccaggctgcagtgcaatggcgcgatcttggctcactacaacctccacctcccaggttcaagcgattctcctgcttcagcctctcgagtagctgggactacaggcacatgccaccgtgcccgtctaattttttgtatttttagtagagacggggtttcactgtgttagccaggatggtctcgatatcctgacctcatgatctgcccacctcggcctcccaaagtgttgggattacaggcgtgagccaccacgcctcgccgatctttttgctttgttttgtttttagctgctgtgtccccaacacctggaagaactgagc

SEQ ID NO: 13378 - DNA, 12561 bp, Human; identical to SEQ ID NO: 12641

SEQ ID NO: 13379 - DNA, 173992 bp, Human
atatatatatatatatatatatatatatatatatttttttttttttagacagagtctcgctctgttgcccaggctgaagtgcaatggtgtgatctcggcttactgcaacctccgcctgccagattcaagcaattctcctgcctcagcttcctgagtagctgggattacaggcgcccaccaccatgcctggctaattttttgtatttttagtagattcagggttttgccatgttggccaggctggtcttgaactcctgacctcaggtgatccatctgcctcagcctcccacagtgctgggcttacaggtgtgaaccactgcgcctgacctgtttttatatttttaagtgattcaaaaataattaaaagaagaatatattacgatacatgaaaactatgtgaaattcaaatttcaatgtccataaaaaatattctattggaacacagctacttcttttatttattgtctatgactgcttttgcgctacaatggcagagctgagtagttgtgaaaaaggtcatacagcttgcaaatcctaaaatatttactatctggcccttaatagaaaaaagtgtgctgactcctgatccaatccatgcttagtttaaaagatcacatctatctgaattacgtccaactgtacatctttaagtttctgctttttcccattctcgtgtctgctactagaaatcaggttccctttagttctatccttgcagcaggattcctgccctgctatctctctcctcttttcagttcatcactgtgtactaaaaaaaatctgcactcttcagcacagcatccctagttccccattatcttaccacacctcaccttgtcagctgtatctcttacatcatactttcatctaaccttatcaatcacttaacccacccttgccttctctgctgtaggccaatgctcacagttactctctctgtgtggaatgtctattgctggtatttctctcttatccatcctttacgttggttatctcaaatgcctccttgccctaaaagctttccccagttcctcgtctgggaataattattgccatccgtgcgagattctctaacgctttgtacgactgctttatttcaaattctgctttatagttcttttgtgtatacacacagattgtttctcacgttctattgaaagctgcttaggggaggaattgtattctattttgttaatctctgcatcctttcggcgcctagtaagagtcttgtacgaaacagaaatgtctctccttcgtaaaattcctcatcgggagctgggactgtgaatttttgtaacgtttaagaactatctgttatttaagaacaaacactctgcttaacttgtttagggttcactagagcgagtaagacctttttagggcacgccgtctcgctggttgtcacacacgcatggatcgctgccgggacccttaggtttgtctgcaaacacgtgggtgataagcgctaccctccaggcccctcctctgtccacggtgattggcggaccaaacgttccaatcatccctccccgcctctttcggcagtagccaatcagagaccccgagcgcctcctgactactagacactgtttactaacagatcgaagctggggaataaggggtgtgaccgttctggggaggtcagggaagggaaggtcttgactgcgagtgcgcaccagaggaaatgggcggggcagagctttgggtctcaccaatcggagtggcggcgctcctccctctcctgcctccccgccaagcaacaacaattcgaggagcgaggcggggaggctcgtgaaacgtcacagcgtactgcccaatgggaaccggcgttggcagacgcgcgcgccctgtgtccaatcagcgaaggcggctcgaatggctcccttaccttgctggctgtgggcggagcggcctgaggaggcggcggtggagcagggggcggtttggttgcgcggtactagcggtgcccgccgaagggggaggaggcgaggagcgagccgtgcggccagagcgggaaagagactcgtctttgcgtccgagttctggagccgccgcaccccgactcctggggccgcggcagcgcatgcgaggggacgggcgtccgctgtctcctgggttcccctcgtagcgacccgcgggatcggaaaaaaaggagaagatggaggaggagggtggcagcagcggcggcgccgcgggtgaccagcgcggacggcggcgacggaggagagcagctcctcactgtcaagcacgagctgcggactggtgagcgaccccgccctctgccggccgggcccggcgcgggggcgcgcctgagggcacgcgggtgcccgcgcggggctgggggcgcggggccgcagccgtgggcgcggaggggcgggcctggggcggggcgtcgcggtcggggcgcgtgccccgggggtcccgggaggtgggggcgcgccttgggggaggcggccgaaagttttccccagcccgggaatgagcggcgggcaccaggcatcggggccagcgcagccgccgaccgctgcccgtggcacgcacctccgaggatgtcgctgctcccccttcccgcacaggtgacacacgtgtgtctgcgtcctgtcagggcgaaaggtgcgcctgcctccgcgtggggcgagcggcgctttgttttggagagtgtctccctcctccgcccctctggtccccgcgatggggggtcccggtggggctctgtggagccatcccctaaggtgctggggtcctgtaggagataaacgggaggtttcgcctcgggcttttaccgagtccagtctagagacaggaacaggaatcgccggctccagggattgagtgcctttattctcacttatcatgaaatactatacttggccttgaatttccttcagaggtccctggagatgatggctttagaaatttaaagctccaggtaaaaggaactaacgagcaggcttcagcgcttacgttctaatgtttgagatcactagcgttgtcctaagctttataactaattaaatgtattcgtggtgtaggttcaggttgttcattttggaaaatgcttattcagaccaatcagtacaatttggatttatattcttggagcccagtctcgtattgtagatatattaatacttttttctctgaacagatagtacattttaatgagtcgttcgttattactagatatgtttgtgagcgttgaaggtttttgacagagctgctttggcatattgggatttttttttttttttttcagacagagtttcgctcttgttgctcaggctggagtgcagtggcatgatctcggctcaccgcagcctccgcctcccgggttcaagcgattctcctgcctcagcctccggagtagctaggattacaggcatgcgccaccatgcccggctaattttgtattttttgtgggggcggggtggggggggcggtcctctccacgttggtcaggctggtcgcgaactcccgacctcaagtgatccgcccgcctcggcctcccaaagtgctgggattacaggcgtgagccaccgtgcccggccgggttattatttaattgtgaaggcacaaaagcttaaacggcaggattcaggtgtccactagtacatcttgtttctgttttgaacagattggaaagttagctctgtccgtcagttctttcagtttttgttatttctactgagattgcctataagcattccattgggtgccagtgtggtgacttaattcaagagagatgtcaaattcatgcttcttaattcaacatttgtaaacattgtttttttggtcattgtgaatctgttatacatcttgagccagctgttccatatttttgagttcctaacataacctgtatgaattcaggtgatttggtttttcttctctcaatttcatagacaactgatattttcaaaagaccctgacatggtttactcagtatacatttattcggatttgtgccacactcagtgtcaggtgctttctggtgtgaagattttgaatttttttcttgtcttacataacgatccactgatttatatgtatggaatcctactgtacagcaaaagctacttgaagtcatatgcttctcagccatcgactgtggtgcaacaagcagctttttgctaaatgaccaaggagcaacctgcttgttattagtagttaaccaactgcttggtttctggattttgcaaacaatgctagttttgtagaaaacaatgagtactgctttatttccccctctcttctaactgtgtgaatcatcagcttcaagttcgcattttagaaatttttctgatggatggtgagattatactgaattcattagtactgttaactgtcaaaggaaacgaacaatcattttgatttattactgaacactggaacaactgaccggatatagtggtcaaaaacactgttaaaatataacttgaaagagttgctcatcttcagccaactgcacttctttcagcacatgatctataataggcaccagagtaatttgatctgatatggtcccgtctcagaatgtagataagcatctagttatatcaggctggcagttggtggtggctcatttgtgcagaacactttattgtattccataggatgaatgaaaaagcaaaaaacgtcccatgaaaggacatggagttggaagacatgattctaaatcccgtctctgcagcttaatatgtagacatcggcaagtcacttcaccctttcagattcacatctttaatctataaaatgtgagaattgaatgagacactgttggaaaagtgctaagcgggttgcttggcatatagtgggcccttaggaaatgttggttgaatgtatatataaaaatcattccataatagtatcttatcttgaagtgtgtgaattaatccagtgtaatttgggaaacaaatcactcatttagtgtttagcctatgtcacattgcctggctgttatctttttctgtatatgtccagtcttctcatgtagagtgtaaattcgccataatctttgcggctgctcagcagcctgtgtggatctcttcagtaacagttaacacacggtactataatagtccatttacttgtattacagtctaatacagattagactgtaaggtccttgagggcaggcaggcaggcagacaccatgtcctttgtttatttgcagcccctggcatatagtaggtacttaatatttgttgaatggattcactgaatgcatgagaatccaggagcaagtctagtaagtttattgtattaccagtgccttgcagatgttaggtggttgataagtggatgacagtgactgtaaaagctgaagaatgcagagtataggattgaacagatcacttaaacatacatttcttgaatgtatgtctaagaaaatgtcccgccctctagtagtaggggaggaggccatataaaccagtaattaagataatactgccttgggaggctgaggcgggtggatcacgaggtcaagagatggagaccatcctggacaacctggtgaaaccccatctctactaaaaatacaaaaaattagctgggcatggtggcacgtacctgtagtcccagctactcgggaggctgaggcaggaggttctcttgaacccaggaggcggaggttgcagtgagccgagatcatgccattgcacgccagcctgacaacagagcaagactcccatctccaaaaaaaaaaaaaaaaaaaaaaaaaaaagataatactgccttaagtataacagtaaagggatattcaagtataaagttagcaaagaatgggttaggacttttagctttcaaataatcaaatcttcaacaacaataacaaaaaggatattattggaaggagattgggttatcttacccacttatttagtaagtattttatttcctcttacatactgggtgcgattttagatgcttggatgataggacatgtatggtctgtccactggaagaactgggttgcatcaggaaccattggaagcagaaacttagcattgtctgtattttgtccaccttgaatctctgcttgtcactatgtgatggctttattcttccccactactgtgccacttttcccacatgggaaagatcatgctgttgatagactgcaagttttacatcctacagcttccactactgaaaagacaccgccgccttctcagcttcagttataaagatctcagggaaggacttttttggcctgcctttggtgaggtatccacttttggatcattcacctaaagccaggggatgggatcatgtttttgtaacatggcagcaatttctgtaaacatggatagggataaaactaaactctaagaagaggaggagttgctgggaagacatttacttagatgcctgttattaggagagagagcctaacattgaggagaaggtcgaggaagtttatgtattgtggtgtaacaaattattccaaaccttagtggcttaaacaacatgatttgtgtgggtcaggaatttaggagtggcttagcttattggttcttttttttaatcctaagtgaattaacacaggaagcttcttgattctaactcagagaccctcatgaagttgaagtcaaggtgttggccaggactgcagtcacctgaagacttgtctgggtctagtgattccccttccgagatggcttactcacatgttggcaggttccttgccatgtgggcctctccatagcgtggcttgagcattctcatgacaggcagctggtttccccaaaaacaagtgatctgagagacagcgaggtggaacctaccatgccatgtcttttgttgttgttttgtttttttggagacggaatctatccaggctggagtgcagtggtgcgatcatggctcactataatttcaaactcctaggctcaagagatcctcctgcctcagcctcctgagtaactctgggactacgggcatgcaccaccacacctggctaatttattatttttttgtagagacaggatctcattatgctcacactggtctccaactcctgggctcaagagatcatcccacctgggcctcccaaagtactgagattacgggtgtgagccaacctgcccggcaaaattaatccatttgtagcatgcatcagtacttcattttgttgttgttgttgataaattgtgttccattgtatagatataccaagttttgtttatgcattcaccacttgtttgaaatttgggttgtttccaccttttggctattgtaaataatgctgctttgcacatttgtggacaagtttttgtgtggacctatgtttatttctcttgggtatgtaacagcagtaaaactgctggatcacttgttaaaacaaagctaaacaaagtctgggtttacctttgtaagaaactgccaaactgttgtccagagtggctgtatcattttatattcccatcagcaatttatgaggcctccagttccttcacagcctaaccaacattgtctgtctttttgcttatcatagggagtgtgaagtgattttccatttccctaatgcctaatgacaagcatcttttcatgtgcttattggccatttgtatacctttggagaaatttgattcagatcctttgcccagtttaaaattggctagtttgtctttttttattattgagatatgagagttctttatgtattttaggtgcatgtctcttatcaggaatatggatttgcatatattttcctccataaatgagctgtcttttcacttttttgatggtttccttaggagcacaaaagtctttaattaaaaaaaaatttttttttttaaataatagagatgggttcctgctatgttgcccaggctggtctcgaactcctgggcttaagtgattctccctcctcggcctcccaaagtgttgggattgtaggtgtgagccactgtgcctggcctaaaagtctttaattttttttttttttttttctgagacagagtcttgctgtgttgcccaggtggaatgcagtggcatgatcttgcctcactgcaacctctgcctcctgggttccagcaattctcatgcttcagccccctgagtagctaggattacaggcgagtgccaccatgcctggctaatttttgtattttcaatagagacgaggtttcaccatgttggccaggctgatcttgaactcctgtcctcaagggatccacctgcctcagcctcccaaagtgttgggattacaggtgtgagccaccgctcctggccctaaaagtctttaatgttgatgaaaccttttttttttctttttcattttattcttgtgtctaagaaatcattgactaattcaagattatgaagattgatgtctctgttttcttctaagagtttatggctttagctgttacatttagatcattgatccattttaaggtaattgctggatatcatgtgaggtagtgattcagactcattcttctgcatgtaaatatccaattgttccagcaccattagctgaaaagactattcttttctccattttaatgtcttggcacccttattgaaaatcagttgactatagatgtatgggtttatttattttatactctcagttctcttccagtgatctatatgtctctccttatagcagtaccatgctgtcttgactactacagttttttagtaagttttgaaattgagaagtgtgagtcttattcttcaacattgttttggttattctggattccttgtatttccatatggattctaggatcagcttgttagtgtctgcaaagaagccaactcagtggcattctgatagggatctcattgaatttttagttaaactttggcagtgttgccatcttagcaatgttaagtcgtctgatctatgaacatgagatgtctttccatttatttaggttgtcttcaattactttcaacaacgtttttccgtttaaggagtataaatttgcacttttgttaaatttatttctaagtattttattatttatttattttttgatgctatagtaaaaggaactagtttcttacttttatttttggattgttcattccaagagtatagaggtacagtttttaccttgtgtcctgcaaccttggtgaactagtttattggttctaatagtttagtggacaccttaggattttctatttataagattgtgttagccatggatagagataattttacttctttctttccaatccagatatcttttgtttcaatttcctgcttaattgccttggccagaaccttcactatggttcaatagaacttgcaagagcagacatccttgtcttattcctgatcctagggtgaaagctttagtcttctaccactgagtatggggttagctatgggtttttcatagatgtattttatcaaattgaagaatttcacttctcctcctagtttgggtgtttttttaaatcatgaaagagtgctggattttgtcagatgcttttttctgcatctattaagatgaccattttttttgttctgttcatatggtgtattacattaattaacttttgaatgttaagccaaccttgtattcctgggataaatcttgtttgtcatggtatataatcctttttctttgttgctggattcagtttgcttgtattttattaaggatttgtatctatatccataagaaatctttgtagtgttcttttttggtgatacctctgtctagtctccccaaaatattcttgattgagttctgtcaccaactaaagagcttctttttttttttttttggagatggagtctcgctctgttcccaggctggagtacagtgacgcgaactccgctcactgccagctctgcctcctgggttcacgccatttctcctgcctcagcctcccaagtagctgggactacaggcacctgccaccacgcccagctaacttttttttttttttgtacttttagtagagacggggtttcatcgtgttagccaggacggtctcgatctcctgacctcatgatccatccgccttggcctcccaaagtactgggattacaggcttgagccaccgcgcttgcctaaagatcttatctatttgattagtggtatccatatttacaatctcttaagtaaatctgttttttttttttttttttaagagacgagtctactctgttgcccaggctggagtgtggtgctgatctcggctcactataacctccgcctcctgggttcaagtgattctcctgcctcagcctcccaagtggctgggattacaggcacccactaccatacccaggtaatttttttttttttttttttttttttttagtagagatggggttttgccatgttggccaggctggtcttgaactccttacctcagatgatccatctgcctgggcctcccaaagtgctgggattacaggcatgagccactgcatctggccttaagtaaagatttaacagaggtagggagtggactgtagttctaagtcagcccctaatttgctatatgacctgggataagtcattttgcctttctgagcccaagttttttgattcataaagtaaaggtgatggactgagttataatcaaagtatttacgagcattaaagctcttctgtggcatttccatggaaattctggtatagacaaagttagttccttgtcttttcccgatcctagggggaaggctttagtcttctaccactgagtatgaagttagctgtgagtttttcatagatgttctttctcaggttgacaaagttctcttctattcctagttggtttgggtgagctttttcttttttttttaaatctttcggccagacatggtggctcatgcctgtaatcccagcactttgggaggccgaggcaggtggatcacctgaggtcaggagttcgagaccagcctggccaacatggtgaaaccccatctctagtaaaaatacaaaaacttagctgggcacggtggcgggcactgtaatcccagctacttggaagctgaggcaggagaattgcttgaacctgggaggcggaggttgcagtgagctgcgatcgcaccattgcattccagcctgggcaacaacagcaaaactctgtctcaaaaaaataaaaaaataaaaggatgtttcatgataaaaagtccagagtggtgatttactttattgttgttgtattttaaaatttcattttattgagacagaatctcactatgttgcccaggctggtcttgaactcctgggctcaagcagtcttcccatctctgcctcccaaagtgtggagattacaggtatgagccaccattcccggctagtgatttactttatttatttatttatttatttatttatttttatttagacagggtcccactctgtcgctcaggctggagtgcaatggcgtgatctcagctcactgcaaccactgcctcctgggttcaagtgatcctcccacctcagcctcccaagtagctgggactacaagtgtgtgccaccacacaccgccacgcttagcttatttttgtattttttggtagaggtggggtttcgccatgttggccaggctggtctgaaactcctgacctcacgtgctccacctgcctcgacctcccaaatggctggaattacagacatgagccaccacacctgaccctatgatttactttaaaagatcatcctgttttaccaaaggattcatgttggatctgttgaaaaacaacagttccctgctgctttttgaatgtggttccattaataatgatttgatttgtaattagcttttaagaaacataactattagttccaataagatacttgctttttttttatttttatttttttaaacaaacatagcttacaaaagcaagccggctgggcgcggtggctcacgcctgtaatcccagcactttgggaggctgaggcgggtgtatcacctggggtcgggagtttgagaccagcctggccaacatggtgaaaccctgtctctactaaaaatacaaaaattagccagccatggtggcagatgcctataatcccagctacttgggaggcttaggcaagagaattgcttgaacctgggaggcggaagttgcagtgagccgagattgtgccactgcactccagcctgagggacagagtcagactgtgccaaaaacaaacaaacaaacaaaaaacaagccaataagatgctttgtttttgtttttgtttttgttatttttgaagataaggtcttcctctgttgcccaggctggaatacagtggtgataatagttcaccgcagcttcaaactcttgggctcaagtgaaccttctgcctcagcctcccaagtagctaggactgtaggcacataccaccatgcctggctaattttctttttattttttgtagagatagggtcttgctatgttgcccaggctggccttgaacttctggcctcaagcaatcctcctgcctcagcctcccaaagtgctgagattataggcagcccagtaagaaactttgaaagatttcagtgacagttgtagttatgtatgagtacagtgcagctctcctttttatactatacatatgtaaatgtatatattcatgagctgcataatgacattttggtcaatggcagactgcatgtagattgtggtcaatgaaattgcgttactgtatttttactctactctttctctggttagatacacaaatacttaaaattgttttacagttgcctatggtattcagtacagtagcatgctgtacaggcttatagccttggaacaataggctatataccatataccaggtgtgtagtaacctataccatctaggtttgtgtaagtaaactctatggtgtttgtgcaaccatgaaatcacctaatgatgtttctcagaacatgttctcattgttaagcaacgcatactgaatatgtgtgtgttgtgtgtttgtactttttttgtagtacttgtctcttttttcttttttctttttttttgagacagagtcttgctctgtcgcccaggctggaatacagtggcgagctctcagctcacggcaagctccgcttccttggttcacgccattctcctgcctcagcctcccgagtagctgggactacaggcgcccgccaccatgcctagctaattttttgtattttttagtagagatggggtttcaccgtgttagccaggatggtctcgatctcctgaccttgtgatccacccacctcagcctcccaaagtggtgggattacaggcgtgagccaccgcgcccggccgacttgtctctttttttcacattttcctcactttgagaagagtaggaagaacttgtgctctatcttttgtttataggatacattgggatggttaaaatacgaatagattattaacagtactctaatttggttccctagtgcctagaccttaaaagaaaatcccttcttaactttctaccatgaattttagagattaagaaaatgatctaatgggtcaaagaaggtgacatcttatcccttctgtcaagggggattcaggtatagtttgtatttgtagtctgtagcggggaaaagcctcagatgttaagtctaatactgtatcagacccaacattaacctctgctccaaagcaaggaaatattctgaagcctcagcttcctggagacacaagtggtttgatgaacaggattgaattcttccctgtgaaaaagaagctgattcttggtgaaaactgctctagggaaaatctaacataataacatcatgtgttagttgaagcttcacaattaaatacactgttgagagatgtcaatcctaaagtgctgtgggagggaggggttgtcacagttatctcctttgagctcccatcatgatttacagatctctctgtgcacctcaaaggtatgatcactcctacattcatcttgtttttcagggaagatgaatagggtctaaaatagaaccttggcctcattatgtttgtttctagcagtgtccctctcggttcaagtgtagctagctattcctccaaaaatcacagaagttctattttatatactcctaaagttgtgagtgagctggctgtctcacttttttctttctttcttttttaaaaaagtattcagtaggcatcctcccctgtgactgcagggagaatgaggaagtaaagttcctgatttttagtatagtgcttggggtattgcagttattttatttcacactcaagtttttgtgtaggtgtgcttctttttatatagtcagtgtgtttttggcaaaaactgcgtaaataatatttttgtatatcctattttctggaatatagaaagtgaatttggtacttaaaataattatatcattaattcttgtattttaaaaatgttttaagttttccacttgtggctcttactgttatgtagattttcctagtactattcttacaatttaggtagcttcaagcaaatacatgatgaaggcttgtgtggtaggctgaataatgaccactcccccaagatacccacatcctaatccctggaacccgcaaacatgttgtcttacatggcaaaagagaccttgcagatgtgattaagtatcctgagatggggagattattttgggtaatccatgtgggctcaatgaaatcacaagagttcttgtaagagggagacaggagggccagagtcagagaaggtgatgtgaagatgaagcagagaaaaagaggaggagatatgaggaaacagatcagtgatgccattgctggaagggaggccatgagctaaggaatgcagacagcctctagaagcaggggaacagattttcacctagaatatccaaaaggaacacatctctgctgtcaccttgattttagctccatgagatccagtttcagacttttgatctccagaactataagaaaacgaatttgtggtgttagtaagccgtgaggtttatgttaattttctaccgcagttacaggaaactaatacaacttactaagattggattaaccaggagataattttgccccaagatatgggtgactaagggtgataacagaatgtgaagcagtcagttatttaaacaactgttttgccagaaaatggtaacacgtgtcattctttgtagaagtagaatggtgtcttctctaatgaatctgcagggagacattcctttctgatcttagcaccaaggctagctgtgctgcttttgaccagctgttctgtttttcataggagtgctctgaagtgggtggctgagcagacctcttaccaagttggtggttagaaagtgtcaaatctcaggcctacaccacttagaagtatggtttggcatgcatattgagtcttatcctggcagtgttttgtgcccttgttctttcttcttattttcttatggtttaattaatgctggtaatttgccttacatcttttctggaccaaggcaaggattaggtaaacatataattaaataagtacatttatatataaacataagtagtagggaaaatatgggaagatatttgactttatgtccagtgttttgcttcttcttcttttttttttttttttggagacagggtcttgttctgttgcccaggctgtagtgcagtgacgtgatcacagctcactacagcctcaatgacctcctgagctcaagtgatccacctgcctcggcctcccagagaagtgctgcgattacaggcgtaagccaccatgccgggcctgttttgcttcttaaataaaatctttgtcatatggtgttcatgctatttttatatttctttgaaaaagagaagtagtaaggtctctgattaattagaagcacttttaattttagaaaatacgtaatgataaacaataaaatgggggcatacttaaaagaatgctagaggtaaaagggtggagaatcatacacaggtctgtctttgtaccatgcggttttctatataagtagaattctccatcattacctggaaaattcagtcaactgaagcactctgtcctctaatgacatcataataatctgaagtgagattatgtatttttttaaaggaaatatttaagatgtgtaataaggatagtgtcacactttctatctaaatatgatgctgcatgaagacagcatgaacagagtcttagcggtagatttgcactagcccactcccatgattttacctatgttttttacctttatactaatgttacttgtgtgtattgaagcatcataattagggctaaaatagaacaaacataatggggccatatgcaaatcaaactcataactttgacctaattttgtcttgtataagttgggcaaaacagccagttttattcacccataagggtttattgaattcctaccgtgtgtctggcactgcactagatgctgggttttagtagggagcatattagacctggctgccacgcttattgtataatacctaagagagagaccttaaatacataatcactaaataactaaccctatgattgcgattatgatgaactcagttaagaaatacacagttctgtgagagaacccaaaagggatgatggcaagcttctgggaagcagtcgtgttgaagctgaggccctggttgttgtggggtgaagagcggggggacaaagcctttctatcaaaggaagcaacacagatggtcttccaacacaatgggaaatggcttggcacactggagttactggaaggaaggtgtctggcttgagtgtgacattcaagcaggagagtcacaggaaatggggctgagaagggagccagggccatttcatgcaggggtttctagagtttagacattgagtgtcatgtgaagccattgaaagatttccagttgaagaatgatgagattagttttgctttgtaacaagatgactcctatttctgtgaggagagtgggtatagagattatatgaagggaaaccaggtaggaaactattgtggaaattcaaatggaatataaaggtttagaataggtaacaattgagattaacaattgtgaatgtgtttgagattcacttaggaaataagaatcagcaaaggccaggcgcggtggctcatgcctgcaatcccagcactttgggaggccaaggcaggcagatcacctgaggtcagagattcgagaccagcctggccaacacggcgaaaccccatctctactaaaaatacaaaaattagccaggcatgatggcaggtgcctgtaatcccagttactcaggaggctgagtgggagaattgcttgaacctgggacacagaggttgcagtgagccaagatcacgccgttgattgcactccagcctgggtgactgagcaagactccatctcaaaaaaaaaaaaaaaaaagaatcagcagaacttggtattgtattgacatggggttttgtggctggaacaaatgtgtgtttgaagatgctgtttattgaaatgatgtaattattttctattgctgcataacaaattaccacaaatgtagtggcttgtaatagcatccatttattagctctcagtttagtagattataaatccttatgagacctaaattattgtgttagccagactgagttcttgtctggaggctgtgggtaaaaatctacttccaaactcatttttgttggtagaattcagttcctgtatttgttccccaaggttccagtttccttgctggctgttagctgggggttatcttcattcttctcatttgtctcttccacctttttttttcttttttttttttttgacacgtctcgctctgttgcccaggctggagtgcaatggtgcggtctcggctcactgcaacctctgcctcctgagttcaagcgattctcctgcctcagcttcccgagtagctgggattacaggtgcctgccaccacacctggctaatttttatagttttagtacagacggggtttcaccatgttggccaggctggttcgaactgctgacctcgtgattcacccgcctcggcctccaaaagtgctggaattacaggcgtgagccaccgcacccagcctgggtcttcaatctttaatccagtaaaagtgtgtcaaatcctttccatactttaactttctgacttctaaacccccttctgtctgacctctaggtacagatttaaagggactcatgtaattaggttaggcctacttgggtaattttctttctttctttctttctttctttctttctttctttctttctttctttctttctttctttgtctatctttctctctctctttctctctctctctttctctctctttctctctctctctccctctctctctccccctctctcccccatctctttctctctttcgttttactcttgttgcccaggccagagtgcaatggcgcgatctcgactcactgcagcctccacctcctgggttcaagcgattctcctgcctgagcctcccaagtagctgggattacaagtgcccaccaccatgcccagctaatttttgtatttttagtagagatagggtttcaccatattggccaggctgatcttgaactcctgacctcaggtgatccaccctccttggccgccaaaagtgctggtattacaggcgtgagccactgcgtcctgcctacttggataattttcttatcgtaaggtcagttgatttaggaccataattacatctgcaaaatccctttatcacaagtgtgtgatttcgtgatattcactcactcaaggggaggagattatacaaaggctagggtcattggggtcatctaagaattcctccttagaagtcacagaagatagtgaaccaggggaaatgcgtatcggggtgggcagaaaagataggatccagttttgtacctatcaaagtaagtttgagatgcctttgacatattctgatggacttctatggtataagtaatcatagataatgtgctagatagtaggtgctttcatcaactcatttaacctaaacagcaacccagtgaagtgagaattattattattcttcttccaatctacgtataggaaaactgagtcttagtgtgctcaccggcttgttcagggttactcaagaagtaagtagaagaatcggttgtgaaactgaagcagtttggccacaaggcccatctaaagcactgtgcttagtgggatcagtaggatatgggtcaggagcttgtaaaagaggtctgggttgcagattaaaatcctagcatcattgaccattagatgacatttaaagccaaggtagtaggttagatcatcttaggagagattttagagtggagaggaagaagactcagaattgagtcctgaaaaactcccaaaattaaaggaatcgatagaaaaagagttgctaagaaatgatacagaggaggaacagccagaagaaaaaccaggagaaaacctaggaaagttgtggtgtttggaagctaaggagaaaagatgctttagggggtggcaggggatcaatttgactgactacctaatggcctcatcaagaacaattttggtggagatttggtgggagaagccggattggaatggattgaggagtgaatgcaggtgaagataacttttgagagacttggttctggaggatattaaagagagggacttagccagagagctatatggggttcaggaagggtttatttgttgtgtccttgttttaagatgagtgatggtagagcgtgcttaagtattactaggctggacctagcctagtactacagtttcatagctattaaaactgtacaagatgggatagacgatggtgtcatggtccctgagaagggggatgggatgttgtgcacctggggggttaggaggtccgataaaagacttgcttttattatttaatgggaaggaagaggtagaggatacaggtccatttgcagatttggtggcaggaagatatgggagttttgagtttcgagcatgattctttttcttctcaaattatgaagaaaaggcaattctttatccaaaaagagaaaaatagcatcattgttttttaaaaattgtgattctggtcttcaaaaaaattcttttttttgagatggagtctcactctgtgcccaggctggagtgcggtggtgcgatctcagctcactgcaacctctgcctcccaggtttaagaaattctctgcctcagcctccggaatagctgggattacaggcgcgtgccaccaagcccagctaatttttttttgtatttttagtagaaaagaggtttcagcatctggccaggctggtcttgaactcctgacctcgtgatccacccacctcggcctcccaaagtgctgggataacaggtgtgagccactgtgcccagccaaaaaaattcttagatatggaaaaacacagaaagttgacacaaaatgtatatgctataagatgaaagtttatagaatgttatagaacaacttactgaaagaggttttcaggcataaccattgaaatgcttctgtactttccacagaggtcatttccctgaacgtgttctctggatcatgccagaattcttagtaagcttaatgttctctttctcctttttgaagtgttttatatttagtttagttcttctaagttaaatttatttggtacatgtattgggaaaaaaaagcctgtttgttactgctttataagcatttgttttcttattgactcagctttcatactggctcaatcatgtaattccaaaatcggttggatatgtaaacactgccgttttatacaccagaagtacagtaagtcttcaaggtaagtgacctgacaataagagcaaagtgggcagcattgttttaaagtacacagatattaaatataacttggttctgcctccagcagaatgctgtccagagacacggtttgaggcccaaccacaaatctaaacagcttcagaatagcttagcacctggcagttaaaaggacttgaatgtgctagctatttagcttatttttaagttcttatgtatgccctagacttgggctaattggaccctgtagacaggagttaaagattttagatttcagagttatgtatgtgttgtcaatactatactgggcaaccactaaattagagcttatctggtaaattgctttataaataatttatttccgcctgacaaaaagaaaaaaataatctcaaatagcagaaaaagatttttttctctctgcatacaattgtcaccttttgactgaagctaaattagtctaagaagcttatgttttgtgatgttgagtaaaaaagacaagggaaatgaaaaaaagttgttgtcccagtaaatgagagactaaatacatatttcctagttggcatattgaaagcgaatccaagcctattaaataaggatgattgagtcagattgtgctttgcacctgtttttgaaatcttctgcttcctcagagactttactccatgttgttctccccttttcctgatcctcaggttctccttcccacaaacacatttgagtctttttgtaaaaagaaaaaagaaaaaaaaaattctctgtcgccctctagttatttctattatccctccttccactagtttttgcaagagcagttgataccagctgtttctacttctttatgccccattcactggatctgctggaagatcaggcttccatctcaagcactccactgaaactgctttcactaaagttactaatgtctccctgttcctaatctggtggaaatgtctcagtttgaatctaacctaatttctgtagagcactcagtgcttggatattggtactttcctccccttgcccagtgacaaactgtgctcttctacctggttcttctcaatcggtgactgcctcatctccttacattagctgctatctctgcttgtgccttaaatattggtactccattgtcagccctgttttcttgtaactgtatgcattcttcctgggaaagcaaatgttatcattgcttgaactagtatccaggccctattttcagcctacatctctttcaggttttcaagaccctttcttgagtttcttatcacttctagcagcccactaaacacaaaacatttggatagtccacaggcaccttagactctgaggttaataatactttttcttccagctttccatgttttattttttaatttaattcaatttaatttaatttaagaggcggactttcgctcttgttgcccaggctggagtgcagtggcatgatctcggctcactggaacctccacctctcgggttcaagcgattctccggcctcagcctcccaagtagctgggattacaggcatgcgccaccacacccactaatttttgtatttttagtaaagatggggtttctccatattggttctaggctggtctcaaactctcgacctcaagtgatctgcccgcctcagcctcccaaagtgttgggattacaggcgtgagccacctcacctggccccatgttttatttagtggcatgccattcactattctgccaggactctagttagaaacatccagacttcttcctctctctcacattctccccacccaccaacttactctcctagttgtgtcagttataactctgaaatattaatacctcctttatttgtttcttgctcatcattgccattaccatagtctaagttcagtgtctaatctaatgataatagctatcatttatttagctttatgtgtcaggcctcttccaagattttgcctatcttacttaattttcacagcacacctatgtgatgggtactgtatttgacacctgtggtgcgcaacctcatccttctatctgccttactctggagtcaagctgtggctgtgggctgtgacaaacagttctgtttgggcttcagctcacttcaaggtgatggcacctggttttaagcacatattgctgcacattgtttactttccgtcccaggcttttgactcctccaaggcttagttctctggtgggaactggctcaggaagcataaatgtgcatctcagaaacataaggaccttgatgtcccactggggcaaccttcaactaatggagtatgagagctgaaaataaatgcttatttgtattgatctgagagtagaaaattctgaggggcattccatatgttcctcaaaagatccagatcagattgagttggtaatgcatttttgtattggtttttctttattctcgatttcactctcaattcctcctcacttctgattgggattaccttccaaatcgctttcatgaatccaggctaagacatttattatctaccatggttctagaaattgacaatatccactgggatctcagagtggatgacttactggtgagactgcaacaaggaccccattgctggtggtagtgggtactaatagccccctgcatgcatcacagcacagttaataagactcttaccttcaggggattgggactagaattgaatggaaggtgaagagttgggttaattgatagctctaggacttgaatggtatggggatggtggaaatcaataaggatttggagttaatggacctcttttagcttttgaaatcttgaggacaagagatcagccagttatcaatgcagggtacactgtgaaaagagggcctatggcagcatttggaaagatccccattgcttgtgactataggacagattatgccaaaaatcaggctgaagatttaatcataagggtgaaagagctgtataccttctgtggtgggtttgtactgtgtcaactgggctaaactggaattatgtttcccagaactcccttctaggctctagattagcactggccatgagacattttgagtgagatttggaagacagaagtgaagcagcagcagctggatatattttatggctaaagattggtgctggtactaggcactgttgtaactcccacacatgattgctaagctgctgtgtcatattgttggtttggagcagtagccaggtctgcggctccttcagctcttgttgcatcactgccatcagcttctggcaattctgggccagtgtgtacagcttttctgcaggttatctgaatcattgagtttggaagcctgaaggtggtgagagacagacatggactcttgtttgtcctcatgggttccagattgtctttgggattccagtctattcttacttttttctattttgtattactctttcctttacaactccagatgtggaagcagtcttatacagactctttaaccaactcccacacctgtgtgaggccaaactcctatataagtctcttattgtataattcatagtggtcctacctctcatacacccttgacaggtgttcagggccaaagtctgaccctaacatgggaagagtaggaccctgatgaaatctcagaaggagacttctaagtggatgacctgagaatcttgaactccttaattttcctgagtcctctggataggcaggatcaacaccttgttagagagaataacttttccttgtttggaaaccaggcagagatcacatagagatggatttcttacaaggtgatacttgttctccttaagctctgtcccatctctcacccctatttcctccagaacaatagctagacacaatctcagcatagcctaatcagggatgtttttcttattctgggagtaaatactcaagcacgtaatcccaggacctggctaatatgtaccagtaggaacagaaggaacatttagggaggtggatcttgcaggtcttgcctggagtgggctggcggaataataaggatgaataagggagaatttattaacatgggaacgctattcgtaactcaggatttgacatcctaataacttggtcctaggatacactggtgggatggtttcttgaagcttggacatgagtatgacctatagtacattagataaatatgcaagaacttctttggcagagtatattgagatcagaactcacagagaagagagagttttagaatggatttactatatgagactggagaacacactatctgaccatacttcttaggaaggtccaaagaaaacacttcattcaccaaggtaattaagaatgcactggtgaggggacacaggctggagttgataggagatgcttccatggagctatgttccctagtatccatagcaatgataggattttggaatggcataggccagatggtgataccattagggctagggtggatgtaattaccataatgggccacagtggcattcagggtgtctttatccacagagatttggggcagtgactaggataggtcatggggcaagaaagatgacagccaactaggatgttagttgacttgtatgattcagaccttcatctctgggggatcttctcttgccttgctgttgttgggctgtggttgcttccagtgcctgtttagaattattcagcaggcatggaagcaataaaaaacattccactatatcccttgagttcaagataagttctttcctgtccccattaggtagtagtttctccttgaagactcagtgaccaaaggcaggaggggattcaagctgtattctgttaactctctcttaagcaccatttgacgtcatcttcaaactccctcatgcaagctttgactcatgttatcccaacagtgtcttgtcttgagcatgctcactgtgcatcttttcctttctgctccaaggcgtctccactgtccacccagcagaaggtacaggtgagagagcatacaggcatgtgcagcctggaagtgctaggaagttaatgctccccttgggcaaccctgaactagagggggcaggagccagtagagaaattcttttccttgtccttgcacagacaattgacaattctgagagcactctaatggttccttagggaatcctggcaaaattgagctccagttacccacagcagtgacctcgataaaggtagctttttattggcatatgctcctttccagtttcatgttccttggtcctttacttcaccttccagctaaattatctgcatgtaaatgtccttttctgatgtgctgctttggggaagaacccaggctcatacaagtacatttgttatttgtgtgcatggatctgtttgtctacctgccttcctagctaatctgcctattcatccacccacccacccatccatccatcctgttacaaataaaggacttagagtggtaaaaatacttgatcagcacagctttagtaaatggtagagtttagttctaaactgagttcaactgaatcaaaacatactctcttcttccttcattatactgtcttccgacctttgaagatgaaatcagtaggccttagttagcttgtctttccaagtcctcagtggtctggagcttcttaactgtccatacaggttggttatagttcaccagtatacaagttgggccatgcacatgcccatccatttgtcaataaattcttttccttttcctgtgcttcactgtggggagttgcaccccccacagtctattttgaaaatgtctgtgtactcttttctgtttcttttttgagtcctgtcaactcatttcgtttctttcttttttgtttgtttgctcatttctgttcttagtttttgtatttctgcttcaggattttttttttttttcataccctaagtgcttgcttgaagatacctaattcagtttggagtgttgtattaccatattcttcagcttgggggtttttttttttttttttttttttttttgaagtttgaaggtgagggtttcatcagctgaaatgctttgattagcatcttctgattttctttttaaacagttttctgtgtctctgtttggcttttttgggtatatctcttcattttctacttaaaacattccatagccccctcctgtgcagtagcttttatagatgatgttgggggaggagatgggtttggtatatcttgtttctccttcatttctgttggatcctttctgtttttcctcttgtttctttctttccctttactgcagtgtttccaaatgtacctacccttctatctggtttgccctcacaagctgtgcttctccaaggctaaccatcacacctgtttcctggctggtgctttaaagcacccacgtcctgacttatgtataatattttggcttttatggctggactctttctgggggatgattttgtcttgctttgtctaagtccatgcccccctactcatttttagtgtcccataagcctcccttccttagtcttgctgtagcagcagctctgttggaatttggtctatttttctatgacaggtaatttgaaggttgtaatactctgtctcctagtactagtacagcgtggttcatatgcagttttacttgttggttttatggtctttttttttttttaagggtgagtggggagatgtgaaatcaggcagacttcattgatgcccacatccagaagtttctgtgtacttttaaaggcttagctcaaattatcatctttcctttgaagtctttccatatagctttccagtttccatgctcagatattctgtttccttgtgttctaactaccttacctctccctaattacatttgttatattgcattgtaattatatatttgtctcccctccccccatcaaattgtgaacacctctaaaccagcaaactgttttttttttcttttttgtggtacatactatgtgcccactaaatggattgacttaaagcagaatagaggaacacttaatgaatgtcactgtgtccgaaatttattcctgctggtgggttcttggtctcgctgacttcaagaatgaagccatgcacctcgtggtgagtgttacacctcttaaaggtggtgcatacccaaagagtgcacagcagcaagatttattgtgaagagtgaaagaacaaggcttccacagcgtgaaaggggacccgagcaggttgctgctgctggctggggtggctggcttttattcccttatttgttgctgcccatgtcatgctgattggtccattttacagagtaccgattggtccattttacagagtgctgattggtgcgtttacaatcctttagctagacacagagcgctgattggtgcgtttttacagagtgttgattggtgcatttacagtcctttagctagacacagagcactgattggtgcatttataatcctctagctagaccccactcgacccaggaagtccagctggcttcacctctcatcacctcagacagctatgaataatatgaatattttgggatcaaatttatcttttttttttttttttgagacaggatttttacttctgtctcctaggctggagtgcaatggtgtgatcctggctcactgcaacctctgcctcctgggttcaagctattctcttgcctcagcctcccaagtagctgggactacaggtgtatatcaccatgcccagcaaatttttttgtatttttatgtaagggttttgctgtgttgcccaggctggtctctaatgctgtggctcaggtgatttgcctgcctcagcctctcaaaagtgttgagaatacaggcatgaaccactgcgcctggcctaaaaagaattctttatgctgcatacagcatagccttatgttcttggatttatctacattgttgtgtgttaggtgtattgtattcattttcatagatttaaacttatgtgtatgaagactataatttatctactttactgtcaatgaacatttgagttttctttttccctattaaaaacaatattgctgtaaacgttttttgtttcatctctcctggtacaaatgtataagagtttctctcagatacatgcctacaagttaaatactctagtggtcatggaggtatacacatcttcacctgtactagataattctgattttatctcaaaatagttttattaatttatactcttaacagtactgtgtaagtaatctggttgttcttcattctgtccaacagtttttatttttattttatttttgagacagagtcttgctctgttgcccaggctggagtgcagtggcgtgatctcggctcattgcaaactctgcctcccggtttcaagtgattctcctgcctcagcctcccgagtagctgggattacaggcatgcaccaccacacccagctaattttttgtatttttagtagaggcagggttttgccatgttggccaggctggtcttgaactcctgacctcaagtgatctgcccacctcggcctgagccaggtgtgagccacagtgcccggcccaacagtttctattgtcacgttaaaaaaaatcttttccaatctgatagggatgaatcttactgtcatcttattgtgattttaaatttacattttccttattattagtgaggttgaacatttttcttttttcttttttttttttgagacagagtctcactctgtctgccaggctggagtgcagtggcgccccaatgtcggctcactgcaagctccacctcccaggttcatgccattctcctgcctcagcctcccgagtagctgggtctacagatgcccaccaccacgtccagctaattgtttttgtatttttagtagagacggagtttcaccgtattagccaggatggtctcaatctcctggtctcgatctcctgacctcgatctgcccacctcagcctcccaaagtactgggattacaggtgtgagccacctcgcccagccaaggttgaccatttttcatatgtttattggctgtttagatttcttttgtgaagtgcttatgtctttttcctatttttctgttgtatgtttttctttttttttttctatgaattctgtgtagcagttctttggcaactcagaagtcttgcttttcttgaaagtgttctgtctttcccgtgcatgtttgcttatgttgtttctttgatgtggactatatattcctgttaaaactcactcagttcttcaggacccatagccgtcaagcatgaagctatctctgatgttccaactagatgtgttgcccctgcctctttggaattcatgcagcaccacattttggctgtagtgcatagttaggtattatagtttttttttaattgattccgttcactctagcagatagtgtgctttgtggggaggaactgtttcatcatctttgtttcccagtgtctgtcatagtaactgtgcgtgtttagctgcaagtaagaaaactcaactacagtggcttaactaaaaaggatttttaaaatccttgcataacagggagtctggagccaggaagcccaagcccctaagaatctagactctttctgctctggcaggcttaaatgtgttttagcttttgccctcattgattattcacattcacaaaagaatatgggagaagaggaaaacagtttctaatgtaggttttgaaatcctctttactagacttttctgtatgttgaatttttggtcacatggtatcacatggtcatcattctgcaagggaggctatgaaatcagatattgagcttcccaaggggagaaggtagttgagaatggtgagaacggtgtttaagtggacctgcctataatgtcgcccgcaaagagtactcaataaatattctttgtttaattttaaaatttttattaaaacgatccatataaatacttagtcaaatagtacaagagggattttattcccagtttctacttttttctaatattttctaccaatttcaagtggcattttaaaactcttgagtcatcaattttagacctgttttatttccctgcctgtctacttaatgaagttatattataattttggttgaatccacattcagtttttaatggctatataaatattcattgtggggccaagtgttttatgttttttttccttccttaaataagttttttttggttgtttttcctggagttaaattaccccagtcttttcattcacttagctttctttgagtctctaagtgtttctacatgttttaacagctttataaaatacttttcattatgattttctgtaggttagataacccatgagttctttttttcttaaagacagtcctttgtggaactctgttccgtctcttccattctggattggtttctttctcaactttgtgtaactgtcataatgggattttccttcactatcatcctgggaattatgtgcttaatcctgtttcctggatccaatggctgtcctcttttttagtattatatctgtggcgcatcctccagtagattgctgagaaagcttgcataggagatttttttttggaaaagctttttcagatattaaaatgtcttcattatgttctcatatttgtgacaggtttgcttggtttaaagttgtagattgaattgttacttgggattttgaaggcattatcccattgtcttctagcttctaatgatgctgatgagaagtttgataccattcttatttccagtggtttgtatgtgacctattttttaaaatctctggaaggttttaggatcctctctttatccctggtttggaattttggaattttacatttatattttaaaatttatttgctaagcactgagtatgcccattaaaactcctttagttctggggatattttttgaattagtcctcctctgggttcttctgttcactttttctaaaattctcttagatactggatttccaagattattctgtgtttttaaatttttttaatctcctgttgtttatctccttgcatctttactttacatttggtctctttctttaactttattatctagacctttaataggctccccctatacagatttaaaagttttctaagagcttgattttttgttttatttcttcttaattgctctctttttctattttatggttgaactatatacctccttaaggataattatactttttatgaagttattttcctagtaccctgggttgcctctctttcttctgaacttccttttttttttttttttttttttttttttctgtttattttggtgtcttgcatgttagggatttctctcaattgtctggtgatccttgactgttaatgtgaataagacaccaaaatgctggttagaaactctgtcttgctggctggaggcttacatggtatagtttttcaccgggagctccatatgtcaatatcaacaacttttacccaagtttgttcatttttccataaaaggatcctctggacttcttggggaacattagcctggctctctgctttctgaaaccaacagcgcgtgtgtagacttatatattattctgcattttccgttcttacctcatccttgcttctctctatacccagtgaccccaaatctggttcttctcccaggaaattattaatcctaagtgttacgagtgtgaggacttggggaataaaactccttaaatccgtttcagacatttcccctgtttgcattctttatcttgccctccccagtcctctgcctttggtgattacaggtgcttctataatttggagccttttggggttctctgggggtgatttagcttgctcacatgaacagtttcctctgcaggcattttaacttgaccttttcccattctgctgagtcatttacctttctttcaaatgttttccatcctcatgcattttagcttagggttataaatgtctttgtgggttattgaatgtgtttctgtttcttgtttacctttatgtttgggggtatggaaatgtttttaccatgttaaaattggaagtcaataagtgacttccttttaatgaattatagcaatataatgtacatatattgtataattactatatacttggcaccattctaagtggtgtacatttattatcttatttaatccttacaatgtctggtttgtgtcaggcatttacttccctaagatttttaaattgtattttaagtcttcttatctccacaacaaatcctataaggccagtaccattagcagtcttattttacagatgagggtacagagaggcacagaggttaagtaacttgcttgagaatgtatacattatagctagtaaatgggtcctatgcaatgagactctaagccactactgttttagatagctctctgcacagtgcctacatgcaatgtgaacttgttaaatatttgtagaatgaaaattttaaagtatacttggttttatttttttaattaagatatctttgtagatatgtcctttggttagctattgcttatttgctttttattcttccattattttcagtcaattttaatatcataaataaggacagtttagtaaagtgtaagctttttaaaaggtagtatgttttcactcacatttttaaaaagttttagaaaatggaagacaataataaagcaaatagtgggaaagtaacattgaatttatatgtcatttttagtgagtttaaaattcccttttatgggcacacaacaaagaaagaataagtcattttctgtggttcgttgtctttatggatgtccttgaattttttaatgtttatgtttatcaacatgctatcatccagatattatagatactttaaaacttgcctttttacttccagaggtgtgacccaaaataataactactataaataaaaaattaaatagatatttttctttgtgtttactaccccttcagatatattacttcagatgtatttgtgctaagtaaacaggtaattaatgatatctaggcctatatgaagataaatacctctatgtatataaagtaaacccatgtgcgtgtatattagtgattctctttattaaaaataggctgggcgcagtggctcatgcctgtaatcccagcactttgggaggcagaggcgggcagatcacgaggtcaggagatcgagaccatcctggataacatgatgaaaccctatctctactaaaaatacaaaaaattagcagggcgcggtggtgggcacctgtagtcccagttgcttggaaggctgaggcaggagaatggtgtgaacctgggaggcagagcttacagtgagctgagatcacacctctgcactccagcctgggcgacagagtgagactttgtctcaaaaaaaaaaaaatcatttaaggctgggcatggtggctcatgcctgtaatcccaacactttgggaggctgaggtaggaggagtgcttgagcctaggatttgagaccagcctgggcaacgtaggaagaccttgcctctacaaataataaaaaattatccaggtgtggtggctcaagcctgtagtctcagctactctgcaggctgaggtgaaagggttgcttgagcctgggaggtcgaggtggcagtgagccctgattgtgcctttacactccagtgcaagactctgtctaaaaaaaaaaatcatgtaaattttctttgtaagggtgttatggatacagtcatctttcataatttaaagttggcaatagctcgctttggcaatagctaactttgttttctgggaactctaattaaagcattttagtcttcatcatttggccaaataaaatattacatttatttgacaggtcttactgcatgtcgtttgaatttcattagaacttgatatgtttgattttaatgttaagtcattgtagtttttatatgcttttatatgctaagtacattactgcagctaacagaaatgtttaggaatattttaggtttgagatacagcttctatggtggagattctggctctccatctgacacaagataggcccatttgtggttaggtgatcagttcttgccaatgaaattgagcagaggttacatgtaagacttcagggctggtgtatttaactgtcagtgtaactcctttaaaagctttatttccactacttcatcaactggcagtactctagatgtcagcttctctttaaacataggttctgtagtgaagaagacatgtaacagaaccctagacaagccacactggacatgcagaatgagggagaagtgaactattatattaagccacagaaattttgggctaatatgttactgtaatataatgtagataattatgagtgataaaacctcctgtgtagaaagtctggtatgaagcctctcagaatttttttaagactgtggagctgcaaataatctaccatttttacaaaaacagacacataaaccaatagaacagcatagagaacccagaaatacagcctcacacctacagccatctgatctttggcaaagtggaaaaaaaaccaagcagtggggaaagatcttcctattcaagaaatggtgctgggataactggctagccatatgcagaagcatgaaactggacccctacctttcaccatatataaaagttaactcaagatggattaaagatttaaatgtaagacctcaaactataaaaatcctagaagaaaacctaggaaatacctcggactttggaaagaattcctaagtcctgaaaaagcaattgcaagaaaaacaaaaattgacaaatgggatctaattaaactacagaatttctgcacagcagaagaaactaccagcagaataaacagcatactcaatgggagaaaatattcgcaactatgtatctgacaaaggcctaatatccagaatctataaaggacttaaacaattcaacaagcaaacaacaaataaccctattaaaaagtgcggaaaacacatgaacagacgcttctcaaaggaagacatgcaagtggccaacaaacatgaaaaaatgctcaacatcgctaatcatcagagaaaggcaaatcaaaaccacagatgccatctcacaccagtcagaatggcttttattagaaagtaaaaaaataacagatgctggtgaggctgtacagaaaagggaacacttacacactattgatgagaatgtaaattagttcagccactgtggaaagctgaaaaaacttagaactaccatttgatctagcaatcccattactgagtatgtgcctaaatgaatatcacaatagacacatgcacttgtatgttcatcacagtactattcacgatagcaaagacatggaattagtgtgggtgcccgtcattggtggattagataaagaaaatgtacgtatgttgggcatggtggctcatgcctgtaatcccaacatttgggaggctaaagaggaaggattgcttgagctcaggagttggattctagcctaagcaatgttgtgagacctcgtctctactgggaaaaaaaaaattagctaggtatggtggtatacagccattgccccagctcctagggaagctgaggtgagaggatcgcttgagcccaggagacggaggctgcagtgagccgtgatcatgccactgcactccaacctgggcaacagagtgagaacaaaaaatccagggcaacagagaacaaaataaaaatgtggtacgtatacaccatggaatatgcggctataaaaaataacaaaatcatgtcctttgcagcaacatggatgcagttggatgccattatactagaagagaatttaattccggaacagaattaacatctaaacctatatgaagttcttacttgtaagtgggagctaaacattggtacacagggacataaaggtgggaacaatagatactgatagacagtagagagaaagaagagggaaaaggctgaaaaactacctgttggatactatggtcactacctgggtgacggaatcatttgtacgccacatctcagcattacactgtataactcataacgaacccacacaggtaccccctgaatctaaaataaaatttcacattatataaattcatctttttttttttttttttaagagaaaaaggacattagcatttagctttccactgagggcagatggagatggagttgggaggttttaaatctttagaacacctctgagagactctcagaccaacctggaaacttctcatttgccttgacgatttgtttgctttttttttttagaacttcagaaatgatactttaacagtgagcaaggacagatattgtaggtctggaggataatgtcagtcacctgattccaaattttcatgtacatctttcctgcctcctccgcaaaataatattaacaagctgaaaaccacacatgacccatgctttcagcattgctcagagatagggagtatgataatcttcagattacatgtaattagggaaaggaaaacagtaccaaatttcatagggctcttctgcagtagtcttgttgggtatggaatagtggagaaagggaaacttaagagactcaatgaaaaaaaggagactgggcgtggtggctcacgcctataatcccagcactttgggaggctgaggccggcagatcacctgaggtcaggagttcaagaccagcctgaccaacaaggtaaaacctgtctctactaaaaatacaaaaattagccgagcatggtggcaggcgcctgtagtcccagctactcggggggctgagacaggagaattgcttgaaccctgggggctgaggttgcagtgagccgagatcgtaccactgcactccagcctgggcgactgaatgagactccatcccccctaaaaaaaaaagttagactggcatggtgatgcacatctgtagtcccagctattgggaagctgaggcaggagaatcacttcaacccaggaggcagaggttgcagtgagctgagatcacaccactgcactccagcctgggtgacagagcgagacttggtctcaaaaaaaatttaaaaaaaaaattggctctatgaaaaaaaggcgagagtccccaaaactttagacaaaacacatacagaaatcattctcagaaagagaaaatgtcagcaatatgtgccaaaatacagaaccctggtctgggacttgttagtttacacctgtggctaaggaaaagggtgttaaagtgagcagaaccagaaggggcagcctctgagaagccttgcatttagaggggaatcagataaatagaaaaggggttggtaccttggagatgtgaccagtgaagagaaagagaaaattatacatttttgcagaaacaggaaaaattactagtttttctctatcattcattaaacaaagtgaacctcactaaactgttagtgactttttatacttagaatgctgtgtaataaatgcctagaaatagaacaaattactacaaaactactgtaaaaggaaaacagaaaatgcaaataaaaatattcctccaaatccaaccattatgtagaaaaaaaacaggaatataatactccaaactgaataaatgtcctgagacaagcattagatgatataaaaagagaaacataacacctggaatcaggtattaaaaacgaagaaagaaatggacaagaaaagggaggaaatggattctggaaaaaaaatgacaatgacaattgattctgggaaaaaaaaggaaaagacagaattgtatcagaaatgatgaatatatttacaagttctccaaggaagaatagatttaaatacaaatttaataagggcattgaagaaaagcaggggaacacttaattaaatacagaaagaaaaaatgtcagagaaaaagtggctgaaatggagaacaggcaaagaaaatgtaacatgtagaactggagtccttaaagaagaaaaattattcagcaaatgtaattctgagaataaaagaagacttgagtatacacattgaaatggcttactaggtactggggaaaattgataatgatacaattatcagttctcataacaaacagctctgagatatatcctattaatactattagacttcaatattgagtgatattgttagattttaatattttaaaaaatcctcagggctttaggcaaaaagataaaataaattataaacggaaggatagttaggttggcatccaacttcttaaaagtgacatacaaagcaaggcagcactggagcaactttgtggtggtggtttttttttaaagaaacttagggaaagaaagtacaaagcaagagttatatccaactaactgccttcaagattaaggctataaaacaaagtttgaggttgggcacggtggctcatgccggtaatcccagcactttgggaggccgaggtgggtggatcatgaggtcagaagttcaagaccagcctggccaacgtggtgaaaccccatctctactaaaaatacaaaaattagccaggcatggtggtgcacgcctgtagtcctagctacttgggaggctgaggcaggagaatcgcttgaacccaggaggcagaggttgcagtgaggagatcacaccattgcagtccagcctgggcaacagagtgagactctgtctccaaaaaaaaaaagaaaaaatttgagcactcaagagctcagagaataccctacacaggtagtctccctgaggatctactagacaatgaatttcatccaaacagattgagaaaacaacctgatggtgagcacttaatatacttatttgtagagctgagactaaggaacaaggatgggcccataggtagaagagtagtacacaaacctttttttttttttttttttttttagatagagttttactctgttgccaggctggagtgcagtggcgtgatctcacctcactacaacctccgcctcctcggttcaagtgattctcctgccccagcctcctgagtagctgggattacaggcgtgcgccaccatgcccagctaatttttacatttttagtagagatggggtttcaccatgctggctaagctggtctcgaactcctgacctggtgatctgcctgcctcggcctcccaaagtgctgggattacatgtgtgagcaaccacgcccggacagtagtacacaaatcttaaattatattgaatatatatttgtaattacataagtatgcaagagcataagtacatgtgcatacttgttcccgattttagtttcaatttcaatttcacttgaagtcatagcaaacatctagttccttgaaatgtaacacacagaaacagaatcagaaaccatgcaaaccatgtaaacattttcaaattcaggcatttatttccagtctaaaaatgtggtaggaaactgaggtaggacctgaattcttagatgctcaaccttttttttctgctttaactgccaccaaccatcctctagttgctgccactctgatatttattggaaagacacagagaagtgagcagacaggttgtttcataagtggtttagtgatgggtagcagaccaggctttcatactaggtagagacatggacattattgatatacttcacattccattggatccccattataatatttgggtttcaccattcaatttgatcattattcttgtacatcatattcttgttctgagtaagttggctatatgctttttggttcatttgggatgacttcaatcagtaaacaagtttaaagtcagtttcacattcaaatagtttcctgcatgaggaaattaaaagcaaatggttacaagtcaactgaataaggcattccttataatattatgaaacacgcataccacatatgtatacaatataagttcatgtacagcataaatatttgtgcaccagatttaaatgtatataaaatgacctaaatatgcataaatatatgatctaaatatgtatgtcctagctctgttcatgaaagagcctagaaggcaaggtacctcagtagcaagcagcatacctgatgcccagatcttggtttctattaagattccataagatcttatttcccattaaaaggaatcaaggctacttgtaagagaacaaatgaagttctcaaaaatagaaagagagaaagaaaaagaaaagtaaagaaagggggcatgtcaggacacagagccggcttttgaaagtgcttccagtgaccaaatctgggacaacttgtgcattaaaatgattagggaaaggctgggtgtggtggctcatgcctgtaatcccagcactttgggaggctgaggtgggcggatcacctgaggtcaggagttagagaccagcctgaccagtatgatgaatccctgtctctactaaaaatacaaaaattaaccaggcatggtggcatgtgtctgtaatcccagctactcaggaggctgaggcaggagaatcgcgagaaccaccatgcctggcttatttttttaaattgaaatagagacggatcttactgtgttgcccagcctggtcttgaactcctgggctcaagcaatcctcctgcttcagcctcccaaagtgctgggatttcaggtgtgagtcattgtgcctgaccaagaatgagtattaaagcattgaaaaaaatggtgattcatgagtagcctaatagataggtagatatctaagcaggaataagggaggtctcttctctgtggtgcagtgctgactgataaacttggaagaagtggaagagtcagaaagttactccattgtaaccattatagtaaggattagttcaggcaagaattgtcagtgaatgctcaatctagataggacattttgatgaagaacagcgtatttttcatgccctaaaatgtgtccctatggattgctttatttccctattgctttatccacctatacagtggataaactggacatcactttaactggatgataaatctaatgtcattaatgagggacagactgatgttgtatgcttcgggtttggatacctgcaaagcacacatcacctaagtattgaacatgcataacctgaatgatgatgaagtgccagtgaaacaaaaaattatatttaaataaaaaacaatattcctcaacaaagtcagtcctaaaagacagaaattgagaaacttccagatgaaatgagaccaaagagacatgacaaaataaaggcaatatctgattatatactggattttatactcaaggaaaaagtgctgtaataatgtattaggcttctccagagaccaggaccaataggatatatacatacacatacacatataaacacacacacacacacacacacacacacacacacacacacacaataggatatatacatacacatacacatataaacacacacacacacacacacacacacacagtcattccttagcatccataggagattggtttcaggatcccctatagataccaaaatctgtggatgctcaagtcccttatataaattggcatagtatttgcatataatctatacatcctcctacataccttaaatcatctctacattactttaaatacctaatacaatgtaaattgtatgtaaattattgttatactgtattatttcttattgttgtatcattatgtttcatcactttttttgaatattttaaatctataattggttgaattcacagatttggaacccatggacatggagggccatacacacacacgtgtacatgcacacacacacacacacccacataaacacaaatggtcatgtgccacagtgacatttcagtcagtgatggactgctatacaacagtggtcccattagattataatacggtgttgttactgtaacttttctatgtttagatgtgtttaattagacaaatacttgccattgtgctccagttgcctatagtattccttacagtcatatgctgtacagggttgtagcccaggagcaataggctagatcatctagcctaggtgtatagtaggctgtaccatctaggtttgagtaagcacattctatggtgttcatacaatgacagagttgcttaatgatgcatttctcagacaatatctccattgttaagtgatgcatgactgtatgtacagatgctacttgacttacaatgaggttatgttccgataacaccattataagttgaaaatatcctaagatgaaaatgtctggctgagtgggagctatggcttaccgctactgccaagcattgtgagagaagtaccgtttctactatatgtgtattacttttgcagtgttatgaagtaaaaaaaactgtaaatagaatcattgtaagtaaaggactatgtgtgtgtgtataaatataaaaagatttattataaggaattggctcctgtgattatggagactggcaggtccaaactctgcatggtggccaggcagggtggagacccaggaaagttagtggtcccatttgagtctggagaccttctactgtagaatcaggaagagctagtgttgcatataaagtctgaagactgtgctgaagaattctttcttgctcaggagaggacagtctttttgttctgttaaggccttcaactgattggatgacactcacccacattatagagggcaatctgctttactcaaagtccactgatttaaatgttaatctcatccaacaatctccccacagaaacacccaggatagtgtttgtttgaccaaatatctgggtacctcatggcccagtcaaattgacacataaaattaactcccacaagtctaccccttttcagctcggtacccttacacatctccttaggccttgcttaatttccaaataaagtgacaacaccgacataaatctgcctaacatgatacagctatcctgtgtacaaaaatgcactgaccttttccctagaagagggtgcaaaacctttggataatgtgtattcttctgcttgatatcttgtaatttatatgctatgatatctagttaatacatcttatgtttcatgttaagaggaaaagagagggtagatgtgttataagtcagggttctccagaggaacagaactaataggctatatgtatacatgatagggagttcattagggagaactggcacacacaatcacaaggtgaagtcccacgataggccgtcttgcaagctggggaagaaagaagccagtagtagttcagtccaagtccaaaagcctcaaaagcagggaagctgactgtgcagccttcagtctgtggctgaaggcctgagagcccccggcaaaccactggtgtaagtccaagagtccaaagaccaaagaacctggagccttgatgtccaaaggcaggaggaacagaaggaagaatccagcataggagaaagatgaaagccagaagattcagcaagtcagcttacgccacctaattcagcctgcttttgttctagccatgctggcagccgattggatggtggtgcccacccacattgagggtaggtcttcttctctcagtccactgactcaaatatcagtctcctctggcaacaccctcacagacatacccagaaataatatgttgctggctatctaggcagccttcaatccaatcaagttgacacctgctattaaccatcacagtagagaacaaagacttgattagtacatatattaatatatagacacaaatattttttaaacaaaataaggaaatattcatgacaaccatagtccccatttctgtgtcctagctggtatttataactatctccttccattactcattctgtatgcctttgccttcagccagcacctgagatgtttgtggttttttacctgggaggtgacccaaacctttattcctgaaggttctgggccattagtattgctgcctgaattgggttgttgtagttttctgttgactttaatcacaaggcatggtaataccaagagacatccaaaggagattgcctgtattttaagcatactcttccttacctttattgtggagtagcagttcaggatcagtcacctgagccaacactgtaactccctcctttgcctggtgatacaaaggcataaggagcccaaagtggccatgtggcagtcttaacttccagttcagtggaatcattgttgtgtctcctggtggaaacatcttgcccttggaactaagacttctaagccagcagagtatacagttgtgggaacaggaagcatacattttgctagtgggctactagggttaatagtgagtggtgccactcaaatttccaccccttgattcctgaatccattaactctggctatgggagaagtggcactatttactggatgctgattcagagcatgtacagcttcttggagaaccttgccccagccctgcaaggaattggcatccatctggtgctgtacctgagtcttccagaggccattccatcaagccacctgcttcaggatggtggagaacatggtaagaccagtgaattccatgagtgtgggcctactgtcacacttcatttgctgtgaagttagctccttgatcacaggcaatgctgtgtggaatatcattacagtgaataaggctttttgtaataccatggatggtagttgtgacagaaatattgtgtgcagggaaggcaaatctgtatccagagtaagtgtctgttacagcaagaacaaaacactgccccttccatgataaaagcagttcagtgttatcaacctggcatggtagcttggcttactattgtcagcaatgatgccatatatcgagacctagtattggtctctgctgctggcagattggcactcagcatcagctgtagccagatcagccttggtgagtagaagtccatgttgctgagcccatgcgtaaccaccatctctgctaccatggccactttgttcatgagcccactgggtgatgacagtagataggatgacaggtgggaaagagactggctggtatccacagaacaggtcatcctatctacttgattattaatatccttctctgctgaggtcatcctttggtgggcattgacataggagaatacaaataccttcagttttttttttttttttttgcctgtttagagagctctagccaaatacctcttccttacactttcttgtcatcgattttccaatcatgttccttctaagtccctgaccatccaaccaaactattggtgatagtccataagttgatatgtaatccgatgtctggtcgtttttccttcaagcaaagcgaagaaccgagtgtataccactttcatttgatggtggaatgctgctgtgcatccctcactttatcgagggagtctgcctaaagcccagtgatttaaatattgatcttatccaaaaaaactcacagaaacacacaacacacacataactaaatatctgggtaccctagaaccaaaaaagtagtatgtagtatgtatgagtgtattaataagatagaaaaatatgacagaatgttaaaaattggtgattatgaacaaagggttattttgaataagcaaaaagattatgaatatgacagttgtcttattttggcaactttgcattttaaatcatttaaaaataaaattaaaaaaattaattgaccacttgggaggctgaggcaggaggatctcttgagcccaggagttcaaggccagcgtgggcaatgtagtaagaccccgtctctaaagaaaagaaaaaaaaaattagtttaccagtgagcactgtagttgtgtttataggcactaaatgtctgacttttatatgacaacataattgtgctgatacccttgccataaaattagaagcattaattgcttaacttcgtttcaggggagtgggttacacacttcatgtttgaaatgagagcaggaggggacaccagggctgcacactgctctagctctctagtgcctctaagtcccaccacagcacccctggacttttttcttctacattcagaattggggttggagggcagttgtggttgattaaacagttagaatgaggtaagaaaggaaagctgaatgaaggctgggacaagacaaggtgaatctagtttctttggtcaccagttttcatagcattagattatatagctcactgagttaacattttttaaaaaagtaggattattcttgaaaaatgagttggctgtagtcctatgaaagtttattgctgtaagaacaagttattacaaactgttatttgatgtaaggctgccacatttctgtgctaatagaaaccaaattggcactgttagcagcatgtagtctggaaaacagaaaaaggaaaaggtgttgataaagtactttctcacaatagaattacgtgtagaagtgacagtagaactgcagtggaaaaatgaggttatgacttaggaggaacaaagtgctgctatattttcttacatcaaattgaaatcttatccttggaaatagtactttggactataagaaactatatcttgtatgaaaagtgtaattcaaaacataataaacaaaataaatttggtagcactttggaagctggaatgtttgccttgctgtaatggtttaattttttttttaatcattcacaagttatcaaatttttgcttgcaaaaatactgaagcaagacttctattgtaaatgaaggtataccttaatttgaggataaggaatgctgtgctgagtgtagatagaatgtatctgttctttatatgtctagattcgggttccaggtgtgattgtctccaacctgtcaaatagttaatggtttataaactaacacttgagggaactagcttttgaaagtaaatcttaaaaacctctgtgcaatccttttgatttactctgttgctccctaaatctttttcttcacatttttgtgtatattaagttcagacatacgacatggtcaggaaatgaagtatttgaattaaccattcttttaattaaactatttgttttataataatagtacattttcaaataatttgactacaacaaattagtgttccttggcatcttcatttggaaatcccatagatacttcatatacttttaaaacattttataaagtttatggtcatcaaatataaactataaagctgcatatgaaaaaataatgtgctattaaatcacattattaaagcaaatatgtaaaaacttgaaatatttaacaatagtgcattaatacatgttttttataaaaataagggatttttttagaggatgtagtataagatgtatcaaaaatatgtgcgtttagaaaaataagccttaggaactttatatcgctatttagaaataagcagtttttctaataagtaaggattaactttgataagtaaataatatgcttgcaaaattataaccaaataaacattaagaaaatcctgattgagtctgaaaatttctttataatactcattttttttgttttttgttttttttttttttgagatggagtctatctcaattccccaggctggagtgcagtggtgtgatctcggctcactgcaacctctgcctcccgggttcaagcgattctcctgcctcagcctcccgagtagctgggactacaggtgcacgccaccatgcccagctaatttttgtattttaaatagagaccagggtttcaccgtgttggctaggatggtctcgacctcttgacctcgtgatccggctgccttggcctcccaaagtgctgtgattacaggcgtgagccaccgtaccccggccttataatactcatgttttaaaaatacattcatgttttttactttaaagccctaattttttcttttgagttataatttgcatgcaataaagttcactctttttggcatatggttctgtgagttttaacagatgctaacagttcatgcacaacatttggaaagttgatcttattttttatccctagtactttatgacgtcgtggtcaccaggattatcattgtgaactttaatgattgcactgcaactattcagaatagattaattttagtactttccaatgttttctctttgtgctgagtagaattagtgaatacatattgaggaatttacgtcttcctccctttccctaccttcagtggcttagtgtagcctttatgaattttggccttgactgttgtttcaacctgtacattggcttcactgttttccatctcaattcctttctagtttgttttccacgctgctgctgctgctggtctttctaagatgcagaactgataatcttctccttaaaatcttttattgcctctcctttgccttctttagatgggaagaaataaaatactactttttcatatcaaacacagattcttttgtgagctggctcctgcctggtgtcttgcagtgccttttttccctttccttcccatgcatctgcctgtctgcactaattgcagattctcagatatgccatgttctctgttgttttggtggttttctgtatgcttttccttcctactcacagcttttttttttaccctgctgttccttagctgcctaacttctccaaaccttcagatgggctgagatgctctcttatgctcttctggtactatttacctcatttctctttaatagtgcttgttccttggacttggtcacctgcctgagtgtcccctctggaccctgagctgcttggggtcagggagtatgtctgttccagtcttgtcagtgctttgcacaatgttggatataagtaagcattcaagatgtttgttcaattaatatactatagcttacatgtagagtctggtgactacgtgaaacctatgaaatagggaaagagaagaaaaatgtcttatggcatcagtggacaccagaattccttatatgaagggaggtacactgggggcattgccttgacatcaagctcacttaaggatagggagtcctgtgaggatggatgttcacagggtctgagaggtcagaagaagtagagcaaacaaggggatgggattgctggtcttattcctaatagggaagaggagagagaaaacaagtcagaaaagtgatgtaaggtcagggataggtgagataaagatccccttccccacggttggatgatggaaagacagattgagaaggttccttcctccagctccttttgagggggttgttttaactgttgcctggtgtaccactcttttgcctagcttcagaaatcttcactgaagtctggtatgctaaggaatgctttttgaacatgtttggtttttgtttatcttgtgtagaagttggtgagctgtgtcctcactggattattgcagtgcataaaagcgttggtgaccaagtagctctaagagttctgagaaggtcagctctcccagtaattgagggaaacctgggcagacaggggaggctttggacttgcacaggccttggcactgcagatttgagtattgagtgtagattataaggggctggtaagcccaatgtaacaactagagtacacatacaacaagaaaagactggaattgaacatataaaaatgagagtagctagtgttcggaagataggattaccatatatagttgtttttttcccctgaagactttctttgtcatagttcataacataggaacagttttaaaaagacaaaaatatgtgcaatacagtgtcatgatcttattcataccagaacttgaaaattagaggttagtattgagatttcattaataccaaaagtgttggaacggagaaagtgaaactgtttattgaggaatagggaataagggctaggactgaaactcctttctttgccaaaagtaggaactttcttactaacatattaggctttgtttccctcttttttgttttaattgatgaactgatgtctcaaagaaaaaaaaatctgtcaagtaactgaaaattggataaggttttgaacaaaatttaagttttagaaattgatgttctgtagatcatttataataaattatggcttatttaagtttagctgcaacaaacgatacgtttctatcctttctgttgcattcactactaaatcttacaatgttactttttataattgttctcctttttttctgaaataaaaaaattagaaaataattgagtaggccatggtttacttactgcagtattatgtatatattgctgttaattaaatgtgccttgatagtggcaaataggagtcattcaacactggatcattatgctattcgtcttttcatattttgatttcatgcttacagctatagttataagcaaaggacggaaggactcaattggtacctttccatggtgagaatggaattagaaaaaaggaattggtcaagtggtctaataagacagtaaagcttgagagcatgatacagcaatttccatgatagggaacctgatgtttgaattgacaggttagattgtcccatggatagtgctagaaacacattgcccaatttagaattctgttttttagttttcttttctttttttttgggacagagttttactctgtcttcaagctggagtgcagtggcgcgatctcagctcagtgcaacctctgcctcccaggttcaagcgattcttctgcctcagccccctgagtagctgggactacaggcgcctgccaccacacctgactaatttttgtgtttttagtagagacggggtttcaccatgttggccaggatggtctcgatctcttgacctcgtgatccacccgcctcggcctcccaaagtgcttggattacaggcatgagccaccgtgcctggcctgttttttagtttccattttgtccagtctatcttttgttgtccattcttttatacatttttgttcttttgattaggaaagttcaagttcttctgatctgcatacagtgatttgtatttcgtaaggtgactttgcatagatctcatttcatcttctgaggtgtgtttttggccaagctgactgctgaggcattctattgttgctccagggtactgcttctctggtacttccttcagagaccatttgtgttggtgagaaagcctatggtttgtttttttcctgcccttgacaccttaacatatccttctctctgttcttgaattcttgagtcccttctgtcccggatcccattatttatcactgcctgaagaacctgctcccttaggaaccaccctcccatctctactttttctagcctttcctacattccattttcccatgggttttctctgtcatctgtcttaagttggaaaaaagtttcatatgattctttcccatttcccctgtattccttttcattataccctcattccttgaacagaattgttattgttttgtttttccatccacacccctataatgcaaccttcctgtgtaaattttaggcttaagcttttctattcacatacttttatgctgaggcttggatttttatttgggctgttagatgcccattttgacattgacattaggggtttcaaaccatccttaaaaggttagatgtgacttgcaatgttattgaacaatttgatgatccgggatattatggctctatgaaatctccatggttcttggagctagcttgtttttattctgggaagaattttctagctccccagcttacggcctgaatggttagagtccagccagtgctgtttgactttatagttcaaagggggtcatttctgtggtcactatcctatttaacagtcatgtcatggtatgtcaaggtaggtcatcatacaaataatctgcattctgttttgactgttttatttttaaaaataatatctcctccttttaaactttaaaaaatttagtaaagtttagtaaactttcaaaaatttagtaaaaaatgtagtaaaaattcacttccttcattatgctttttgaaatctggctttttttctcattcttcccctattaatggttcttaaaaaaaaaaaaaaatcgctgttgacctaaccaaattagagtgtctcagtcttcatgcacttccaccttcttgctgcatttgactgcattgatacttcttttttgatgttctttctttgaatttcatacatggttagttgaaccacttctctggctctttttcttcttgcctcataactctaggtaatcatcaagacttgcctttcctttcctgtggtctcttgaagggcgttcgtcttaaagctttagccattgcctttctcctagtaactctgtgcatgatgtctctgcagaactttagttccttgtctagagctgcctacatgaaagctcttttggggtttttttctgccattcttcaaaatcagtgttgaaaccaaaaaacttccccttttgacttccttattctgttggtaacactgccattcaccagacttgcatttcttatgctttagatatagggctgtcttagtctgttcaggctacaataattaaaataccttagacatggccaggcatcatgcctgtaattccagcactttaggaagccaaggagggagggttgcatgagccaggagtttgagaccagcttgggcaacatagtgagactcggtctctattaaaagaaaaagcccagcaaccttggattaggtaatttataaacaacagaaatttatttttcacagttctaggcaccaggaggttcagtgtctggtgagggctctctgcttcatagatgatgttttctagctgtgtcctcacatggtggaaggggccagcaggctcgctctagcctcttttataagagcactaatcccatccatgagggctctgccctagtgacctaatcactttccagtggccccacctcttaatgtcaacacactggggattagatttcaacatacaattttgaggagaaacattcacaccatagcaggggccaatagggaaaaaaatggaacagaaattgagttaatttatctttgaaagtgaggaccctgtcctgtgccttttgtagtttcagcacccaagacaggtattcaatgaatgtttcttaaactgagcattacagtgattcttgggttcactctttcctctagtttttactcagaccagaccctcattagtacacatcttttttactgcaatacctcattgttttttagcaatcatttttccttgcttctatgcacattgtacattactgccaggagaatttttctaaaacattacttttatgtagtgaagagccattattacttacggattcaattaaaactagttagtctggcattccaggttttgagccagctagttccatatacctattttatgttatgtttttctcacataaattcattatagctagttagaacagtctttttattattctctcgtagtaacatagttatttctacttatacctttgccccagctgttcttccagtacagaatttcccagccatcctctcatttttttgccagtacaaatcctgtacttcttagctaaagacctaacacgtagcccagaacgttggcctttagtaggcactcttgactgttgagtaaatggggacctgtattctcaatgagcttttctaaccagcttcacatgatattctccttcatgtccacatactccacaggcctgtttattaacttacatttctcatatcttatttcaagtttaataaatgattaattcattgaataaaatctggcatatgagtgccttagcatatactgtgaaatgtatttgaaatggcttcaaaagcattattgttctctttatttctaccttaattgtaaaagtgcttttaaattaagcctttaacataagtgaatcattggatctaatcaaatgatttcagcacatgctctgtgcaattacatttgtgcagcttagctgaaactatggcaacagagtgaaaaatgcatttttactgatcattttcctccataggagtgggaagttccaagttaaacatctcacaactttaaaaaattattatacaaattatacttacaatagcattgcttagaaagttaggaagccatttatcaatcataggtttgtggctgaaatcctggaagaccatgccaagggttaacaatagttacctttgagtgttgggattatgggagatttttaaggtctgctttaggcctattttttcaaaaaacagtgaacctggataattttatgaagaaaacaacaacaaagttatttaaatctgaaggaaaagacaattttccttttatccttaagtttactgtttttaaaattacatcaatcaccacctcatatctactaggatggctactaccaaaaaaaaaaaacaaaatagtaagtattggacagaatgtggagaaattggaaccctcttgcactgttgatgggaatgtgaaaaggtacctgtgaggggatttcacaaaattcatggaaaaaatggttaaaattgctttgtgagagcattaaaactatttacacctctttttccctaaatgattaaacttaaggcattaatataaaaaaattctaagagcttttgagaggagcatggtttaagctgattcacaacagagataagcctgaagtagaccttgaaaagatttaaaatatttattgatttagtccaaatttactaatatttaacaactcatgtggtcatcagaattgacaccagaaacaaataactgatatggtcgtactcctgtgtaccagttgattagctctattctaagtttttagtttgttgatactctttgttgttttgtatatttgtcaaaagttttcataaggcattctttctatgggaaggagttaatatttttctaagttaggatttagaggctgaaggtaaggttttggtgccactatgctgttatagtcagacatccacaaatgcccaaactctgctctcccaggcccctcttttccctcagagtcatgagtgatccatctgcaaggcacaagtagctggtgggaatcagagtaacaaatttaataagagttgtgcaaacatccaacacaccaatgtaaaactcttctgtagaagctgcattggtgcagtagtttaggtttaaggcctaagtgaggtgtcctacttcccttccaactacatctaattataatcttgagaccagcatgttcaggtgtgtgacttagaaggttagaatgggccgggtgcggtggctcatgcccataatcccagcactttgggaggctgaggcaggcggatcacctgaggtcaggagttcgagaccagcttggccaacatggtgaaagcctgtttctactaaaaaataaaaaaaaaggttagaatggagaagaaacaccaggtatcttagtttcaggtttctttaacaaagacaccataaactatctggtttaaacaacaaacatttatttttcacagttctgaaggctgggaattccaagattaaggtgctggcagctccagtgtctggtgagggcccacttcctggtttgcagatggcagtcttcttgtgtccttgcatagggaaagcagagagagaggaagcatagtctgtcctgtctcttcttgtagggcactgaatccatcatgagagtttcaccctaatgacctgattacctcccaaaggccccatctctaaataccatcactttggagattaggattttaacatatgaattttggaggatacaaacattcagatcatagaaccaggtcccaggagaacccctgaatctgcttagctaactactatgtatgttgaagggagaagtgcaagagaatggccaatctgtcaggccatggaagaaatttgaggcaaaaaaaccaaagaggccttgtggggaggctgatcttttaacacagtgagtctacctattaattgtgcccatctggagttttggactcttgaataaatgaattagtcacgtttcttacctttggggagaactagaaagggggttgggcaaaggcatgcctggcataggaaaaggagcaaaagtccttttttcccacaactagactaaagtaccatctccttttgagtgtgaagaaagacagtgtacaattctaacaggtctgtttctggcacagtctgatcctaggcatgcaggtagctccacatcatctgagcagcatattttgggctttactaaagcatgtgaatgactcacacatacagatttcagcaattggttgatgttttatttcacctgtagggtgaaataaatgtgtaaatattataagtcttgttctaatactgttaatattattgtagagaagtttgagctcttgttcttaggttaacaattaagagaaatgtgatttatttttagactttcatgcacaaaagctttaatcacaatgacaaaataatagcataggaatgaaaactatttagacacctagactcacatgctcaaatatgtgttttttattgcttaggattctatataatatgatatttaccatttcttcttatgtgttttgtcattaacacagtgaaaaaaatctttataatggacaaatactcccccatgcctaaatatgatactacttactactgatttgctctcatatgtgtgtttacttactttgccagtagatgtaatggaaaagactcagagtcaggaacaggggcaaaaaacaacaacaacaaaaacatgtggttgctaagttcaagagctctgagatgggcctatatcatatcaccttttaaatttttattttactcttttagattaatttatgatggcagtagttgaagtaaagtaaaggctaagtacagcccacactgtgaagattctggtggaaaaatagtagactgtcagaaacctggatgaaactcaaagactgtaggccaagtaaatgaagttgaaagccaagaaactatgtattgcatgatttcatttatatgaaattctaggaaagctaaaactgtaatgactggaattagattattagttaccagggaagtgattggcttcaaaaggacatccagaaacttttcagggtaatggaacagaaacttttcagggtgatggaactgtttttttgtttttttgtttttttgtttttttttttgagacggagtctcactttgtcgcccaagctggagtgcagtggcgcgcgatcttggctcactgcaagctccgcctcccgggttcaggccattctcctgcctcagcctcccgaggagctgggactacaggcgcccgccaccatgcccggctaatttttttgtatttttagtagagacggggtttcactgtgttagccaggatggtctcgatctcctgacctcgtgatccacccgcctcggcctcccaaagtgttgggattacaggtgtgagccaccgcgcccggcctggaactgttttatatcatgcttgtggtggtggctccatgactatgtaaaattaccaaaattcatcaaactgttcatttaaataagtgaattttattgtatgtaagttggaccttagtaaaatttaaaaatacgttaactatagatttttggtgctcagatgtctttaatttttcctttgagcaaagacaagaaccaaaggaatgttatctgacagtctcagacaataactttgaggactattgtaaggattaagatttctgtatcctaccctatcatagtttcaactgcatggttcccaggtgagattaagaaagtgaaggcgcggtggctcacgcctgtaatcccagcactttgggaagctgaggcgggtggatcacgaggtcaggagatctaacacggtgaaacccggtctctactaaaaatacaaaaaattagccgggcgtggtggcgggcgcctgtaggcccagctcctcgggaggctgaggcaggagaatggcgtgaacccgggaggcggagcttgcagtgagctgagatcgcgccactgcactccagcctgggcgacagagcgaaactccgtctcaaaaaaatcaaaaaacaaaacaaaaaacaagaaaatgaagacaaaataaaggaatacatgatagcaagcttgatctttggttctgtaccccaaactgaaaccttgaccttggtgagctgggctggatcacatggacctgcttaaggacttacttgtccctttgccctgtgcagataccctttaagattgtttactggaatcttgccattcttaagcaagaaaattccaagaaatctaaactctatcagaaacttgaggtggaagagagtggtttttcttcataagcccagggctaagctcttttcaggaccagcattcttgagttttcctaagacctaggacttgaggtatgggagaaagaagagctctgccttacctaccagccacctgggaacagtattggtggaaaagcaataaaaagagtaaatgaaattctcagctgctaaattaatgagaggaggagccaaagagaacataccttgagctgcttctcattacctggaaaccttcaaccctgagtacagaaggcacccttcatctggagccctggggataggaggttggagaagacttgagctcctgtagcagccaaagtgttaatttatgtcagaaacaaaataatagaggtagtagattatgaacaaaaacagcccttcacagatcatctgaacaacctttgtgaatgactagggtttcctgggtactatactttgtaaaagaaagtgtaattaatttataacctcttttaatttcctatgaaagttaattctgtgtatcaaaaaataattccttatcttcttagtgtagcagcaaatatagataagtaatatataaatataaagcaaatataaatatagatataatctagtatatgaacaatgcttttggaaagctgggcttgtacatatctcagtaaataaaaaaggattcctaatagtaagaaccaggagtaattatttttgacacatgactctttaataatctcttaagcttttttacataataaaataatagaatttaacattagaagagagccaaatcattgtttcaaaagtggttgtctcttatgagtttggctttttataaaatctacttgacatattaaagataagccatcgtttattttagaatactacctatgtttttgatattcattttagatctatactgatgtcaatgtgaactctaggctgggccatgtacattgacttgttcttactataaaattatacattgatagtaaaactcttaaaaatagaaaatagaatggtggttcccagggctgagagaagagggaagagggcaattgttgttcaatggatatagtttattttgcaggatgaaaaggttctaaagatctgttgcataacaacgtacatatggttaacaatactgtatacttaaaaatggttaaggtggtaaattttatgttatgtgtttttgaccacaatttttaaaaattttaaattatgagtttagttaaactttggaaagacattgaaattatttatgccccaaagcttttcattctaaaagttgttagttgagttttattttcttaaagttgtagtcccaaagcattaatttatttacaaacacttatactgcttattggcacacagcaagcaccatataaatttgattcatttaatcctcattaaattctatgtagtgggtattattttgttttctgtcattttataatggccattttctaatatacagagaatttgaaagaattgtatgttgaatacccttatactcactacctaaattctgcaattaatattttgttgtatttgcttttgacgtatgtgttcatagctatatttatttataaatttatcttattttaaaaaatgcatttcaaagtaaatcacagatatcagtatgctttgaggataggtgtttttatgcccattttacattattgggaactgagacacagacaagtaatttgtcaaggtcacacagcttttaagtggcataattaggatttggatcaagcctttcttaaccacttctacagagtactagttcacataatgttaatagatactaccttaaaaagtaattttgtggttaaatccacaaacgtagtatctttgtcttgatctacatgcatattttcataatacaggatctgtaaggttcagcagtaaagaaatcgtttaactttgtttaagccaaccatttccacatttattctaccaaagcactctgctccccacatctccccctaacagaacacctattataggataggactagaattcaatggaatatgttatggaaaatgctaatttataagagatcctaattttatttattcaagacaatatatctttgaagagtttatatttttaaacatagtcctagaattttagagctgacagggatcctagagttcattgagaccaacactttcatttcagagatgtagtaatggagacatagagtattgaagtgacgaatgcatactatatcgtgtccaggtatttagtggcagaaatggaactagaacttaccctagaacctggggatggcatttaatagatactcagtaaatgtctgtcgaatcataaatacatcttctcaatccatccagttttttccccactatgtatctatctacatattagaatttttatttatttttggagtatattggtcagtagagagtctaataaacactttaatttatgttaatatttggtacaaatgatatatatagttcctaaattccaaaaaaagttttattgtaatgcataacatacagaaatttatgcaaaatatgctatactgtttaacaaataattataaagcaaaccctggttaatcactcaagtcaagaaatagagcgtcgctggtacacaagaatcccccaggagcctccttctattgctgaccctcttgttttttttttcctctttttttcttttagctaatttgacaggacatgctgagaaggtgggaatagaaaattttgagctcctgaaggtcctaggaactggaggtaagtcttaagttaattatatttaaggaaaaaaaaaagtacttattattcctatgatgaaggattgatatccccaatacagaaattaaaatttaaaaagcatgaggaatccattaggagaactgtcaaagaacatgaacagaccattcatagaagcacaaaaggcaaaaataaaaagaattggcaaggatttagggaaaccaatcccttttaccctgctgttgggaatgtaaattagttcagcctttacacaggacacaatattttattttattttattttttttgagacggagtctagctctgtcgcccaggctggagtgtggtggcgtgatctcagctcactgcaacctctgcttcctgggttcaagcgattctcctgcctcagcctcctgagtagctgggattacaggcgccttctaccacgcccagctaattttgtatttttagtagagacggggtttcaccatgttgttcgaggccaggttggtctcgaactcctgacctcaagtaatccgccctcttctgcctcccagagggctgggattataggcatgagccactgcgcccagccaggacacaatattttaaaaaatcactaacattgatagagtgcttgttagatgccaagtactctgtggagggctttgtattgattgtcttattcaatctttgttcaactcagttgatactcaatgaacgtaatttgtaataatgaaaaacccaggactgtttagaaacccaacaatagggctttggttaaatggaacatggatctctatgttctataatgtatataatagattaaaatgatctacttttatttaatattttggaaagctctccaaaataagtttttaaaaagctacagaagagaatgtacaatatacaaaacattatatgaataaatataaatatctacatgtgtatatggatatggaaaatatctgcgtgtatatttgtatgcagaaaaatctctaggtgcccgggcgtggtggcttatgccaccacagcactttgggaggcactttgggaggccaagatgggagaagcccttgaggccaggagttcaagaccagcttgggaaacatagtgagacctcatctcaacaaaaaataaagaaaattctccgggatgtacatggttatatacactaaaatcttagtggtagcgggattttacatgatcttggttttctgctttgtaactttcctttgccttctgaatttttgctaccaccgctttcgctgctcagaaatcagggctgacttaagggggatgtgacctatgcagttgtagagatccctgcatgtagaagagccccatgtttggtgtaatgctctgctgtcactgttctgaaattattagtaattcatgaacaaggcacccgcattttcattttacactaggccttgccatttatgcagcttcttgtcatgtgtatgtttcctactcagttctctccctgtcctggactgtgttgctctgcagccaccgctgctgtgagaactggcttctgtcatttttctcccatcaggtcaagatacaaaggaggcctttaactcttcccctccccctcctcctccccattctcagcaggcctagatctcttttcctggaagaccagggagagcatcagaggacagaccatttttcttccccgctgcagtttagcgtcacactctcagggacctgagtgttctagcgcctgacaggatggattacacctgtccatataagggtatctgcccatcccttccaaaatgccaaacattatagcaagaaagaaagcctttctcttggggcctctgtaatcaataccagccacttccctagcttcatgtctgtttgtttttttgttttttgtttttttgtttttttgagatgaagcctagctgtgtcgcccaggctggagtgtagtgactcgatcttggctcactgcaacttctgcctcctgggttcaagtgattcttctgcctcagcctcctgagtagctggaattatagacatgcaccaccatgcccagctaattcgggtttcaccgttttgactaggctggtcttgaactcctgacctcgtgatccaccctcctcagcctcccaaagtgctggtattacagacgtgagccatcacgcccggcctgcctcatgtctaagttcgcttatgtaagctgtctttaggtcatttagtaatgagccttcatgtctacggccctgctgtatgaggtctttataacctccctgagtagtttagcatgccatataggcccaatctttacagctaccagtgaataagcaaaatgaatagtttattcccatcaactaagcatgttattgtcagaaatttagtgtaactgtcaacttggagatgttattgtacatttccaccttcaaataatttgttcaaatgtattttttaaaaatccaagctctaccccactgtattcctaagaaatcatgctttcaaaatatcaaaataataccctttattcctacctttgtttcctgtttcaaaggcaatatctactcaaaggggaaagaggatcacagttctgtggtgactcagttcccttaaaaatagtgctttgtgacatctggtcaaaagttcttaaggttgatatatattatagattgtttttataatagctgttttatctgcatgtttttatctgttttgtctgtatgtggctttcttggtaacaactttattgagatataactcacgtaccatattgttccatcatttaaagtgtgcaattcagtggttttagtatattcacaaagttgtgcagcaattttataacagtcagttttataacattttccttacttcagaaagaaaccctgaaccctttagctattaatgcccaagcaagctcaccatcctccccagtcctaaacaaccactaactgacttttttatctatatatttgcctcttctaggcatttcatataaaggtaaacatacaaatgtgtagtccctggtgaccagcttctttcacttaacataatgttttctaggttcattcatattgtagtacacatcactacttcatacttttttttttttttttttttttttcagacagagtctcgctgtgccacccaggttggagtgcagtggcgcaatctcacagcaacctccacctccctggttcaagtaattcccctgcctcagcctccggagtagctgagattacaggcgcacaccaccacgctcggctaatttttttgtatttttaatagagacggggtttcactatgttggccagattggtctcgaactcctgacctcaggcgatctgcccgccttggcctcccaaagtgctggaattacaggcgtgagccaccctgcctggccagtacttcatactttttatgacttactgtttcattgtacagatataccacattttgtttctctgttcatcaggagatgggcatttgggttgtttccatcttttggctgttataaataatgctgctttggagactagcctgggcaaaatagtgagactccccatcttgccaaaattaaaaaattggttgggcatggtgtgatatgtgcctgtattcctagctacttgggaggctgaggtgggaggattgcttgaacaggagtttgaggctgcagtatgccatgattgtgccactgtactccaccctaggcaacagagcaagaccgtctctctaaaagataaacaaatacatgaatataatgctgctatgaacattcatgtacaagtttttgtatgaacatatgtttttttcattttcaggtactttataaaaagtcatgcacacttttaaatattttgaatacaaggttctataaattctctcaagttctgtttaaagtaatctttgaagtgagaatgatcttcttccttttttactacaggtcaggttaaataattttaaaacaggaagaaatctgaatggtcttcttccttttttactacaggttaggttaaacaattttaaaacaggaagaagtctgtgatagaaaaatattatatgcttatactttaatcataatctatattgcctgaagagttcatagtgtcttggcatgtttcttgccatctgccatttatttagatggcagaattccatctaactcatctataattcagtaatgtaaaattgccagaaaaatagggtttgggtaaacaaattttcttagtgggttaacttatgcatagcagtttctcaaatatttttgaatgaatggatgagtatacttattccatataataagggatctctataaagatccttgaaaatttgaaaacaaattgctattcttatttgcaatgtttacctgactttccatgctttagagattcttttttcatattaaagttttagaaatgtcagtttttatgttttttatcaaaagcaaaacgtagtaaaaatattagtacaattgatcaaatgaaactactgtttatatacttttgattaacccaattattatttattttattttaaaaatagatttatagctgtttttaaaagaaaacgttatctctgagatgatgttttattctagatatggtcaaagctaaacaactttaatctgtaataacagataacttctctatagcaaaatagacatagcatctacagaactttcaaggacactattaaaatgtaatattaatgattaatttcaccattgaattttatagtacataacaagaaccatgagactaatcctattcattgatctgttaatttaatgcatgcaggcctggtgcaatggcttatgcctgtaatctcagcactttgagaggctgaggtgggaggatcagttgagcccaggagttcaagactagcctgggcaacatagcgagacttcatctctactgaaaaaaaaaacaaaaaaaaaaacaaaaaaaacaaattagcctgggctgttgtgacactcgcttatagtcccagctactagggatgctgaggtaggaatatctcttgagtctggaaggttgaggctacagtgagccatgattgtgccattgctctccagcctgggagatagagcgagaccctgtctcactatagttttgaacttctgggctcaagcagtcctttcacttccacctcgtgagtagctgagactgcaaccatgtgccaccacactcagcttgcttgcttatttacttatttagtagagacagggtctcgttatgttgcccaggctggcttcaaactcctgggcccaagtaatcctcctgccttggcttcccaaagtgctgggattacaggcatgagtcactgcatgtagccacaatcattattaaacctctaaagtgctagataaggaattttccttactcttgccaggtatctatgcagttgagtagtctttctatcaactgcttagattacctggcaaaagtaaggaaaattcttaagcttgaaaaaataaaatgggagcaggaatttagagaagcaaataagctgcctgagggcagaagttatgctggagaaatccaccagtgaattccgagctagttctttgggtttaccattttcatacttcatatataggagacagcttctaaggcactcaagcggtagagaaggctactgctcagtaaaacagtaaatgagaaaataaaaatctagcctgcaaagggagatagaggggaaacttttctggcttagcattggcttcgggtgaaggaaacaaataagcagtaaaagccttccgtgagtcataaccttaaaccaaacatcatacaggtttgcaacttcagtttgttatccacttatgtgatttaaaaaaagaaaaatcctggccaggcacggtggctcgtgcttgtaatcacagcactttgggaggctgaggccagcatgggaacaccccatctctactaaaaatacaaaaattagccaggcgttgtggcgggcacctgtaatcccacctactgtggaggccaaggcagggagaattgcttgaatctgggaggtggaggttgcagtgagccactgcacagagcaagactccgtcttatattaaaaacaaaacaaaacaaaaaaccacacacaagcaagtatgaatttagtttattctacttatgaattggtagtgttcccaacagcactagcaaagcaaatgtaaatcttctctggaggatttacttagatcttaaggaaatagcaaagaaagttttacagacatgattttactatcaaaaattacaaacaccagccgtgtgcggtggctcacgcctgtaatcccagcactttgggaggccgaggcaggcggatcatgaggtcaggagatcgagaccatcctggctaacacggttaaaccccgtctctactaaaaacaaaaaaaaattagccgggcatggtggcgggcacctgtactcccagctagttgggaggctgagacaggagaatggcatgaacccagcaggcggagcttgcagtgagctgagatcacaccactgcactccagcctgggcgacagagtgagactcagtctcaaaaaaaaaaaaaaaaaaaaaaaaaaaaatcacaaacatccaagaagcaaagcactatgagtgaaagaagtggaaacaacaaataatagaattagacctaaagagactgttggaattattagatataaaatataaatgtgtatgtttttaattaagaagagatttgattgtaatattacggaataatacatgctaaaaaaatgaccagacagattggagaaagaaccagtagtccttctaggagtgaaaaaaaaacaattcaaagtataaacttaatggatgctttactggtagatgagatatagctaaagagaaaattattgtggattggaagatagatttgaagaaaatatgcagaatatagaatggagaaaaaagagatagcatatgagaggactattaagatatagaggataggccgggtgtggtggctcacagctgtaatcccagcactttgggaagctgaggtgggagaatccccatctgtctgggcaacatagtgagaccctgcctctagaaaaacaaactaacttagctgggcatggtggtgcatgcatgactgtagtcctagccattcaggaggctgaggtgagagggttgtctgagcctgggaggttaaggccacggtgagttatgatcacatcactacactccagcctgggttgtctcaaaaaaaaaaaaatagagaatagatagagaagatacaacatttttctaatcagactttcagaaggagcttatagaatgagtagaggcactgttcaaagaaataatagctgggagtttacaggattaaacgtgaatttgcagagagcaaatacaagtacttgcatacaagtataaagaaattcttatgtagatacatcagagagaaactgatgaacatgagacagagaaatacctgaaaagcagtcaaagagaaaagacttatttataaaggaacaacaattagtttaacagtggactttacaacagcaaccctggaagccatgtaaagtggaataatatcttcaaaatgcccagagaaaataactgttaatctacacttgtatactcagcaaaactgttttccctaagtgtggcaaaaagacacttgttgttgttgttgttctttttgagacggagtcttgctctgtcttgttgttttttttgagacggagtcttgctctgtcacccaggctggagtgcagtggcacgatcttagctcactgtaacctccgcctcctgggttcaagtgattctcctgcctcagccccctgagtagctgggactacaggctcatgccaccatggctggctaatttttgtatttttagtagagatggggtttcaccatattagccaggccgatctcgaactcctgacctcatgatctgcccacctcggcctcccaaagtgttgggattacaggtgtgagccaccacgcccagccaacattttcaaacatacaaaagctgagtgagttttctaccaataggtcccctatgagaattttaaaagaagtagttttaggaagaaggaaaataatccctggagaattttccgagatgcaaaaagaattactgaacaaacagtctaaagcatactgactgtgtaaagctctggtcacgatgtctcatttgtggagttgaaaaaagaaaactgaaaaattggacaaaatagcatttaatttgggaggtgacaggagttagtttcctgaagtaatgttcctcaaagtttaacatgcacagtaatcttgaaatgtgtaaattaccaaactgattgaaaaaaggtgtgagaaacctacatagtcctataactgttaaagagattggtcagtaagcaaaaatcctcttgctgggaagacactcagtacagttttaagaatgagttctgccacacattcaaggcatagataattctgatcttccacaaactctttcagaaaacaggaaaagggggattatttcctccaactcattgtatgagtccagtgtaaccttgattccaaaaaacacactaggacagtataaagaaggcagattatcagcccattttatatatgtgaaatttttaatatcaaatttatatagtcaaaccttgtgtgtattttctttcaacacattgaatactttgactcattatctattatacatctgcactgagtagtttggttacaggccttgaagacaattctgtaaaggtaaggaaacagtttacctgtaatgttttacctttgtatttccattttgtgtgtgtgcactgttttataatggatcagttgtcagccatggagactgcttttcctttttgccagctgacagtgtagtctcttatgagaagatgggataactaagaaatgtcattgtaagtatatctgcctttaaaaaatcacagttttgatgactaaatggagtaggtggaagcttttattatgaatataataaaatctcaatttttattcaaaaattttaccactaatctttcagtttcattacctttttaagataaatttttttcagcactacttagaataataggaaagcctcatcagatgtcttcatgtgtcatgtaaggttttctttggaaatgaaactgaaaactcttctgatgaattaatttctatatatttaaactagaaaaaaatgctattcatcaaatatcttgaagactgtggaatatttgaatatcaaagatttactttttgacacttaaatacatctaatatgcataaaactcttttttactcagattgacttgcttctcttgaactatctggtttcctttggcctatcactaatcttgatcagttttctgagctagaaacttttaaataattttggattctttttggattcttctctatctattttgacctctttatctctcttctttttttttttttttttttgagatggagtctcactctgtcacccaggctgaagttcagtggtgtgatctcagctcactgcaacctctgcctcccaagttcaagctattttcctgcctcagcctcccgagtaactgggattacaaatgtgcaccaccatgcccggataatttttgtatttttagtagagacagggtttcaccatgttagccaggctggtctcaaactcctgacctcaagtgacccacctgcctcggccttccaaagtgttgggattacaggtatcagctgctgcgcccagcccagcctctttacttctattttctcacaaagtcctataattttccccttaaagtgatccttggatttaccttttctgggcctaagaacggaaagtgccatcactcattttaccttatgcatggattctttcaaggggtgtcttaacctgtctgcctttctgtaggctctcttccatttgtgcattttaatatcatatgctgttatacgtaatatacagtcttgctaaaatacaacattttcgtgcagtttttctatttaagaacatatactgcattttttcccatttaactattcaagcccaaattcttgccttgctttcagtttcccctgtcttttttcgcccagcttaccctgatattctgcctactttctatttttttccccaacttttattttaggtttgggggtacatgttcaggtttgttacctgaataaattgcctgtcgctggtgtttggtgtaaaaatgattttgtcacctaggtagtgagcatagtaccctatatgtagtttttcaaccatcacccttctcctaccctctcccctcaagtaggccctagtatctattctttccatttttatttccatgtgtactcaatatttagctcccacttataagtgagatcattttcttttcctacatcagtttgcttaggaaaatggtctccagctgtatccgtgttgctgcaaaggacatgatttcattttttaaaatggctgcatagtattctgtggtgtacatgtaccatattttctttatccagtccaccattgatgggcgtctaggttgattccatgtctttgctattttgaatagtgctgcagtgaacatgcaatgaacatatgagtacatatgtctttttggtagaatgatttatattcctttgtgtatatacccagtaatgggatttctgggttgagtggtatttctgttttaagttctttgaaaaatttcaactgctttccacagtggctgatgtaatttacattcccactagcagtgtataaacattttgttttctccacaacctcaccagtatctgttattttttggcttttgaataatagcccttctgactggtgtgagatggtatctcattgtggtttttatttgcgtttctctgatgattagtgatgttgaacattttttcatatgcttgttggcaatgtgtatgttttcttttgagaaggatctattcatatcctttgcccattttttaatgggatcgtttgttttttgcttgttgatttgtccgcctactttctagtccactttattttccttcacttgcctacaattatgtgtacttttccaccctctgatgccctgccttatcttgtccccccattggtagtgctcatctttttttccacctgtccaaatcctgcccaaattgctttattctctgaattgttgcactgagagccctccatagagagcatagcactgacttgttctctgaattttccttcacatctgcaatctttcctctggattgtaagctcttacgatcatccctgtatatttttccaaccctgttgccctgtccccctacctgcccataatccagcattgtgtgaagtataataatagtctatcaagtatgtcatttatgctgttgtctttagcattattcttcagattgatacccaaaagcccaggaaatatctttggctcatcttttagaatttgtttgatgatgaaattttgggttattttggggaataatgattatatttttatttcttttttaatctctctgctgccttccttttgaccattttgccttctttgagatatctgtccaagtatgggagaagaaaatgtttaaatgtacctgtgggtgtgcattatcagtaattctaataatgaagtgcagcatgaaggtctcagctaaagactttagtattctctgaattttctttttttatcataaatggtcatgtactttgaagagctgatgtcttgtcttaccatgacaaaaaggaaaaaagaaaaattttgccatgtaagagtaaaggatgcagccaagttgattcactcttctggttttggtgctttcacacggttgtagagtacttgagtatcgaggatgacgtagaagactcaagtttgcatcttgacactcttgttgtttacttgagtttcttgagttaatcatatgaactctgtgagcccaagtccctttggcataagttattataataatacctatctcacaatgttgttataagtttaatgagataatggatatgaattgccaattactagataaccatgggttatggttattgaacagggaactccattgtaaagctgtaacctaaattgaaaaaacaaaattatttaggacttactcataagaagagattatttatttattattttatatagtcacttactttattagcatctctgggagtaatttcaactaaagtgatatttttaataaaaatttaacaagtgagaaaatacctcataaatgagatgttgctaattgcaattttgttagcatttacaagaagttgatttgtatgttaccttaagcataacatgtcaaatggaaagattatatttctttgttatttatttatttatttatttttttgagatggagtcttgctctgttgcacagactggagtgcagtggcatgatctcagctcactgcaacctccgcctcccggattcaagcaatgctcctgcctcagcctcctgagtagctaggattacagacgcccgccaccatgcctggctaatttttgtatttttagtagagacggcgtttcaccaagttggccaggctggtctcacctgacctcaggtgatgcacccgcctcggcctcccaaagtgctgggattacaggtgtgagccaccatgcccagcctcttatttgtatcaaacaaatgtattcaagcatcttagattctgaaccatcttagtgtagtataggttaacattcctctcctaagatatacatgatatgagtaataaaatgttttgattgcctgacacataataaatgctatgtaagttttagctattttgtttttcagttttagctattattggggaagctgaaagggaatgtagttcagcttctaaaagagctgatgtaatacattaccaagctttcagcttagctttatacataagtgaatgtcatttcttaatgagtattttttgtaaagcctaaaatgtgtcctgcagtaaatagagaaataacaaccaccaaaggtcttcctggtttcaggccttgctgatgcatttatttccattctagagccagaatgatttttctgatgggcaaatttgattatgtcgcttctcaatttaaaacctttcagttcattcccgttggtcttgggattcattcattcatttgtatttaccaagaggcagacactgttctgggtgctggagataagagtagtgagtattaagtatgtatatgttatacacacacacacaccatacaacatagaaccttgtaaatggaatagtatggagctggtcttcatgtaatgcagagttatttgtgagtttatgaaaccttggagtgagtgctggcaaagtatagaaattcagagggccttgcttatgatagtgtctaatgagcagtaaccatttgtgtctaccttggtccctggtgtcctctttaagaagttcactttttccttatgtggatatcctttgttgttgttgttgttgttgttgttgttgctgctgctgctgtcatctaatcaacagcagatcttgtaagtttgctctgtggaaatactgtttttccagttgaggcggtctttgggctgctttccccagccttcagtgccatcttgaaatgtaatttgtgatatttctttactcattggtcccagactctatgaatattcctgataagatagctttttttccctccaatcttttttttactacagatttagagtaacacatttcatttattaaatgagacatacttgtttctcatgggtaatttgttactagaggatgctgtaaattgcactaggcaacttaaagacattgctactttttgatgacatgatagagggaaaaatactttggttgagtcatttaaaagagtgttttaaaaagtatgatgacttagtcatcatttgtcattttattcttttaagtgtttggaaagtatccgtattaaaataatacctttaaaagcatgtattcattaaattgtcaaaattgtcattcaaaaaatttataattttgcatttgtgtatgtgtatacccactataccttatgcttcagtgtaagcctacaatgtttatgtaagtcttagaggttaaatgtttgtgatgttttatgccataataaaaagatgattccatatgaaggtgtcaaatgacattgtctctctagtgtaaatacaattttatttattattgatactatgttaggtcatgttagctagaagcagatcccgggacatggatttggatttatgtgatttactgcaggagcactctcaggagaacaagagtgagggaaggagggtggtcaggagactagcctaaacaggcatgtggtctaagcagtggtctggattcagcctggactcatgggaagttttggagcaagagcaaagaggcaggcctttcatacctgtgttagtcattggctgcaggctgcttgagtgagggtggagtagagaatgatggcatgtaaccttccaggtgtggtggcccctgtctacctgaggcctttctccagcagccaacactcacagcagctggagaatagatgcaccggcctgtaaaggggacctggcagaacaccatcagcacccactacaggtggtcattaactccagcagttaagacatcactatttagttaggcaaacagcttgtcttttgagatataaatagagaattatttatgaatatgcatcttagtcttcttttgattcttattttaacgtattttttttttttagtaagatgctctggtaatcatgtttaccagattgaaataagcacacctggaggcatagctagtgtggtggatgaccaagtcaccatttcacaagattccagtaatctggaaagattaattttaggagtgattaatatgattcttcagttagtagaaattctctcgtatgacacagttggtatgtgtaggtaattttaaaaagttggttcaagtgtgaatcatttaaaaatcattatatattttttgaacattttttacttaaaatgtataagagtacttcacttgtgaatctttggatgtaagcacaggactctgaatgtaggttaataaacagtttattttgcataaaccacggttgaatccatcatctaaaaataacagtttcaggttctttagagtgagaactagccagattttaagtagtctgaatactccccctagccttttatagttgtttcactcacacctaatttttcagcagttcctttctttaaagtgttttgcttttatctagtcctttcaaagcattcatcctcatttttctctttggcatgcacatttcagtggttcatgtaatatttaatgaatttacataataagaataacagatacaacaagtagaaataggcaaagcaacaagtatcagtgactggcatggaactgcatgggtgcagaaatacacatgtaaactagtcatagattgtcagtgtgcagtgggtgttttcagagggaaaggggagtataagactaagttggtcttaggagctggctaagtataagtcacttaagagcatttctactgtattttttaagtggtagttcaagttcaatagttaataagtttgttatgaacccaaagtgcagcatggctagtaaacattctattcaaggtataattttaagctgcattaacaaaagtttgagtgaaagaaaacattgctctcaccttggttgagccattcaggtcctagtgagaacagcatgtccaagttgagcacaacaaggaaggacataaagcaggggcctctgaacaatggctcttattcctggctcgtggttgccccttcagaataatgcatgtaaacgtgtacacacacaaaattttgcatgcatttaattatgttacattttaaattgattgtttttacaaattaaaaatattttctaacaaattaacctcataccattttaatgtaaaaattaaaggcggccgggcgcagtggctcacacctgtaatcccagcactttgggaggccgaggtgggcagatcacctgaggtaggtagttcgagaccagcctgactaacatggaaaaaccccatttctactaaaaatacaaaaaattagatgggcgtggtggcgcatgcgttgtaatcccagctacttgggaagctgaggtaggagaattgcttgaacccagaaggtggaggttgtggtgagccaagatcgtgccattgcactccagcctgggcaacaggagcaaaactccgtctcaaaaaaaaaaaaagattaaaggctacttatgaacatgtttaataaattcaaattttgcaaataaaatgaaagataagtttatgctcaagaagactgctttggcttggcttaaaaaataagttggaattgtgcagtggtttctgacatggcagcatggatgtcttcttgttttaaaactgtcagtcatttttaacttttctttattatagccataagtgcttaaaacctggttcacaataattgtggcaaatggaataagagccacacatttggaaaagcaagctgaaaagaaacctactccaaggaaccagaaatttttctatgacacttcctttggttcagtatatattatttcttatcgtcaagccactgaaatcattatcagcaaagattgtcaacgttttgctgtctacatcaggtagaatagaattataaatccacatttcagtttgaacagaagcgaccttcataagatgtctgcagtgttcttccaacctatagaaatgtatatccagctttggaaaaatttacatagttgatccagttctctcttctgaaatggctgtttagctaaaagagcacataggttttcagcagcattcaaaatggtgtctgtagggccatgaattgaaagatttacgtcattcatttggtctcaaatatcagccaagctaaatcagtaagtaatccttcctgtcatttgttcttagaatgtactttccctcagtctcaaaaagtagaacctctacctcaagttcagtcaaacactgcaggactagtcctctggaataccagtgaacttcatgatctcaggccgagtgtggtggctcacgcctgtaatcccagcactttgggaagccaaggcgggtggatcaccggaggtcaggagttcgagaccagcctggccaacatggtgaaacccccatctctactaaaaatacaaaaattagctgggtgtggtcgtgggcacctgtagtcccagctaatccggaggctgggatgggagaatcgcttgaacccaaaagggagaggttgcagtgagccaagatcatgccactgcactccggtctgggcgacagagcaagacttggtcagaaagaaagaaagaaagaaagaaagagagagagagagagagagagagagacagagagagagagagagagagagagagagaaagaaagaaagaaaggaaagaaagaaagtgtgtttagaacttcatgttctcttttgcttttcatttccccattcccctttcccgatgcccctttcccctccccttcccttcccttttctttccttcttcctttttctttttctttctccttttctttctctctctcttctttcttctttctccccctgagacagagttttgccctgttgcccaggctggagtgcaagtggcacgatctcagctctctgcaacttctgcctcctgggttccagcaattctcccacttaagcctcctaagtagctgggaccacaggcatgccccaccacacccacataatttttgtgttctttgtagagacggggtctccctatgttgcctaggtttgtcttaaactcctgggctcaagtgatttgcctgcctctgcttctcaaatttctgagattttaacatgagccactgtgcccatactttgctcatatttttttctttctttcttttttttttttttttgagatggagtcctgctctgtcccccaggctggagtgaaatggcgcgaccttggctaactgcaacctttgcctcctgggttaaagcgattctcctgccttagcctcctgtgtagctgggattccaggcacccgccaccacgcccagctaattttttttttttttgagatggaatctcgctctgttgcccaggccggagtgcagtggcacgatcttggctcactgcaagctccacctcctgggttcatgccatcctcctgcgtcagcctcccgagcagctgggaccacaggtgcccaccacgacccctgcctaattttttgtatttttagtagagatggggtttcactgtgttagccaggatggtctccatctcctgacctcatgatctgcccgcctcggcctcccaaagtgctgggattacaggcgtgaaccaccgcgcctggccaacttttgtatttttagtagagacggggtttcaccatgttggtgaggctgatctcgaattcctgacctcaggtgatccgcccgctccggcctcccaaagtgctgggattagaggcgtgagccactgcgcccggcccccttgcttatatttcttaacagagtatcttgaaaagaccttggctctgatgtagttgataagattaacagcggtagacacgacttctgtgaggattgctaattgagcatttgatgccattgcatgttgatgcagaaattagagagtcatacctagtaaggcatgaaggtagtttctttaagcagctccatccaagcaggaagtactattgttttatcttttttttcttcctttggagacaggatcatgctctgtcacacaggctgtagtgcagtggtgcaatcatggctcactgctgtctcaaacttctagcctcaagtgatccttctatctcagacccccaaagtattggcattacaggcatgagccactgaacccagtccctattttgtttatctttttttttttttgccaaaggaattttcactgtggtagtctttgcagtttcttaaaattactttaaaaataagattactctaataatgtcagggcacacatagtgaatgaaaggcaggagttggctgcacttgcaggcagtcattcatccagttgcaaactaaaagaaaagaatattgccaccagttccagtttcaatggccgctcttaaaatattggagaacaaaaaggtggtctggaatagatagcattattcaacagaaggactactttactttctttctctgctctgagctataaaccagcttaaccaggtaaggtggcttctttaagttctctccagtatggaatgtgttttcttcccatttggcaatgtgataaacagctttatgggtgcttcaaaaacaaaactgtttggaggcaactatgttttagttacacagccttcttagaagtaagatcgttatctgaaatacttattgtttggaatgtcgtaaggcactccttgaatgttggtaataagcatccactggcacttaccatgtggtgaagcattgtagcttaaatgttaatcatggcaattataaaagtaaaaacaaaatatttgtgagcttcattatagtttttccctgacattgtctgatagatgaacacaattgcgttggcagagtacgtggtctttaattcatattattgggaaacttcttgatgttatcacatggcaaggatgattgcgtattatttgaccatatagattgtaacatagcaatcaggatgattttatattatttgatcatatatattgacatcctatgctacttcatgcatattttgagtgaaatacaatagtttttaaagtaacagaaagaaatcaaagaaaaaaatatttacaaccccacacaacatatcagtgggacctcctagtggtgagaggtctcggagtcatcttactttgagattggtttaaggaggaaagagtatggagattacatgatagtgcttttaaatatttaaaagattatcttatagaagaagagtgatactcttttttaagtccagaggatatagaaggacaaatgaaaattataaaatggcctgcttccagtcaatataaagaagattttctttcagactaagtttcactcttgttgcccaggctgcagtgcgatggcacgctctcggctcactgcaacctccatctcccaggttcaagcaattctcctgcctcagcctcccgaggagctgggattacaggcataggccaccatgctcggctaattttgtgttttcagtagagacagggtttctccatgttgatcaggctggtctcaaactcctgacctcaggtgatccacctgcctcagcctcccaaagtgctgggattacaggcctgagccaccacgcctggcaatataaggaagattttcaaacagagcctcccatcaataaaatgggccgttttgcaaaacttcctcctcttggaagagggagcactgggtccattcactgttaaaacacctaacttgcattgtgacttctatttaatctctggttccctatttatttgcctatgaggtcattcacttaagtgaagcaggtagaccacaggtaagactggcccaggagtcagactgaatggcaagtgtgatctaggacaagtgacccaactcttctatacttcagtttcttcatttataaaatggagataatagttctcacctccttataggaatgttgtaagaatcgaatgagtttatatcataagtgcctgacaagtactcagatgttaggttcgaacacccagcagcctgtgtgtcacatggtcaacacctatgttgcggacagatgtactaggaagaagctgaacagccatgtttggtgatcttgtggaaagaattcctggttttgagagcatagatggattccctaatttctaaaaaccatagtgctctggagttaggaacctgggataacaagaatttagagtaagtgccatgtgtatgtaaggaacacagaagtttcagggctgcttgtggaagactttaccttctcctgagtttatatagtggctttccctgttggaaggtgtagtgcataatattttctagcttcattttgttgcttctgaatagataaacatttttttatttgtataccctaatttgttaggttccaaaagttgtcatttcatcttgttgattcacttctgccttactaaggtctcaacctataattattggatttccgatgagctaatacacaaacctttgtgaactttttctgtgccctggaatgtgttcagtacgtttacagtactggttatattaagatccagaatgtctgattactagcgcttgtgaggaatcacttttttgttcatttatggttcagagtgtggtccctggagtcacactccttgcatttgaatcagttctgctgcttcttgcctcagtctttgggccagttctgtaactattctgaacacatttcctcatgggtgaagtagaattgctaaaagcaccagcttcactggctgttttgaggattaagtgaatcgatatgtttagtgcagagccgggcatcggcaagtccttaataaatgttggcgctccttctcaggattattagtctttcactgatctcttgcacattgtgtgttggtactaatccagttcccagagtactgaactgaataacatacggagtacaagagcccttcccttaaagctcccttcttctagtgggtggattacaatagaattaggtggtaaatgccatagagtgtgaatattgatctgggccagaattcaaactaactcaataatggtctgattaaagcatttaacagagagactggacttaaacatcccagaaagcatttgcctttttaaacagattaactgtagaggattgacaccttgtagggatgaagtgggggactcaccttttcattcccaaagtgtttttgtttttttgtcttcccttcttcctccctcttccttccacttcttcctgccttagcccacttctctaagaaaataaatgcagaggacctgctctgcccacaggcacagtgcccacatggccccaattcctccacctggaggaggggcaccacacgtaggatcatgcccaacagagtccttattatgaaaagtgtggcaaggttgacctagtaagctgtaaattactgcccagagatacaaaagggcttctgtcgtattgtatgcagtttaggatcttttcatgttttaagtctgaagatctcttttgttcatataatgtcagcttatgttgctttaggcttttttttataagtatagaggaataattgaggcatttgatttatatatatatgaaattcttattaagaactgccttcatttgtctacatcagtaataaatatatatatatctagaagttttatctgatgtctaaaatgtcctggttgttccagaattggattgtggttagttgaccgtaataacagctagttttctacagctaaaaatattgcggagagaataacagtaaaagagtaaaagcataattttgtcagcagtggctagatatgtaaacattaagggttagacctagaaatatatttggtataaaattgaagaaatctatcaaataactatttgaactggtaccaagggtactttttcctttaaagagtgtattttttgtgcattaaataaatttagttgcactaaattaccattttgcctgtgtagcattttaattctttttattttttcttttcattttcagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttaggtaagtgtcagttgttatcagactttttatgaaaacacttttctttgggtcttaagttataatgtacttaaagggcaagatactatggacttagaagaagtgaaatattttgattctcattctttgtggtggcatctcctggaatatcatgcattgctctggatttgaggcctcccattatgccattatggaagaatttacctccttctattccacactcttttcttagtctttttttcttttctttttttgaggcagagtctggctctgtcacccaggctggagtgcagtggcacaatctcagctcattgcaacctccgcctcccaggttcaggtgattctccttcatcagcctcctgagtagctgggactacaggcatgcaccaccatgcccagctaatttttgtattttaagtagagatggggttttgccatattggccagcctgctctcgaactccagacctcaagtgatctgcccgccttggcctcccaaagtgctgggattacagctgtgaactgtcacttccagcctttcctttattaatgttaagaaacatttgaattgttaggggtatctacctccctgagcagtatgcttccattcaaatgtgaggaactgattggtgaagtgggccaatttctgctttaggagttctcagaatgaacaggtttaggctgacaaggggacggacgttcatggaaaccagtaatggagaaaaagaaaaaagaaagaaaagacttctgttcctagagatgctttgcattcctggtgaaaaacttgattagctactaatcagtcagccctttacactcccatttccaccctaggcactttctgaatccattcctttctcaaatagagctggacctttatatatgatctttgggaaagtcctcacacacattcccagactgctttgcagaaaagttccaccatcttctgttcccactagagaaatggcagtgcttctagtgttctaccatcgttgaagattttatctgttaccattttggtcccgtgcttgttttaatttgcatgtatgtgatataactctctcctagaattatggtaaggattaaatgagctagaatttcacatagtgctttgcaagtattagctatttcttgagtgcctacagtatgccagccattacactaggtgtattccataatatcactgacccacacaaaggcactgcaggatcccctcattagtgatgtccacattctggaagctgtatgtcctgaagttacgtatcttgtgtatgcttgaagattggagctcaagtctgaatcattccaatgtctgtcttctgtttccctaaattgctgcctgtattctttgattattggtaatacaaactggttttttaatatatatttggccattttattgagtgcttttatattagaaattatatttttattaatgatacctaagattgcattcaccttttgagccatgatgttacacttcatgctcattttgcaatgcttaccatcaattaacaattctaaatctttattcatgtaggacacactctcttctctcctcttaagagtccccattaatgttatcatttgcctattgttccagtgagtcaatataatttggcccttcattctgcctcctgtgtgtatctgctatgttattgatttttttgatatatatgtcttcagtatctacccacatgaacaacaagactgttgtaggtgacagagcattctaatacagcggtttcaaacatttttagtgcaggacccttccctcaaatgaacacacagaaattcaaatggaaaacaaatggaaaggagtagctctgcttgtatctgggcctaagggtaccaagccctaccggtttatttctgttctttaccctagaatttccaggaaagccttaggaagtccatgaggactgtttgagaaatgattatcttttcaagtttctcccttgacaataaactcataaaagttaaatcatgtgtctaaggttgtccgagtcagaagctggtaagaaaacaggttcctggactctgcaccattactctctagcctgcccccgccctttctgtctcctctctttttttttttttttttttctgttctcttaactatactcaatatgctttttaaaattatttaaaattgtaatttttttataaaacatgttaaatttagaagtaaatagataagagtgaaatattttgtattagactagaaaacagtagtccttaatcatgttgctttttcgttattggctctccattacttttggcctttgtcattggccctaaataaacaaatccaaaacaaaacaagaaaacccatttttttatgctaagtcaagaatggaacgtgaactggacaacatattcattccacagtgagtgaggcattgcatttagaaatcatgcccttctatcttctgttcacattaatttatttaacacaattattctttgtgcctgtttcagcagttgacttttaaagatgaaaacttttcaggaatttagaagaggaccatagactgttttaatggttcagttatttgtttgcagtgccctaatgcacactaggtcagtttcccaaatatcgtgctatacacttggtccctatattagtttgctagggctgggtggcttaaacaatagacatttattttctcacagtactggaggctggaagtccaagatcaatgtgccactagggttggtttctcccacggcctctttccttggcttgcagatggccactgtcttaccacctcttcacatgttgtccccctacgcatgtgtgcccctggtatctctttttgtgcccaaatttcttcttcctgtaaggacaccagtcagattgctttggggtccaccctaggggcctcattttaactccatttacagtcacattctaaggtactggaggctaggacttcaacataatgagttttgggaagatacagttcagcctgtaacagtcccaaaaggtttattggttgactgactttatccagctttttgtgaggtattagcaagaacttacatgtctagctcttcaggaaccttgctaacagtttgtctgatgactaagtaaatactataaatctttttttttttaaatatgtgttttcttaaagttttattactgcaaaggcagtatatatgcatacagaaaatacaggacagcaaaaataagaaaataaaaacttattttcactacccagcatgaaccttattatatacccctctgttatcagtatatattcttctaggtctttttgtctgtatgtctatctgtgtgttttatcaaaatgagtttgtcccgtatatgatttgtaagcagatctttccgttaatgatatctacctttcccagctaataaattttcatttaaaacccagttgtacaagttatttattgctgtataacaaaccacctaaaatttcatagcttaaacaatgatttattttctcatgatcccatgggttggctgagcagttctctaatggttagcctgggctcactcacctggtgttcagatggagagttggctgggctgtgaggtccaagatggtttcattctcatgtctggtaattggtgctagctgttagctgggccacctcttttctcctccatatggcctctcatcctccagtacagtagatcagctttttcatagcatggtagtatcagggcagctagcaactactgccaagagggcaaaagtggaagctgcagggcctcctgagcctggacactggaactcacatagcttcactgtcaacacaagaccagcctggattcacgggatgcagaaatagacttcacctcttgaagaggggaactagaaagaattcatggccatttgtcacacaagtccattttcatattttactaattgtaacataattatgctttacagctgtttgtccaatccaggaatgctcacttggttgtgtccttatagtatcttttaacttattcctgcctctgctgaattctagtagtaattgggaagctagatctaaagtctcaataggttaaacttaaacgttttgagctggaatacaccataaatgatgttatgtatttcatgttatatcacgttaggagaaacctattatccgatttttcccaattagtgattctaagattagattacatagtgacagcctgatcccttcatcataaggttatattttttctcctagaagtgaaaatattctgtgtggtgtttggacactattttttttttttttttttttttgagatggagtctcactctgtcaccttgactgtagtgcagtggtgcaatcttggcccactgcagcctccacctcctgggttcaagtgattctcatgcctcagcctcccgagtagctgggattataggcacctgccaccacacctggctaatttttgtatttttagtagagacggggtttcactgtgttggccaggctggtcttgaactcctgaccctcaggtgatccgcacgccttggcctcccaaagtgctgggattacaggcgtgaaccaccacgcccgccctgatactggttttaacataatataacgtggttgtaatgtaacataacatatgaacaccatataattcataaagcttttccttgttcttttttttattcctgcacagtccttcgttccattccattgtatacttaactggttccctgtgaagggatccttgggttattgtttattatcttttcttatgaggatgcttcagggataacttgcacgtatgtcattttctacttgtttgggggaaaaaacctgtaggcttgatgaagggagattgctgggtctgtgttttcaccatctcttcttttttttttttcgagatggagtctcgctctgttgcccaggctggagcgcagtgatgttgatctcggctcactgcaacctctgcctcctgggttcaagtgattctcctgactcagcctcctgagtagctgggactacagatgcatgccaccacacctggctaatttttgtattttttcagtagagacagggtttcaccatgttggctaggctggtctccaactcctgacctcaagtgatctgcccacctcggcctccaaaagtgctgggatgacaggcatgggccaccacacccatccttttttgccatctctaattttgccaaatacacttccatagaagttgtaccattttacattcccatcagcattgtttgagagtgcctgtttctccacagaacgtattctcaaacttctgggcatttgcctgtctcataggtgagtagtagtgtctcattgtagagttaattttctttttttctttactgaatgaggccgaacatcttttcacatgcttaaaaagccatatgtattttttctgagaattatctatttgtaccctttgcctctttttttcctctcaatttctaggagctcataaagtaattaatcatttctggtatgcattgtaaatactttcccgtttcccatgtatttttttgagtttggttatgatgcatttaccatgcaaaaatttatgtatagtaaaatttatttttaaaattatttttatggcttgtgattttgagtcatagtcagaagacctcctctactcctctactgagtttataaaggaattaactgatgtcttcttccagtacttgcatggttttattttttgcatagagaacttggatccatgtggatggcgtatgacatgaaataaggatccaacttaatctttttcaaatagctaattttcccaacactgtttagttaaaagtccacatttacattgagttgaggtgcttcctttttcctctatgaaattctcatatatgtttgggtctatttgatttttttctgtttggtttgttaagtcatgtaccagtactatactgttttaatttatcaaggttttacaatgtattttaattcttggtaaggttagttgccctctgcccctgatctttcattgcctttatttttcagagctttttggaggactcttcctgttggtttatttttcagcatgaactttagaatcacattgtctggttttggggggaaaaaccgtaaggtattttcactggaattgctgtaaattaaaaaattaatttagggagacttgacatttttatgatattggttattccaattcaagaacatggtatgtttgctgatgttgaaatccttctaagaccttcaggtgtgttttagcatttacttcctagccatgtttcttaactgaatcttagatattctgtcatctgttgcttttgtaaatggggtcttctcttccaccataccttctagctgaaagctattacttttatatattagttctatatcctgctatcttactacattttcctaccttcccacattgctcatgtcttgcccagttccttcttagcctgccctgaaccatgttgtttggtgtatatgggttttctttctctcagttttgctgaaggagtaggtcatggaggtttacagcttttcttgctgtttttaaagatgttttaggagcagatgtggagattcatgtctaggctgccatcatgtgcctactagtatttatggctcactgtagacttcttgatggggcttgttccattgggattaaattcgccttgtttgcacaggcttctccaaatgataagattattacaatgttagtattatcttgccatttgcttacctgtgacattttgcttttagtaaccagatacggaatagactagcatttctacttgaactgagtatgtgtgattgtttcctacaatatgctgtatttactggtagttgccttctctttatttatattgtatctgtcatcttgtaaatcaggcatcaggactttgaccagtgaagggctagatggtaaatattttaggctttgcaagccttaaggtctctttgaccataggcagtagtgaataaataggcatggtagggttccaataatttttttttctttttgagatggagttcactgtcgcctaggctggagtgcagtggcgtgatctcggctcattgcaacctctcccttccaggttcaagcgattctcctgcctcagcctcccgagtagctgggtttacaggcatgtgccacctcacctggctaatttctgtatttttagtagggacagggtttcaccatgctggccaggctggtcttgaactcctggcatcggtaatctgcttgccctggcctcccaaagtgctgggattccaggcatgagccaccgtgcctggcccaagttccaataaaattttatttacaaaaatggtggtggaccagatttggcctctggtctgtaatttgttgacccctgctttaaagttatctattgttaagtcacatttctggttttttttttttaattctacaacattaatatcttttaagcctctgatttatagctaatgatattggatttggtggatttttccctttatatttcttttacttttcccaaatcttgtaacgtggagatcatgtctccttttataactttttctgtacctgtgcatggttacaacaagagatataaaaatatttttatctgttctctctctcttaaaactcatatttatttcaactaacactgagagggaattctatgtggaaaataatctgtaaaaataatttttcttttgatgttttctggtttctgttagtggtgattttgttgaaacaccagctgatctatgactgtaataaattgttacattaatcagaattcacaagatgttaaataagcaaatcaccaaagtgtttgtaaaggtaatgccaaggatcattcccaataatgaatgccatcccagccttgtagacagttttgtgatcatgagtcattctttcaatggagttaagaggtatttaaaaattaaagtttcacttttgagtattggtttcatctcaataattgtaagggtgagcaataattgtaattgctgagatggtaacagaatggttcatgatatattacagtcactagtatgacgaaacagacagtaactgaaaacacttccttgctttgaagtaaatatgactaattcacaagattgataagatgttcttagtcagaactttgtaatgattttgataagctgaaatgcatttatagagtgtactattagaatgttgagctaaaaccaaacaaaaataaactgagatggttttggcatgacattaaaaagaaatgactttcaggtttgtgtggcatgtcacgttaagactatattttagatagaagataagaaaagggagctatcaagagagatttgggtggtccagaggagaaagagtaggtagaaatgagaacaggaggtatgggagttcatggaagtgaagcatatcagaaggaagaggaaaatttgtaggaaaaaaaataaaaagaagaccaagtaacagtgcagagagagagagaaaaaaagagagaagtggtctgaatcatagggggcatgtgggaattaataacagctctttggaaggtgccaccatttaagaagaaatatgagagagagaaattctaagtaggagaatttgaaatagaaagcttagatgtctagaggtcagccagagtattactggaaataagtaggtgtttgggtgtttggagagtgaaagcagaacagaatctttccttgaaagcaggagatgtaggatttctgttaactctacgacttcccctcctacaagctgacttccatgcaattgcacgagcaagacatagccttaaaataagcttgctagccctttctgtggttatccttttgcatcttaaatggaaaatgggctatttaggctgtagtttttagtaatactttaaagcttatgtaacccaatgtctctgtgaatttcactttctccatctgctaataaaagtgtatgaactgcagaacaatggagagatttctgagttcaacattaagtcaaatcagatgtgcaaagacgagcagcctgaaactgtgcaacagtatgtacttagaaagtcagaattttgatggagagcacgtgctgttttaccctaacgttaattccataaggtattaattgtcagaatgatatgagttgcttaagaatcttggaaattttgtagagatcttcagttcaaattctcagaattaatttactgttttaagaaacaaatttactggtttaaaggctatttttctctcctccattctctacctgcctttccatatacatacaaacacacatacacacacacggcttgctattctgaatccaagaaggaaatattatttcataataacaaagtgaaatctacttgctactgttaaatatctgcataaattatgtgtcattgaaatgaaatataaattgttttcctaatatgaaagatgtgtgacctaaattaaagggctattattctgctaaaataaaaagattgttttggttattaactgtgtgatcttgaacaagacacttaagttataagcatgatctacaagttgctaatatatcagttgtctttttctgcataactaacccaaaattcagtgggttaacataaccatttttgaggggctcaatttgggctgatccatagaggcagtttttgtgctattttgctgcctttgaaacactcttttcctttttgccctttgcaaagggcataaagttaagtaatatgaggactgaaaagtattcattgactctagtaacaagaggttatttttagctttaagttatggtgttatcatggaggtagaagttgtactgtagtatgttaaggaatgaatagaggctgtggtagactgaataatgtcctcccagagatgcccacattctaatcccccaggacctgtcagtatgttgagctacatggtaaagaagaattaagattacagatgaaattaagaccactaatcagctgactctaaaattgagagattattctgaattatctggtgtggggccaatgtaaccacaagggtccttacacaataggaagagggagggagggaggagagaggagggtgagagggagatgtgtctacagagaaggtcaggtgatgcaatgtgagaagtgactcagctgccatagctgccttttaggatgagggaagggaccagaagccaaggaatgtgggtggcctgtatctagaagctagaaaaggccaggaaacagatttttccctggagccccagaagaaacgcagtcctgctgacaccttgattttagtccagtgatgtccatgtcagacttcgagtgtacaaaattataaaataataaattcatagtgtttacgccactaagtctgtggtaacttcctatagcagcaatatgaagggaacagtgggtaaggagcatcagccatgtagaccacgctttaaagaagtttggcagtaaaataaagaagaaagacaagatgggacacgtgggatttagggaggatggtagtgtgttttaaaatgggagaaattttatgtttttgaattttcacattatttgtgtgatttctgtgttatttttatgcttcttagagacacagtatcagagtgcttcatctggcattccaaataccagaacataaaaatctttaaaagcaagttaattgcacttgaataaaaaccagatatctctgcaattttaaaacttaggattgcactgaaatatcagttatataagaaaatctctctttagcttaatactaagtaattagaccctggtagtactttatggaaatatatgttaaacattcataagtcttaaaattatgaccacattgagtatgtaagtcagggcacaataaatttgatttttatatttaagtcattataattaagcttgacagtatttttcaagtctataaattgtaactgatgcctgtaaataataataggagctattagttattatttaacaaatgcctactgtatgcctggctcataatcctcagtagctcatttaatcctcatgacaatcttatgtggaagttagaattatttatattaatattttgcagttatagaatattagtcatcctacatataaagaagaccatttaagaaatacaaaggaattaagatataatcatttacatgacatttcttttaatcaagaaacaaatcattggcacaaggatcatataaggtattccattgtatggactgtaagtcaatttcaatgggatgataaatgttttttggaagggtcacattaatgaaatttgcctgacagcttctgagaacatgtattagagttagccctacctatttatttttaattattgtcataaagatggactattgatagttttcttttgttcttcagttgtaaacagaataagtctgaagacttatcctgaatttatctcttggaagagctcagaacttgagacatgcccatcaagaaagatgttcttactgttattaccagttcccttttgctttctctcttcttttctatttctttctactctttatcaatgctgaaacttaagatgaagaatctaccttaatacttatgtggctacggcagttagttactgcaatattacatgtttactcattccttgcaactagtattagtgccttgtattcgatagggctagaccctgtgcctggcagagagaaaattgtccttggactttagtctgcctctttggtgccagatcccaacttgactttctggcagaatacatgtaaattagcttttagaataaaatgtacaatatgtaaataaagaggtatgactccgttggtacactgtactctctaaagcttaattttgtatgtgcctactattttagaagctttggagatattttttatgtctttaggaattttgtgttcttccccctactcaaacatctcttcatcttcctctactaacagaaagggttagtattctatgagtaactgtgtgcataaactcctgaaatgctttatttatcctttcctctaaagtaaaaccttctgtttttggaggatgttgcttctctagcagcccctgtcacagaagaccaccttcctgtactcaacaacatgatgatagttaaacatcattttaaaaaatcatttctcaacagagtcttgtttttcaaagagcttttctaagccacttccctcaattctgtagctaattgactcccaggacacatatctgcgtttccagtgacattcatcagacgtagtttccctttcctccagtttcctcccatcactttctacaactttagtaccagtattgataaccagttcaataccatgccaaacctctttcacttcttttgcttcatttacaagtatagctgcacattaggccttatcagtcaaaccagttgcacctctaagacctcaaagtctttaaccataatcttccatcattttcctttctcatactccccgagcattttttaaatcccctctgagccctaccttcttttgagcctttcctattctcctacttcctttgggttccatctgcacccttactaacctagaatctgccttggctggcacactggcattgcttgccctcttcaccttcctccttgcctgacattgcagtcactttgattattctctgaacttgtcttcccaatactagattgctaagctttcctcgtgtgtcaacaaaatgtgtcacctgggtctggcatgaaacccatgctgtcagtctcagcagagcttcacaggttagtgagcattttacccctctctcgtgaactgcatgtgaactttcccagcctcttattacttctcaaacccacaatcccattactgtcttcctctctgtctgagatgatcaggtccagttgctacaagctctcaagttttcttcctttctcctttcttttgcaccttaaaatcctctgtatcttggaaatgcatgtcagattggcaaaaatttaaggtatttgatatgagaactttttttttgttgagacagagtctcgctctgtcgctcaggctgtagtgccatggtgcgatctcggctcactgcaatctccacctcccaggttcaagcctcagcctcccgagtacctgggattacaggtgcccatcaccacgcccagctgatttttgtatttgtagtagagactgggtttcaccctgttggccaggctggtctcgacctgacctcgtgatctgcctgccttacaaagtgctgggattacaggcatgagccacagcgcccagccgatacgagaactttttaagaggtatttactcactgttggtgggtgatataaatggcttcagcctttttttggaggtacttaccaaaaattggcaacagttatcaaaatttaatatgtatgtttgttgtgacttgccaatccaagtttgtttgtttgtttgtttgttttggttttttggtttttttttttttttttttttgagacagggtctcactctcttgccaaggctggagtgcagtggcactatcatggcccactgcagccttgacttcctgggctcaaatgatcttcctgcctcagcctcccaagtagctgggactataggtgcacaccaccactcctggctaaatttttttgtattttgcaaagtcagagcctcactatgttgcccaggctggttgtgaactcctgggctcaagtgatcctcccatctcagtctcccaaagtgctgtgattacagatgtgagccaccacatgcagcctcagcaatcaaattttaggaatccatcctaccaatttatgcctgcctaagtagataaaaaatatgtacaaggttgtttcttgtggcactattactagaatgagaatgtcagtacaaactaaggttgtctgtaggccagaaaatcctacacttctgtgctcacagtcaaaaagcattttagatgaaggtggcaaatatttttattgtaatatttatgttttgtagtacttatttgttatcagacactactcttggcatttttttatatattatttttttcagtctttgaaagcaacccttgaagaaatagattatcatctttgttttatagatgaggtatctgaggctcagggaataaaaaaaggcgcccaaggctacatagccggtatgtgcaggagccatgcgacttgattgctatacacagcttagccacatgtgttgccttctttgttttatcaggagaagcagcattatttttattatcagaaaattagaaatagtgctaatgtctattttttgacccctttcaatcctttccagtccgttttttacattaatatttgattagtcttcctacgacacagccatgattgggtcactccactgcttgacgtctctcagtgacttccatttacttgaagaggatatattctaaagtccattgtaaggctctcaaaacaatctgaccccagcctcagcttgtctttccctcccagtctcccactactgtgctctgatacctgtgcaccagccaagccaaataatctactcctcggtgaacatgtatttttctctgtttcacttaagtagtaacttggctcaactctgggttgctgggtttcaatatatcctagctgcaggatcctaggcaagtcgcctaatctctctgatactctgctatcccatttacctggagttgattggcttaaatggaatgatctatgtaaagtgtgtcgtatcgcccctggcagatagtgatccatgagtggtggtgatattaaaataaagccttgaaaagtacaagatgaaactagaacatcttgttatgctagaaagtaagaaagtgcaataaattgggggcgaagggaaagctcttccttatgggagaatgccaactaacatagaggaatgatggagttggaaaatcatcacttgatgctaaaatgagtgggtgacatgaggaggaggagatttttacatagtctcaattcctctccctaaaatttaccagttaattataaagggaaacatagtaacttcatagtggagaaacgtggcaaactccactttagtgactccacattaatgatgttctcaaagttaacaccaatgttgggtaaactaacatccgtgcttcctgagatgtcgtagtgagggtaacatcattttattgctattccttccaagaatacataacctgcatcatgagaaaacaaaagataaaacccagattcagagttagtccacaaaatatcaggtctgtcctcttcaaagataccaagaaagaaagaccatggattccagactaaagagatgtgatttctaatgcgttgtatgaaattgaactagaaattggactggaaaaaagtagccacaaagagcattattggggtaaatggccaaatttgaatagggaatgcaaattaggaaatggtatttttatcgtggttaatggctctgatatttacaattatactgtggttatatgcaggaatgtcctagttcttaggaaatgtacactgaaatgtttaggagtagaggagcacgatatctccaacgtattctcagctggttcaggaaaaatatgcacatatatgaaaacagaaagaatgctaaagcaaattaaacaaaatgtaaacaattagtgaattttcataatgagcatatagggattctttgtattgttcttacaattttggaatcgtgccaaaattttgtactacgttaaaggtacagtacttttttcgagaaaaccgcccagggttcatactgcactccagcctaggcaacagagcgagaccctatctcaaaaaaaaaaaaaatctaggccgggcatggtggctcactcctgcaatcccagcactttgggaggccaaggagggcagatcacctgaagtcaggagttcgagaccagccaggctaacatggcgaaaccctgtctctactaaaagtacaaaattttgcacctatagtcccagctacttgggaggctgaggcaggaggatcatttgagcccaggaagtcaaggctgcagtgagctgtgatagtgccactgcactccagcctgggcaagagagtgagactctgtctcaaaaaaaaaaactgtaccaagataagttttttgtaaaaaaaaacccttaggaaaaaattctttaatagggcttcatttaggagccactatgtacttcctagactaacaataataagaagtttcatgccactcttcaggcttcataatgtaagcccgtggaacacaaggggagagtataatttttccaaaacagtgtaatctgtgtttatagctttctgctgctcttggtccaaagtcataatatagtgtatcaagagagatgtattgatcatatgcattgtcctttatatgtattatttctaacaactgaacatttaatgatatttggtctgcagatactttgaggttctaatctctggcaagaaccatgaatgtagctcttctatgttgccaaattcagatcctctgccttaacagccaggtgggttaaaatgataacctcttaggaaaaattaaggaactttttgcaaggttgtagatattcctccattcaaggtacagtacttttttcgagaaaacagcccagggttcactactgcaagatgtaaattgctgtccttaagttctgtgccataaaatctatgagcgataattttagcttggcagtctaaaaaaagatttaaactgattgtttactgtagccattaaaaaaaaaatctcagtagacatagaatgtctacttttgattactgtgacattcagatgagccctccaaaatttaactggaaaaagcatgtaagactgcaaaattatataagatatatagaattattggttctaagtcatttaaatacttggaagctgtcttccaaagaatagttgatcttaaggcaatatttctgacaaaaattatcaagtccgactgcctgatgaggctgctcctcaaaagcagcgggaaagccaagttggaaaggggaaaagagcagctctaagacaacgtctaaacccactgtcttcagagtcagacacgttcatcatccttactctcccccttcataagatatacaactctggaaaattgacttaaccactctcagttttacttttctctggagattcctattttctccggggattatgtgattattttaatagtacctacttcatagcattatttattgggatgagattcatcatatctaactagaacaggcatgaaagaagtgcctaaaatctatagttgctattgttattctttggtctcagaagcagtgggctgtgttcagatacaaacttttaaggagggccacccaagtcattgttttacatccggattcttgtctgtcgggagccctttcccacttcccctgcctatctggttattacgctacttccgtacaaacgtcagtagccaggagtgtatacgaacagtaccacttagcccattttcattgtatgtccacagaggcaaaaagctgaaggagtatcaataaaaattgagcaatctcatgctatcttctgatagttttcttataataaagggaagaaaaacaatattggctttaaaaattcaagaatgctcaagcttacaattttttgtggaagaaatgacagagacttgagaaggaattttcagaaatctaatggatcataattttggcagaaaagttattcagggtagataagctggcatggatcaagagtccaccaggtagattggaccgtaaattctagcagtagacagttttcaagtgctttattctacctgagctatttaatatgtattttatatgaggaaatgtaatttatgcccagttgaaaaggggctggggatctaaaagctctggaggttttccttaggctataaagctgagaagactcctcctttcagatgtcagtgaggatctgggtggtcatgatatcactgaccactttgatgccactgctaactctagcccagaatccgccacattccttttgagagaataacaatttgaaaattcaactcaaatttaacgatatccctgatagtcttttacatattttgtcttatttgttgtttcgctgcctggctaagttgtttttactttcaggggcatgcccgagccctatcctaacagagttgatagatctcttgataaacaaagaggcgtaaagacatcagagatgcagttttagcacattctcggtagtcagagctcttgttgaaatgaaaatcccttgctccgtctcacttttcttaagctctgaaccccactggtccaaatgtgaatacaaagaatctctaggatagttaagccaagcaggggtaaaattcagggagaactaatccaaacgctgagagggagtgtggcactggtgggcatgctgggcatgatcaagttggtggtgtgggctctcagggcagagctatggcacctgttctcagaggtttcccatgtgctgtcagtacttgctggtttgtttgtaaataaacttgataggaacctttccattcaaatttataatgctgtctttaaggtgatgttccttaaatttttggctaacaactccttggcaaatctcacaaaagctgtggattctctcttctcagaagaatgcatgtaggcctacatatacccaaacagtttacataatttcaaggaattagcacgaagcgctttcaccatggttcatggaagctactcttaatgctctacaactggccacaagatggtggtggtgatgactaccatttatttagcttgtactattagtcaggcactcttcattcttcatatccaaaatgaactctggatagccccttccaaacctgttcttcccccatccttactcatctcaggtaacacccactccatctctttagttgctcagttatgctgagtccttatcactactactgttgtcaccttcctcctagccagtcatctcttgcattattaccttatttattattgcgagtgatctccctacttctaccctttctattctcaatacagtagccagagtcattgctcctattaaaatgaaagtcatatcacactactatcctactcagaactctgcagagtcttcccatttcattcacagtaaaagatgatggccagggcctctgtgctgcacagccgcaagggcaactgttcacatagatgacaatatgttgtgcagtagatgatgtacactacggctccagtaaaggtccataagccctgtacaatctgccccacccccctaattcagttacttctgtgacctcgactctcctactgcttctccctcattcactctgttctagccacttgatctcctttatgaccttcaaatacaccaggcctgcactgcctcaggatctttgtactggatgttacttctgcttggaacagtctttcctcaaatatgtgctcagctcatgttcttgcccttttaaagtcattgctcaaaagtcacctcgctgaggcctatactaaccatccttatttaaacacagtcctcatctctaccctagacctttgtatctatgctactttttccatagtaatcatgaccttccaactcattaataatatctaatttacttatttttttttcctgaatggaatgcaagcttcactaggatcctcactggaatgcaagcttcactaggttggagatttttgtctgttttttcaatgctgtgtgtgcagtgcctagaagagaggctgatacataataagagctcagatatctgttgaataaaatgaacaaaccttaggaagatatattcttttaaaacacagatttagattcagagagattaaacatcttgctcaaagtcacacaattgataaaaggtatagctaagatttttggactttctgacaccaaagatgtgcttatctactgcatcagtcttcctttctaaagataaaaatattcctttctaaggatatgcaaaatcagagatcaaaatgtagtccagaagtaggagtcttattctgtagattataatgcgttgctaagagaaatgaaagaaaactgattattggagatacaccatatttatgggttggaaaacgcaatatttaaaaaatgtcagttctcctaagttgaactatggatgcaaaattttccaaataaaaatccaagcagacttttttgtagagattggcaaactgactgtaaaattcctatgcaaatataaaggaactcaaatagccccatctaattctttattcattattattattattatcttgagacagggtttcactctgttgcccaggctggagtgcagtagcacagtcatggttcatggttcactgcagccttgacctcctgggctcaagcgatcctcctggctcagcctcctgagtaactggaactacatgcctggctatttttattttttatttttattttttttctagggatgaggtctggctgtgttgcctgggtttgtctcaaactcctggcctcaagctatccttctacctcggcctttccaagtgctgagatttcatgcatgagtcaccacacctgacctaaaactaagggtgcttttggaaaaaggaaaaaaaaaaaacaaaggaaattttggtggtaagcaatttaagaggaagccagtagctccattagagcaacaagcttaactctgtcgtatgtggacaactaagaagggtcctcctggggtcagaacaaactttaaacactgtcctcaaaagctactcctgcaaatgggcctgaatttattggactagaccatggagtaatttatgctccagagcattattgaaaacaaaatagcgaccagccagcaattagtgggtcctaacagctgggtgtaataccagcaagaggcagacagcctaacagatcagggaaagaaagtgcaaagagagccctgctagaaccattgttcgaatgcccaaggttctgctctctgaggagcaacattggaggcttcacactgcagataaaatactttactaaaatagtcaagccaagttattaaataaagaaaaaataactataaaaacaggctaggtgcagtggctcatgacggtaatcccagcactttgggaggccatgggaggcagatcacgagaggccagcagtttgagagcagcctggccaacatggcgaaaccctgtctctactaaaaatacaaaaattacccaggcatggtggtgtgcacctgtaattcctgctactgagaaggctgaggcgcaagaatcgcttgaacccaggaggcggaggttgcagtgagctgagtttgtgccactgtacttcagtgtgggtgacagagtgagactctgtctcaaaaaaacaaaacaaaacaaaaaacactgaaacaaaacaccagggttggggatggaagtagggggttggaatcagattataactcgaattcactgggaaaaaaaaaaaaaaaaaaaacagaaaaacagtaagtaggaaggctaatataacaaactacaagtatgtatttccccttctatcttgtctcagcttctttgaaagacaaaattatatatagtaatattaggttttcaacatatgtagttgtactgtatgttacaataatagcacaaaaggggaagagaatatagatatatagaattaatgtttctatatataaccagaagttggtataaacccaaagctgttatgataagttaatattgtatggcaagttgcagagcaaccactaagaaaataagtaaaaaaaaaaagtaaaatgagaaagtattaaaggaattaaaatgttgcactagaaaatattcagttaacaaaaaaaggataaagaaagactagactagaggaacaaaaaagatatgagatatatagaaaacaaaaaagtaaaattgcagatattatgttaataacaataaatgtgaatggattaaacattttaatcaaaaggcagagattgtcagactgggggagatctcactatgtgctgtttacaaaagatacactatcaaaggtacaaatagattaaagggaaaaatgattaaaaagataaactgtggaaacagcaaccacaagaaagctggagtgattatgctaatatcagacaaaacagatatttttaaatgctagtagagatttaaaaggacacttcctaatgataaaaaaaggccaatccatgaagattggttataaatatatatcattatccctcattatctgcagggaattggttccaggacaccctacggataaaaaaaaacttcagatgttcaagtttgttatattaaatgggataatatttgcatgtaacttatatgcatccccctgtatactttgtcatctctgtattacttctgatacttaatacagtgtaaatggtatataaatagttgttaaacggttttttctttgcattattttctattgttgtattgttacatttctgaatatttttgacccatggttggttgaatctgtggatgcagaacccacagagatcaagggcctaacaatatagagcctaacgtggatgtacctaacaacatagatccaaaatacataaagcaaaaactgaaagaaatggaggaagaaatagacaattcagcaataatatcccattctcaataatgcaaaaagattcagcaaggaaacagaagacccgaacaacacaataaaccacctaggcataatagacatctatagaactctaaatagtaattgcaggatatatatacagatgcaacattctctagggtagatcatatgccagcccatttttaaagaacttaattaatcttaaaacattaaaatcataaaaattatgtttcctctccacaatggaatgagaaaagaaatcaataacaaaaagaaatttgggatattcacaaccataggaaacaatgtactcctaaatatccaatatgtcaaagatgaaataagagaaataaaaaaatactttttgacagcctgggcaacaaagtgtgagaccccgtctccacaaaaaaataattttagccaggcatggtggcacacacctgtaatcctagctactcaggaaaatctcttgagctcagaagttagaagctgcagtaagctatgatcacaccactgcactgcagcctgggtgtcagagtgagaccttgtctctagatttaaaaaaagaaaattgtttcaataagagacaatgaagacactacatactaaaacttacagaatgaagctaaaattaaaaaagcaagaaacatttgaaatcagtaacccagtcttccaccttaagatacataaaaagaagcaaactcaaccaaaagcaaccagaaaggagggacataacaaagattagaaattagtcaaatatggaatatgaaaacaagagaaaatcaatgaaaccaaaagattattcttttgagatgatcaacaaattgacaaaccttgggtagactgaccaggaaaaaagaagactcaaattggcaaaatcaagaatgaaagaaaggacattactattgaccttacagaattagaaaggatcatcatgaacaactgtataccaacatacagttttgttatttatgttatttcatgttggataacttatatgaaataaagacattccaggaaagacacaaactactagaacttactcaagaaatacaacttctgaatagacaagtaaagaaattgaactattgctactgttaccaccaccaccaccactacccacaggcctagtacggtggctcatgcctgcaatcccagcacttggggaggctgaggcagctggatcacttgaggtcaggagttcaagaacagcctggctaacatggtgaaacctcctgtctactaaaaatacaaaaattaactgggcctggtgatgggcgcctgtaagcccagctacttgggatgctgaggcaggagaatcacttgaacccgggaggcggaggtttcagggagctgagatcatgccactgcactccagtctgggtgacagagggagactttctctcaaacaaaacaaaatgaaacaaaaaacaaacaaaactacacacaaagaaaagcccagccccagatggcttcactagtaaatgttaccaaacatttaaagaagaattaccagttcttcacaaactcttccaaaacatagaggagaaagaaacactaacttatcttatgaggccagtattatgccaataccaactgcagataaaaacatcacaagaataacgggggaacctgtccccaatatttcaatgtaggctctttctattttccataagtgttgactggctgagaaataaagagaaagagaacaaagagaggaattttacagctgagcctctgggggtgacatcacatatcggtaggaccgtgatgcccacctgagccttaaagccagcaagttttaaggatttcaaaaggggagggggtgttagaaaagggagtaggtcacaaagatcacatgcttcaaagggcaaaaaggagaacaaagatcacatgcttttgaggaaacaggacaagggcaaactcagaactactgataagggtctgtgttcagctgtgcatgtattgtcttgataaacatcttaaacaaaagaaaacagggtttgagagcagagaaccggtctgaccacaaatttaccagggtggagtttcccagtcctagtatgcctgagggtactgcaggagaccagggcgtatttcagtccttatctcaactgcataagacagacactcccagagtggccatttatagacctcaccccaggaatgcattccttccccagggtattaattactaatattccttgctaggaaaagaatttagcgatattgtccctacttgcacgtccgtttgtaggctctctgcaagaagaaaaatatggctctattttgcccaaccctgcaggcagtcagaccttatagttatcttcccttgttccttgaaaatcactgttattctgttctttttcaaggtgcactgatttcatattgttcaaacacacgttttacaatcaatttgtacagttaatacaaatatcatagtggtcctgaggtgatgtacatcctcatcttacaaagataacaggatcaagagattaagacacgtataagaaattataagagtattatttggaaactgataaatgtccagataaatgtccatgaaatcttcacaatttatgttcagagattgaagtaaaaacaggtgtaagaaattataaaagaattatttgggaactgatatatgtccatattaaaatgaaatcttcacagtttatgttcctctgccacggctccagctggtccctccattcggggtccctgatttctcgcaacatctctccctttctttttatataaatgtgccatggtgctgaaggcttgttcgttttcttggttttgacgcaggattctttgactggtccagcacactaaaaacaagccgattaaacagagaaacataattccaaaatttactacagtggagctccccatagacttaatccaagtcgtggggtttagtccagaaagactttgtgccacctgatctaacgcctcagctccaggcacaatggataaatgagcttgagagccttcaaaaatttgtttctttaatttagttatgtccaaggataaattatcttccctacccagaaggtgtcctttgaccatttcccattaatgatcagtcttgttgtaggaatatggtgtgatacagaaatcagaagtattccaatcgcactgcatttgcatgcgatgtttgagactcattagccgatccccaagccaaataacagactgtcttaaatcattaatttgattagccaatttttgatcaatgccttgttgagaattccacatttgggtggaattggcttgccaatcattaacaaaatgagctgtttgaatagattgatgtaatgccattctggcagtggtggccagtgtaatgactgtaattaggcccatgatcacagtgattaaagtgaaaacaaatctcttagatcttttgagaattcgttgtaacacttcattaattaaatgtactgagggggaagattcccaggtctgggtaaagttaccgatatccagattccttcttgaactcgaaccaacattgtacttttcctggagtcaaaacgggagttaatacaagtgtataaatgacaggtaatgcattggacagtttgattgtttgtccaaattttgatatttcccactaatagcatgtaaggaggcttaacacaactctatataggaagagtcaggttggaggtaaacaaagcataatgtttgaatgtacattgatagggagaggagcggcagtggcaatgcctgatgttctctcccgtaaagaagcaatccaaggtgcctggggatgccaaagaagtagaggggcatacctgggttgagaagaattatcataatgccaattgaagtcccataaaggggtattggcatcaaaaagaggaaaaggattcaaaggggatttatcttggtggtcagaatcacggatgtgaggggtggtagtggggacaacagacagaaaagtttccccttcccatactcgcagtccggacatggcaatagccaatttccaaaggtctgggtgttctgggctcagaatggggaatatcatacaaggcctctgggggtaatgcccttatcttcccattttaagggaaagaacgagcggaaccttctatgcaaaataggatgatgatccttgtcctcccagtaagaaataaaataagtagcctccatacattcccttctgccagaggagcaattgttttttgaatagccctttggtgcccagtctattattaaaccacgagtcattttttaatactactgcatgtaagttaacacagtcttcccaaattaaagttttagatgggcgctcaaaatttttaggacatggttttcctacaggttttttgttttttgtttttttgttgttgagatggagtctcactctgtcgcccaggctggagtgcagtggctcactgcaagctccacctcccaggttcacaccattctcctgcctcagcctcccaagtaactgggactacaggcacctgccaccatgtctggctaattttgttttgtatttttagtagagacggggtttcaccatgttagccaggatggtctcgatctcctgacctggtgacccgcccgcctcggcctcgcaaagtgctgggattacaggtgtgagccaccgcgcccagccttcctacaagtttatattgaaagtatggtgtatcaactacagaccattatctctctctctctctctttttttttttttttttttgagactgagtctctctctgtggcccaggctggagtgcagtgcagtgatcttggccaactgcaacctctgcctcccggttcaagcaattttcctgcctcagcctcccgagtagctgggattacaagtgtgcaccaccacgcctggctaattttgtatttttagtagagacagggtttcaccgtgttggccaggctagtctcaaacccatgacgtcaagtgatccgcctgcctcagcctcccaaagtgctgggattacaggcatgagacaccatggcaggcccagatcattatctcttatgaatataaatgcaaaattctcaacaactttctatcaaaccaaatccagtaacaaataaagataattacatgccatggccaagtggaatctatcacagtagtgcaagattggtttaccaaccaaaagtcaatcagtttaatatatcatatcagcaggataaagaacacaaagcatatgatcctcccaacagatgtagaaaaacagtatttgccaaaattcaactccttcataataacgctcaacaaagtaggaatggatgtgaacttcttaacctgataaaggcatctatggaaaaaccaagagccaacataatgcttaatggttaaagactgaatgctttccccctaatatcaggaacatggacagaatatccactttcccactttattcaacattgtaggcaagaaaaggaacaaaaggccttcagattggaaaggaagaagaaaaattcttatctaaagatgacatcttataaatagaaagtcctaaggaatctactcagaaactactcgaactaatatataagttcagcagaattgcagtatgtaagatcaacatacaaaaatcaaatatatttctatacatttggaataaacagtctgaaaatgaagtcaaaaccatttaggatcaacaggaataaaacatttgggaataaatttaacaaaagaagtacaaaaatgtatgctctgaaaactacaaaacattgctgaaagaatgaaagaagacctaaataaatggaaagccatcccccatgttcgtggattcaaggcagctatgctcaccactgcgtcatccatgcattcccaagttcatagagtttgctgtacaacttacaaagtatacaacccataactgccccctcaaaattaaataacttattttatgatgtcaagtctttaccttgggctgtcaagtcaatccatcccaaaagtaggaagtaggtcacttgatattttaggtatgtctccttagatttatagttactttttcgcaatctcccagtaaatggaaaataaagcactttgtcccaagtaacaataattcataagtagttattattcctgctttataaagaactgaagctcagagagacttaatttgcttaaggaaggacagctgtggagccattgtctagttcaggtccatcagttacaaagccctgtttgttttgactatgccatgttgcatttgaaacaggagtacattagattttttaaatagtagactggcctcttaagtttcagagtggttttgttcagagaccctgtttataatatattccagtattaagaatttgtgttcaattgttaataccataaatatctattttgtgcttactgcatgcaggcactatgatgagtaaatagtaatgaatatattaatccttactttagcagagaaagtaagtatgcaaataaacaattgcagtatagcaagataactgcagtgctggaagtcttaaataagaacagtgctaacatagaagaaagtaatcagctctactggagtggccatagaagatgagatgattgaattggacattcaaggctatgtaggagtttgtcacttgatatatgcgtgcttctttctgtgtcatgactaactatggaaagcatttatgcataaacataagtattgagtttttaagtaaaataaggtaggaaaaaagttcattattagtttgcaggaatcctgtgttcctttacacctttttaataattagctttgtgttcaggtataattaaaactccttggcaaaatacagaagcctgagaagggaaatgctttttgctgtcgtgtggtttgtaaaatgcattgcaaaacaactagctattagagttctttaattctgttgtatctgctttttggaatttaaagttaaatggacaaagtaaaagaaaaatttgtgagttcatgaacaatttcattcttttatcaaattgtggtaaactcaagtgaatatacttgggatatacgcttttcaaatttttcaggagaaaaagctttaaattgcatttgtgacttttctagttgtcagtggtttctcacacgcaaatcctgtgtgttaatgtgtcagtggttttttttgttgttgtgttttttggggtttttttgtttttttttttgagacagagtctcactctttcgcccaggctggagtgcggtggcgcgatctccgctcactgcaacctccgcctcccaggttcatgccattctcctgcctcagcctctcaagtagctgggactacaggcaactgccaccacgcccgattaatttttgtatttttagtagagatggggtttcaccgtgttagccaggttggtctcgatctcctgacctcgtgatccgcctgcctcggcctcccaaagtgctgagattacaggcgtgagccactgcgcccggctcagtgtttctgatgtaactacaatttaaagcttttttgcaacacttatttggtaaaaagtttattctataggattttgagcagtttctaacattaatttgtatagttgttacctaaaataatgaatgataaataagttctgcgtttatgaagaaatatcttattagagccatgtatcaacataactattttggttttttaaaaaattaaccagctcccctatttatgtcttaatgtagccttttggtcacctatttcattatcccccttgggataaatagagaaaattgacagggaaatggtaatcttctactttcagaatctttgatttgaccaagttgtaatacttatactattgggctaaataaaagggtgtctattacctaatatagatttttggaagtgcatgtagacaattctggaaaatagggtatctgtttacaggtgactggcaattattacaaatgaaaggatgggactttgtgttttgttttggttttggttattgcagtggctgatgttttggtactccagagtaggttaagtatgcattatatggttatggcagaggtttctgatatgctgtatttgagaaaacatatttaaatatatgcagattttagtaatagttttaatggcaatactctttgcaaactcatttgattatatttaaggtaatcattattttgcgaaactgtattgctatctgaatctagaactctatctacatgatactgtatgctaaattgtatatagcaatatattaaaatcagtgccttatggtgaatccaaagtgattaaaaggaaacactgcttttcatttatgaatgcatgtttaagaaagaaaaatgtatttcatttttagattatataaatggtggtgaactttttactcatctttctcaaagagagcgtttcacagagcatgaggtgcagatttatgttggagagattgtgcttgccctcgaacatctccacaaggtaagactcttcatttttcaggtttcttttctgaagtctgttaactaaggtaataatggagctggaagagctaatgtttttacatgttattgtcttagtggagattatgaaagcatacttatagaacattaccaattttctcaatttcataattccgtttgaaaaaatctactttccaattgtacttgctatgatagagattaaaaagaacctaagcaggttttggcttttatcctgaaaaatcctaatgcttatttgttacaaagtatcattataataaaagcttttaattgttaaaataaccaataaaatgaaaccatcagtcataatatgtatttccttcattgtaatttactgcattgcagactctgcctgtacatcttcagggtgtatcctgatgaggttggagagtaagagttatttcccactcgcactctggctttcttttccatttgttttgtccctgacaccgtctcttgctcccactccctctctcctccattgtccccaggtaggatgaactcttactaaaaaactttaaatggaattcatgtctgtgaccctatgcaaactgtaacaatcagtttaaactgtaagaaatgttattgcagataaccattaatcttgagccaagaaattttcactcggttttttgttttacttaatgaggaaacattgtagaagcagtcattatgtagactgggcttgtgtttttcctcagagacagaaagtactcaagtaatttttaaattaggacaattcaggtacatcatgaagccacccttccttgtcctgttatattcaggtcctacactagtttaagatagagattgaaatgctgattatggagcatagaaaagaaaggagagaattgaagggaaaaggaaggatgaaggatgacatttctaaaggggcaggcagcaaggtggaggtaacaggtgggtgaggccgtgagaataaattatggtaagatgtaagaaaaaaagagatcaggaaaagggcagatccagcccagagcagaaaccagacctgccaggtgaagggagatggttcaagggtaggaatcttagggagactgaatgaaaaacgtgtgagaacaagcagggaaagaaacctttggtaatggggggttgaggggcagggctgcagcacaatggagaggaaggggaacgaggtgcagtcaagtaggcactcaaactgaggtagcagaacagacacttggacttcttttcatggaattattgatatggtaacaagctttaagatgatttttgtgggatataagatagttaagacattttcatacaagaaactattggacccaagaatatgctgcaaagaaagacctttgaaatttatgatttagggcaattagtttataatataaaaatgatggtagaaatcatcataaatatgagtaagaaacaaaatgaatagctccagtgagtaagctaggaagtccagtgtagtggtgcaatcttggctcactgcagcctccaccttcccaggctcaggtgatcctctcgtgtcaatctcccgagtagctgggaccacaggaacgtgccaccacacctggctaagttttgtattttttatagagatgaggttttgccatattgcctaggttggtgttgaactagactcaagcaatctgcccgcctcagcctcccaaattacaggcatgagccactgtgcttgtccgaaaatccggtttttaatttatgtgaaacttgctgattgtcaaacacagaagtaaataaaacaatgaatgttggatataactgcaattgatatggaatgagagtaatatagtaaatgaactcttggttaaccttctcttaatcttactaccctaaaaagatacagataaatataacgcaaagccagcaatgttaatcttgataaagctactaacattgagtttcacaggaagaggcaaaaatggatgtttacttgcaagtgatgaggtgacgcagatagtaaattatttgtttctaaaatcttttctaaagaggttgttttttaggaaaaagcatctcctggttgttagatgcatataatgctccaagtcaatgtctgttcaatataagctctagacattttccttcctgtctgtcttgtagaacactggggctcttaaaggaaaattgcctagtacttttgtgttctgttgtgttgtgttgatacagggtcttactctgttgcccaggctggagtgcagtggcacgatcacagctcactgcagcctcaacctgcttgactgaggtgatcctcctacctcagcctcctgagtagctgggacaacaggcatgcgcaaccacacctggctaatttttgtaatttttgtagagacagggttttgccatgttgcccaggctagtttcaaactcctgagctcagatgatcctcccatcttggcttcccaaactgctggaattacaggcatgggccacccacacttgtccgttttttattctgttcttttaaaaaaaaaaaaatagagacattgggtctaaaaatagacatatggtctcgctctgttgcccaggctggaatgctatcataggttgctgtggccccaaacaccctgagctcaagtgatcctcctgcctcagcttcccgagtagctctaggactacatgtgtgccaccacacccagctaattttttttttttttgagatggagttttgctcttgttgcccaggctggagtgcagtggcacgatctcagctcaccgtaacctccacctcccgggttcaagtgattctcctgcctcagcctcccgagtagctgggattacaggcatgtgccaccacgcccggctaattttgtatttttagtagagtcggggtttctccatgttggtcaggctggtctcgaactcttgacctcaggtgatctgcccacctcggcctcccaaaatgttgggattacgggcgttagccaccactcctggcccagctaatttttaaaattttttgtagagatgggtctcactgtgttgcccaggctagtcttgaactcccagattcaagtgaccctcctgcctcagccttccaaagtctagggttacagacatgagccactgtgcctggcccctagtgtttttctgtatgcaattttgatttccattttaagagattattaagaactttctcatattcttagcattgaggaaaacaatatttctaagtttagaaacatttaattcaggctgacataactgaaaacatgaaacagaattcatgcagatcaagcacctcttatatgagttggatagattatttgttatatagctgaagtgttttgctatagaacttacaaaaaagtaagttttataaatgcaaagtaaaacagagggatctataaatgttacttaattgattttctttgcttatttagaactaaagtttgagcctagtgcagtggctcacacctgtaatcccagctactctggaggctgaggtgggaggatggctttagcccagaagtttgaagttgcagtgagctaggaccacgccactgcactccagcctgggtgacagagtgagaccctatctcaaaacaacaacaacaataacaacaacaaaaaacaactaaagtttgagtaaaattaacctatgatcttcaacctttatgtttaagagcctgttaatcaacaattctttataaatttcctattttatacatggtgtgctgcacaaatacctataaatacataaaaagtgaaaaaaagagttagagtataggtatataaagacaagtaggaaatagctagaaaatatcagtcatgtataggtaagtacaatgtaaacataggtgttgtaggatgaaaaacaaggaaatgacaggggatctggttagtcaggaaagtcttctgaagccgttaggaagtgatggacaagaattggctatgaaggcacctgaaggtcatctagagtgagagtgaactaggaagaatagagacatgaagaagcacgagtcaagagggaggccctaaagaagctgacccaacaaggtagaccctgtgcacaaggagaacaaagacgtggttggagaggtccagagaacgcagcagataaaagaatttccattttccctgaccaatcaccaagagccattacaggatcctgaggagggaaatgccttaaaaaaaaaaaataaataaataaaggtagacgagaaagactgccctaattcatttttttgtaaattattttaaaatttatatttctttgtttttgcagttggggattatatatcgtgatattaagcttgagaatattctacttgattctaatggccatgtggtgctgacagattttggtctgagtaaggagtttgtggctgatgaagtgagtatattttaatttgaagttagtaataacagcatgtaaacaaggatgaaaacttagccgtagaataaacatttagcagaaaactgccctgtgaattctgaacttttgtgcagatttgtccatggaaaatgtagagatttttagtttaaaattcgtatggagccgtcctgttaaaattgcggtaaaccttgatgggtatatcagaattcctatttatttaaaaaagaaaaaagacactatgcatttaactttccccataaaatatgtaaaatataactgaaaaatcaaataactcttttggcccttcaggagaattatggctttgatagtggccaataaagaatcataaagcaaagtacatacagtttacattgtggtaacaaagtaggacatgctatgaaggccctttgaattcgcttgacaagaatgacagagatctactagacccaatttttaaataatattgctggtttttgctcaacatgaattaaaatatggtggctaatgtgcagattttacatttggagaactttaattttcagtattaattagaatttgtttaatattacaaatgcatttaatgacacttaaaattgtacatctattagttgtaattaagtactgtttatgtaatggttgtaatagaagttacatttatttctgcactactagttattcaagataactaagtaaatttgaatgttagtttcgtttctatctaggaaattgttggtatagaatatgaaatcatactaaaatttttgtagtgaaggactttgttgttataaaagacatcattcttggattccaaattaggtatatctatttctgattggtttttggagtatattgctaaagcagtcctaggtgagtgagataagtgctgaaattataaaaattaaagatcctaattttttaatcgcatctatattcattcagtttacttataaaataaatatttatttatcccctctactatgctgggtactggacaatacaataataaatgaagtgaaaatgatctctgccttcatgaagctgaagttattacagtaaattgatcatctttgatacaaatatcgtagttataaaatagatgaattttgagtttacttctaaatttgatttttaaaactttttatgccgttgtaaaaattttagtgatgacttcagcaaattgtagcagattatatctgtttaccgttgcctccttaataaatcccacaaggataaaaggaaagggataagatagacatgcactccaaagggaaaagagaaaatagcaactacattttagaagatggatgacagtaacatgggaagcctaaaagcaggctctctgtacttctgaccccctaaaaaggttcaataactggagacagcaggtatccctcgaagtaggcatgcaagtgatgcaggacccaggaggattgattgaaagtctgtgtaagaaacaggtaacccccagatcctatctctgcccctgttcacataggcagctgtgccttcctcaccctaagggaagactgacaaggtctgtgcattcagggacaatgggcacagctaaggatgaggataccatacagaaaatgacaggtatggtgaaaatggacacacagaactgtgcaaactccctcggcggctttctagcacttcactgagcacagtggcttcccaggcaggagtctggaggagttttctctgagaagccaagaacaaaatctccatagatgttgtcagtaattttgccactgaactggcccagccaaatctctctacagagaagcctggggcttggcaatcccacccggtgccacagaagcatgtttgtaatgatgccacatttaaaaaaaatagttttgtgactgtattttactataattaatttcctctataatgctatctattttaaaatattattttgagaaggggtccacaggcttcaacagactgccaaaggggtccttggtttgtaaatgtgtaaaactccccctgcatagagagatttgatgatcacttttatttgctcattccattgatatttgttgagggccttctgtgtgctagatcagcagtccccaacttttttggcactagggactggtttcctgagagacatttttcccaaagacgagggtcggggtatggttttgggatgattcaagcgcattacatttatcattagattctcataaggaatgtgcaacctagatcccttgcatgcacacttcacaatagggttggcactcctaggagaatctaatgccaccactgatctgacagaaggcagagctcaggtggcaatgcttgtctgctgctcacctcctgctgtgcgccctggttcctaacaggccgcagaccagtacttgtccatggcctgggggttaggggcccatgtgctagatggtaggctaggttctggtagtacactcattaaaagaatcacttaataattcctctgtttataggtgtgtgtggcagatcatttggcaatagatagaaacagactttggccctggggaacagcaaaatgttaggactcaaaactaaacaaacaaataaaaatcaaagttgaccagagttgctaggtcttaatacagtaataagcattagtcagaaatgctgtgtgactgaatcagccaggtcactcttcacaagaggagagtttgctgctagtcgtgtcaacagccacccttcaaggggatgatggagatccagtcaaataccatcatctttgagcacttagtggtctgggtgcaaaaatgaaataggagagttcaagctgaagtagaggagtaattagtaggcgcccttatttactgaatacagcctcactctaggttatgttaatagtttaacattactattaagctttaagggttgcatatctctttgatccttagactgtctgctcattcttcctgttagccctagaggacatactatcatgcttggcttcaggtttaactctcagggctcaggtaggaattttcctttgctgagtcctctgaaacttgatctaatggttctttgctcctctgattccacccagcacctatttaggaagtttctctatctagaccctttcttaccttaaaaatattcccatgaaaccatttctattttgattagcttgcattcctttttggtttccatgtcagccccaactcatatcaaaataccatattttttggaacaagtttctttctgctccatccctaatctgcctccttggtttccaggttaaatgtgtatctttatggtatggtttggctgtgtccccacccaaatctcatcttgaattcccacatgttgtgggaaggacctggtggggagttaactgaatcatgggggcaggtttttctcatgctattcttgtgatagtgaataagtctcacgagacctaatggttttaaaaacgggagtttccctgcaacaagttctctctctctttgtctcctgctatccatgtaagacatgacttgctccttcttgccttccaccatgattgtgagacctcccccatccacatggaactgtaagtccattaaacctctttcttttgtaaattgcctagtcttggatatatctttatcagcagtatgaaaacagactaatacagtaaattggtaccacgagtggggtgctgctgaaaatgtggaagcgactttggaactgggtaacaggcagaggttggaacagtttggagggctcagaagaagacaggaaaatgtgataaagtttggaccttcctagagacttgttgaatggctttgagtaaaatgctgataatgatatggacaatgaaatccagcctgaggtggtctcagatggaaatgaggaacttggtgggaagtagaacaaaggtaactcttgtaatgttttagcaaagagactggtggcattttgcccctgccctagagatttgtggaactttgaacttgagagaggtgatttagggtatctggcagaagaaattactaagcagcaaagcatttaagagatgacttgggtgctattaaaggtattcagttttaaaagagaaacagagcataaaagttcggaaaatttgcagcctgacaatgcactagaaaagaaaatcttgttttctgaagagaaattcaagccagctgcagaaatttgcataagtaagaaggagctggatgttaatcactataacaagtggggaaaatggctcagggcatgccagagacctttatggcagcccctcccatcataggcctggaggtttaggaggaaaaaatggttttctgggccgggcacagggcctctctgctgtgtgcagtctagggacttggtgccctgcttcccagctgctacagccatgactaaaaggagccaaggtacagctcaggctgttgcttcagaggatggaagcctcaagccttggcagcttccatgtggtagtgagcctgtgggtacacagaagtcaagaattgaggtttgggaacctccgcctagatttcaaaggatgtgtggaaacacctggatgcccaggcagacgtttgctgcaggaatggggccctcacggagaacctctgctagggcagtgcagaagggaaatgtgacgtcggatcccctacacagagttcctactggggcactgcctagtggagctgtgagaagagggccactgtcctttaaacctcagaatggtagatccaccaacagctcgcaccgtgcacctggaaaagccacagacactcaacgccagtctgtgaaagcagccaggagggggactgtaccctgcaaagccacaggggcggagctgcccaaggctatgggagcctacctcttgcatcagcgtgacctggatgtgagacatggagtcaaaggagatcattttggagctttaagatttgactgccccgctggattttggacttgcatgggacctgtagtccctttgttttggccagtttctcccatttggagtggctgtatttaaccaatgcctgtactcctgttgtgtctaagaagtaactaacttgcttttgattttagaggctcataggtggaagagacttgccttgtctcagatgagactttggaatatggacttttgagttaatgctgaaatgagttaagactttgtgggactgatgggaaggcatgattggctttgaaatgtgaggacatgccaggggtggaatgatatggtttggctgtgtccccacccaaatctcatcttgaattcccgcatgttgtgggagggacctggtgggaggtaattgaatcatgggggcaagtttttcccatgctgttctcatgataatgagtaagtcttgcaagatctgactgtttaaaaaacgggagttttcctgcacaagttctctctctctttatctgcttccatccatgtaatatgtgacttgttcctcctttccttccaccatgattgcaagacctccccagccacgtggaactgtgagcccattaaacctctttcttttgtgaatttcccagtctcggatatgtatttatcagcagtgtgagaatggactgatacactctgcctgccttctcttctctttaacctcttcctctttgaccatttctgtcactgtttaagtagacatagtctttccatcttaaaattttaaaaatggggagatgaatggactgataaataaaaaggaaaaaaaatctcagaataccatattcccgcctagctattgtctcattgttctcctttgtcagtatttgtctctacttactcacatgtcccttactcccttatcaattccaattctgcttgtacctccttgcccccctaccccgccaccatctgctgaggctgttcttgccaatgttaccattgacgtgcatattaatactttttagttactttatttgactgcctggtagtactgaacttgaaatcacctctcagcttggctctgtgacacaacacccacctgactttccttctctctctcactgccttttgttggctcttcctcttctacctgagggttcccctcagctcagtcctaggtactcttcttttttttatgctgtactcttcttacatgctgctcattcccagccttctcttggccaaccttctcttctgggctcaagacccaaatatgtgaatgttttatctccacttgacactttcacaggctcctcaaactgaacattttcaaaacagaagtaatcttccaccaaaatctgcctttctgtcagtatatcacaattttatattataaattctggcctcatttggtctgggaaatatatttaatcttcaggaatttactttttatgtatgtttgatgtttctgctcatgatattatacttatctctgtatatatattaatttagtaattcaaaaaatcttggagtacttaccattgccaggtattgcactagaccctacaaatataatggtgaacataacaaattccttaccctcctgagcctgtattctagagatatttgtcaaatattcatataattatttctgggttttttgtttttgtattttttttttaaaagatggggtcttggtctgtcacccagcgtggcaagatcggctcactgcaacttctgcctcctggggtcaagccatcctcccacctcagactcccaagtagctgggactccaggcacatgccactatgcccggctaatttttgtattttttgcagagactaggtttcaccatgttgcccaggttggtcttggactgatctcaaaaaatccacctgccttgctctcccaaagtgctgggattataggcatgagccaccaggcccagcccatataattatttctggataatggtttgcagcctagactacatacaggttaaagtaaatttattttagaaactttaaaaatattttatgataataaaaatttgctacttttactgttctgttctcaaccagaaaattcgatcaagctcttgagattctgaaaaataacaaaacatctctaattttcaggctaatatatatcttccatagaatttttttggtagtacagttttacaaacatttgttgagttcttacttcaagtcagagaatctggtagttattggatatttgattttaatgttgacaactttaaagacagttaaaaaaagtgttggtaaagtgatgatagcttcaaaattgtgtctgttcatatttataagcaaataatgtcaaaaaggacacgtgtttatgcttaaatatggtatatgcattctgtttttataatttaacagtgagtgcttgaaaattttcaaaacagatcattaacacgaatccccaggtagataaatacaactttaaggttcagaagaaaaataatatgttggctgaacagtacagagtatctgtacttaaagggaaaagcctatggatttatgactgtttctctctttccagaagtagaaaaatctaaccttgctcaattcagataatgttatttattgattaattctttggacaatgtaagaggcattttagttagggggatctttttctggttctctatttcttagctttaggacatgaggcaagtcacttcgtcattaacctctctgagtcttaatttcatcatctgtaaaataatatttatcatacctaatttatagaattatcatacagacacaatgaattaatgcttgtgaaagtactttctaaagtataaagcactatatccgttctatttctgagaagtactgtttacatttcagattactgtgagcaaaattaaaatataccattgagaatttaaaattattctctttattttcttttttgtagttttaaattacatctttctctaataaatgcctagctaatagtgccactttcaagtttctgctgttataatgtacgtatctcaagatgtgtaggtaagggtcgggctccataaagagcgtgtttgcattgagaatcagataacctaaccctaaaccagctttttagttacctctgtctcccttcctaattgatttgtactgacatgtagtcatgattttttttatttgcatgtgtcctgaaaatctattaggtctctgataataagctctatcagtcatttgccaaaatcagtgactctaggataatttagttattttaaggtaaacattgagttggaggtgttgggaaaataggagacctagaaaccaaagtgttaccctgttgccccagttcttcctttcttaaaacactattacacaatattcagatgccaacacattagcttgagccgttcattagtgagatttttttcccccagatatctgagcagacctttgattcccctccaaaggttggggggtaaatagggattgcctgccagctgtctgcttcacagatccctttataattattcttatggcagaaatttttggatctactaaagtttattcataatacgattttttttaaggtagattcagtgtgagtaacaacacagaacaagcagggacaacttttgaaatgagattattttcacagaaacttccaagtatatatttcatttgttcaaataatgttaaatatgtgtttttaaatttacttgataactatatttagcagtcacagtttatttttatctattttctaagaaagaaaggaaaatgattcagaactatgctgagtgtcagggactttaaagtccataagggcaaaagatatcctagaataataagaattcataaatgtgaataataaatgtttatattttccaaatttctctttaaatttttatgctataaagcacaataaaaatagaaaataatataactgagtttatgtgcccactcttcacattttcagttatgaaaattttataattttttccattaattcagtgaatattcattgaatgtctcctgtgatccaggcactgttctatctcagtgttgagatcttgcaatgaatgagcaaaatggacacaaattcttcctttacacggggaggcagacaataagaaataagtatttctgtagtatgttagatagcaataagttgcaagaagacaagtatagtagggaacaggaatagggaatagggtgagaagaggctacactttgaaatcaagtggtcaggaaaggcttcaccaaggtgatagtgcagtagagacatgaaggaagtgagagagtcagccatgtagatatctcaggaaggagatttctaggtagagggatcagccaatattaaggccctttaaggtggggttatggaatgagtgagggttagaggccgttgtgggcatacagaatgagtgagagttacagtagtaggaaagaaggacatggaggtgatcatatggaagaaggattgtacagattactcagggcattgaagatcattgtaaggactatggcttcttccctgcacaaaatggggagccactggggagttttgagtagaagagtagtgatctcctattttggaagaataattctggttgataactgtgataatcctgtagtgggacaagtgtggaaacatgaggtccagatagaaaactgttgaagtaatcccagcaagagatggaactggcctagactatggagtagcagattttaggactattttgacattagatctaatggaattttttgatgagttagatgtggggtatgagaattcagaagaaatctagtgtggccccaaggtttttggccagaacagctggaaggatgaaatttccatcaactaatatggggtaggctgctgatggggagctatctggggttacaagaggagaagttcagctggacaggttaagtttgagacatttattagacacacagcagagatgttaagcagtgggctatatgagtctggaatttgggagagaagtctggtctggatctatgaatttggaatttggaaaacaaggtggattgtctcagaagacaagtgaaaaaatgtttcaaggatgaaaatgattaactgtgtcaaatgctattgttaggttaaataagatggggactgaagattgagcattgattggctcagttttaaccttaggaaagagaatagcagtagccttattgtcttccacatatgtagacaacttggggttttctgttaaaaggaatagtgaaattctgtgaagagcatagcagaggatgaagtgaggatgaaaagagggttttttcccctaagatgggagaaattacagatgtcatacactagttagaatagtcctcaaaaggaagtggggtagatacactgatatctaccacccaaacccagatatctatctcctataataatacagcaggtaaagtgggaaattgctggaacactgtccttgagaaggataatgtcaaacgcacaagtgagtttgtgcgtgatcatgctactagtgcttaacgagtagcatggtcagttcatgcttagaaactgaagaaagttgagttactaggcacacatgtgggtggaggttaagtggtgtgtactggcagcttatagaaggtcttctgttttctcactgagtatgaggaagggagtggacacatcgaggttttaggagaaaggagatgatataaaataaccaactaacaatgtgggagagtgaacggattagggaaatgaatgtgtttgctgggtactattaagacccatgtgagattcctgatcatgaatttaaagtgaaattgcctgggctgatgcctgtaatcccagcactttgggaggccgaggtaggaggatcacttgagcccaggagtttgagactcaacagcctggggaacagtgttgggcaacagtgagacctcattcctataaaaaaataaaaaaattagccgagcatggtggcacgtgcctgtattcctagctacttgggaggctgagctgggaggattgcttgaatccgggaggcagaggatgcagtgagccaagatcatgccactgcactccagcctgggtgacagaatgagaccctgtctcaaatgaatgaatgaatgaatgaatgattgaatgattgaataaaatcggccaacctgattatatggttttctccaacaatgtgtagctgcactggtgcaggtaaagagtatgtggtggattaattttaattgtgttttagtacccttacttcatgtgtgtatatccgtaaacaatatatactattaccatgttttttaaatgtacatacatgacatattctattgcaaattgttttttatttgacctattcttgaaatttatccaagctgataaatgggatgtttcatttattttaactgttgtgtaataatcctttatattagttatccagtctatcttttctcctactgaggtacatttaggttgtttctatgttttctctatcacagtgttgcattttttcccctgatgttattgatttgttggagttcgttaagtattatagataccaaccctttataactatatgttttgtaaatttcttttctaaaattttaacttgtttttaattttgtttaatgatcttttttgccatttaacattttaatatccaatgtactaaatcttttcttttacggcttatttttttaattttaaaaaaattttaattgtggttaaaaaaacacaaaacaaaaattgccatcttaactgtttgtgaatatatggttcagcagctttaataatactcattttgttatgtaacagatctctagcactttttcatcttgcaaaattaaaactctataccttttcccccgtcccctaacccccagcagccaccattctactttctatttctgtgagtttgactacttatgatatcccatgtcagtggagttgtacagtatttattttatttttgtgactatttcacttagcatagttctcaaggttcatgcatgctgtagcatgtgacaagatttccttctttattaaggctgaataatattccatggtatttatatgccacattttgtttattcgtttatctgttgatggacatttggattgctctcacctcttggctattgtgaataatacagtgaacgtggttgtgcaaatatttcttcaagaggcctgccttcaattcttttggatatatacccacaagggggattgctagatcatatggtagttctacttttaattttttgaggaacatttatactattttccatagcagctgcaccattttacattctcaccagcagtgctaaaaagttccaggttctccgtatctttgccaacacttgttatgttggtgtttttgttattatagtggctgtcctaatgagtgtaaggtgaaatctcattgtaattctgattcgcgtttatctctaatcattagtgatgttgagcatcttttcatatgctgttaaccatttgtatgttatctttggagaaatgtctattagagtcctttgctcattttaaaatcaggttatttgtgggttttgttgtttttaggagttctttatatattctagatattaactccttatcagatatatgatttgcaaatattttctcccattctgtaggttgcctttcattctgtttctttccttcgatattcagaagtttttaaatttgatatagtcccatttgtctatttttgcttttgttgtctgtgcttttggtgtcatatctaagaaatcgttgccagatccaatgtcatgaagcttttcccatgtattttcttccaggatttttacagttctaggtcttacatttagggtataaaatcaggtggaaatattttatatttttaatacaaataacccaattaccttttaagtatttgttgactagtcagttaatcttttctctgcttattcgaaatgcaacttctgtcatataactaagttcccaagcatacttacgagtctgtttttaggctcttcattgaattccatttgtctgtttgcctcgctctgtatcagaaccaaaatatcttaaagcatctggctggccgggcgtggtggctcacgcctgtaatctcagcactttgggaagctgaggtaggaggatcgcttgaggccaagagttcaagaccagcctgggcaatatagcaagaattcatctctacaaaatatttaaaaaattagttgagtgtgttggtgcatgcctttagtcccagctgctcgggaagctgaggcagaaggttcacttgaacccaggaatttgaggttgcagtgagctgcgatcatgccactgcactccagcctagacaacagagcaagactttatctcaaaaaagaaaagaaaaaaaagcctatcattttatagtaagtcttgattctgaaaaggtgagatctttttcctcttcaccctcaccctacctccctctcctttcccccgaccttcgtcctccctcttcactgtcttctctattcttggctttttgtgttcctccacatgaattgtggaatcgaatatataaattaatttggagggaactgcaatttttgaatattgacccttccagtcaatgaatttgcatcagtgaatgttcagatcttctcatttatttagttttttatgtctttcaaaaatattttgtactattatctgtaatattttatacatatattattagacttatttctatttatacattttgtttcaattataagaattacctttaaaaactggaatatttatgtttttcttgccagagcttaggaatgctgttgaccttatacataaaacattgaattcttattaggtgcacaaatttatagattgacttggatttttgtatagatgactacattaaaaagaaaaaagtcagaaccattatttgtaagtaataatggctttgtttcttttcatttctcataccttttagtttctgtgtgtttggggatggttattttgtttaggtttggcttggttttattgatttgtctaccaagttttatgtgtatatgtattttttacattaaagaacatgtattttagtcatttagtatggtatttgctgtaggtttttggtagataaattatatttttagtatctttattgttataagtaaattcttatggtttttctctttaaccacataatgatgtgaattatatgaatagatttttgtttcctttttcagtgttagaccatctttcaattcctggaacaaacttaactttccatgatatgtattttttatacattgctggattttatttgctaatattttacttaggattttattttctaagttgacctataattttcctgtataaaattgcatttgtcacattttagtatcaaggttgtcctagcaccatgaaatggatttagaatggtttatgtaagataaagtacatttcttctaaaggtttgtgtggattaactttcaaatctgccagagtgtgtttttttcctttttttttttttttcattttaagtgagtgcaagtagcttttcaaatactgatttaatttttaaaatatttacaagtatatttagagtttttatttcttcttgaatgttaacatttttatagaaaatggtattatctttttaaattctttgacatcagtttcttcagaatttccttacttttaaaaatctctgtaactatagtaatgttttattttaaattactgatattattcatttgttacttttcttgatcctttgttagaagtgtccattttattagtcttttataagaaagagcttttgtcaagccttctatttttcttctctttctttgatgaggtttattattttgtgcattttactttctataagcttctttcatattctttttctaagcttttaatttggacatccagctcactaatatttaatctttttaaaataaagctgtgaatttttaaaaatagctctagctgcatcccacaagttcttatatatagtatttttattgttactgtaatatttattgtcactttttctttgagtggtggctcatacctatatccaagcactttaagagtctgaggcgggcgaatcacttgagctcaggagcctggacaacatagcaaaactgcgtctctctacaaaaagtacaaaaattagccaggcgtggtagcaagagcccagctacttgggaggctgaggcaagaggatcacttgagcctgggaagtcaaaactgcagtgagctgtgatcacaccactacactccagcctggatgacagaatgagaccttgtctcaaaaaaaaaaaaaaaagaaaagaaaagaaagaaagaaggaaaaaagacatatgcctgaaagactatgtgtgtattctctaattgatggatacaggattttgtatattttcatgaatatcattcaaatcttgaatatctttactaatatttttccttcttgatctgtcagttataagaaacatatgttaaaatacccatgatgattgtggatttgtccatttctccttgaagatctctccatttttattttatatatttttaaagcttttcacaaatttttgaggatattcaagcttggaatagagttatttccctagtgaaatgttccttttattattttgtaatgtacgtaattttaataattcttttgccttaaagttcatttctcctcctattaataaagatactccagctttctgttggttagtgctgtctgatacaacttttttcatctctttactttcaatctttctttgtcattatgttttaggtgtgccttttataaataacatatagctggattttattttttgatcgagagtttctgtcttttaactggtgagttatgatacctgtatattatgattactgatatatttttatttatttctcttatcttgctttgtgtttctctttgcttctgttttccctttttcctgtcttctatttaaatgattaagatcttttgatttcatgtccgcctaatggtctggaagtcatgtatattctatttctgttcttttagtagttattaccctgattttatttacttatctatttttatacacaaggcatttctgtaatattaccctgattttagacttgtgctctgacttaacagagtctgaaattatccattatctctcaaacgatcatgaccactacaagaacgttagaatgcttaaacttcagttatttatctaatttttatattatttagtattttagtcctacctgctaaatttccacaaatcaatcattactgtgcagttattacttttattttataaattcagtgcttgtttatatttacttacacatttgttttctctgcttattcttgcttcttgcatctgagttttttctttcaagttcaatttattaatttatgaaatacatacgttagatttctttttagcaaggttcaatgattaataaattctgtctttgtcttaaaatgctttattttgccctgcatattaactgataacttagctgctgggtataaatagatctaggaatggacctgtgagatatgtacacacacacacacacacacacacacacacacttaaatatatatatatatacacatacatatatatgtctctctttttattgtaaagtaaaacagattcaaaaacaaaataaatgtatggctcagtgaattattataagacagcacccttgtaaccaccactcaagtgaagaaatagaatgtggccaatcaggaatatatttttatttaatctgcttaggacttttgcaatattctggataattttctcaaatttactaagtctttagtaaattttactaagtctttttttttgttttttttttttgagacagagtctcactctgtggcccaggttggagttgaatggtgcgatctctgctcactgcaacctccacctcccaggttcaagcagttctcctgcctcagcctcctgaatagctgggactacaggcacgtgccaccatgcatttttagtagagacaggatttgagctatgttggccaggctgttctcgaactcctgacctcaagtgatccgctcaccttagcctcccagagtgctgggattacaggtgtgagccaccatgcccagcaattttactaagtcttgagaagattatccagaatgttgcaaaagtatcctctaatttactgtctttcttcagctgtgtctaatacgtttagtctgccttttttattgcctcgtttctttatttgcacagctctatttgattctttttcttcttttcttttctttttttttttttttttttgagtcagggtctcactctatcaccgaggctggagtgcagtggtgcgatcatggctcactgcagcctcgatctcctgctctcaggtgattcctcttggctcagtctcccaagtagctgggactacaggcatgcgccactatgccctgctaggttttttttttttttaatttttttgtagagacagggtttcaccatcttgcccaggctgtcttattttatgtcttttatcttttacaacatgctggtcatttacagattatttttctactgtttcaagtaatccttcagtttgttgtgtctgtggagtctagttcacttatttagtaatatcaagacatcagcgctttataggaattctgggcaggctaagttgtgagaatatctctggttctatcatgtgtcccagggtgtcaccatgtttggccagattttcctacttccccacaccgtgcagaagagtaaattcagatctcaaatctaagaagcataagcctaggcatttaagctcataggaggaactttgttcagctagggcctagacagaaacgaatgagtgctagcagatgaatttatttttctgtagtttgttttcactgaggtttagctttctttggtttcaaggtttatataagagtggtaattctagcccatctcatttgagctgacagcctcatcgtttatcctcacagggtattaaaactcaagtttctggattgctgagacctgtaacaactcacctttccaccgtttgtgcagccacagcactaggtcatatgcctacctctctggttttctgtactcacttcctggctggcacccaggaattctcctttctttcttgtgagcccggtctttggcgattaccagtggaatatgtaatcctttttaaaaatcagtcaaacatttctagatatttgtgtggagatttgccagcattaagagtctttctaaatatgggatgagaaaaaaacctgttttcattgatgattttacaccagaatttatctgtcacaggcagatatgattaggacaaaacattggcaaataaaagctaggaattatttcatcagagtctttattgagaaatacttaagtctggcatttgagttactattgggattcctccctagaaggaaaccagctttatatccagtgttatctgatccttttctctaaggagcaatgaagcctccttgattggctaatcacttaaaacacatgagtattccatattatctgctagtatgttgtacacatcccactcctgctgtttttgttcataatcaagtaaattttcattcacattttttttaactgtgataactaaagttgcttatagtatgggcataaatgtcaaataggttgtctccttgagaaaattgttacttgagaaaattattgtattttgaacaaataataaaccataagcatagtagaactgttaccttgaagtctttcctgcccctatcagagactctggaatatgttttatggtgcatccttcccctgtcaaatctcatcagtttgtcttcttggtagaattattttaaggcattatgcatcttcataggcaaataaatacaaattcaaaagttacaattggtgatatttttacaaatagaagagaaactcttaggaagtttaggcagagacctaaaagttagaacccagagggaataacacaggaggaagcaaatataggtttagaactgggtaagatggcaagggtttaaaataattgagagaattaagagatgtttgtctttatttactactattctcagtgattgggacttctcaacatttaagctttagtttttctatattctggaatttctatcaaataaataaatatttattaatgtataccctatcaactcctcccccaaagcaccagataagctaaaatgaactataagagaggccaaaaattacttggaaaagatagaagaaaaatcttttaagcacttaacttggggtggttgtgagcttcctctaagttgagataataaatgagctacgtaattgcataattgattatctaaaaaataatttttaggttaactttcaggcatgatatattagcccttttgaatttttaaaattctataaaaaggaaacatctatctttaagaaataatctttttttaaagacagttttgtttaccatcgttaaacataacattagcgttgtcaaacctacacaagatggtaaggtagaaaaaaaaatttttattcttttttatctttgggtttattattccccctcttagaatttggtctttcctaccccttcaagttacccagtgttttctcaatcttgcctaataaagtcattcatactaatgtgttagacagttcatgttgccttactaggactatttgcattcttcaaaaaaagggttaaatcaacaactgaaatatacatgcatgcaaaaagtgaacaagaataaatgaatggattcatggaaaggatggatggatggatggatggatggatggatggatggatgatggtaccatttcatgcatgagaagtctttctgatgggatgggatgacatatacccaggactcatattatgtagacagtggtctgttccagtgaagagtgggtctgtcaagtagattctaccactactttgccactatagtgtatctcaaccactaacatgtattactttcttcttttgtcacttgtcatactagcttgaaatcaaatcccttttttgtttgtttgttcaagactgaaagagcatattccttttgtggaactattgaatacatggcaccagatattgtcagagggggagattcaggacatgacaaggtatgttctatttttgatgcttctttatgtatttctataaaatgtactataagaatcctagttaacaacttaggtcatctcttcaacagagccgtctttctggtgttgattgtcttaccttcctttttttctcttttgctttgtattcctgaacacattatgatatctagtattttggaggaaaaagataatacaaaggttaggacattctagatttccctttttaaagattttattggtgagaattgtgttttattttatagagtaacactcttgttaaagttgagacctccaaactagtcaaataatttttattttatttctgttgagagagcctatttcttagagtacaaactatgactccattcttttaaaaaattaagggcctgtaatcccagcactttggaaggccaaggtggatggatcacctgaggtcaggagttcgagaccaacctggccaacatggcaaaacctcatctctactaaaaatataaaaaattagctgggcgtggtggcgagcgcctgtaatttcagctactcggaaggctgaggaaggagaatgtttgaacccgggaggcagaggttgcagtgagcagaaattgtgccattgcactccagcctgggcagcaagagtgagacaacgactcaaaagaaaattacttacttatttttgcatgagaccctggccttttaggatacaagtgaaccacaatgcaatacagaagggtcacggcatgtaaaactgcacattgttcctgtctgagtcgtgatgaatggttttggacagtatttattggcatttttaatttctactagaaaaacattcggaaacatatagtcatgtgtatcacctttagttaataattggctttttaagctgtcactaagaggtcaatgaaaagggaatcactgatattttcttattcccagtttctgcctttaactttccagagacactggagactgttgattatcttcccaacagaaataaatattttaacaacccttggtgaaagaaaaaatcctgagttctagatagtttaagtttgttttcctaagccctctaaaaagctcaatttttttggcctcctctcttgcctttgtatgtgcaaaatgaagattctagaagaaactttctaagtaattatgttataaaatctaggtcatggttttttttctgtattaaagggtacaaaatttgttcattttttaacacttctgttttattaatagctttatccaaataaggtattctactttttgttccccatctttccttctccttcattccctttcagagtcccacatatgcagttcagatatctggctgtggagaatctttggtctccttcctgacgactaatcatgtatttaaaagcatgttcttcaagtttgtgtgttactggttttggaacccagggctaagaatctgattattgatctctgtcagttgaataatgtggtttcaaatccaacagcaaaacattctgagggttctgactcaaatggcagtcaaactgcttgtattaatggaagagtttaattgctggcttagtttgcttcttgatattctttgaagctgttggggaatttggtaggaatttatacctgttaatttgaaaattatcttcagagacctaatggaaccaattttcacataagaaaatcttatattactcctagaatttctacatacctaaggtgcagaatatacctagtcaataaatattttttcccacacctggaacaacctgacagttattaaatgatataatgtatgcaaagtgctcatcatagtgcctggcatgaggaaaatattcagtaaatacctttgctctcacgattttagtctgcctgatgtgttttgtatgtcagcactctgtattttcttaatagctctaggctcataaattttgtcacctctctgaaacttaggccctggaaattggaagcaaatagtttgaaattttaacatctagttaatatttctcattggtgtacactcatttattcaatagttattaaaattctgatttgcctaattacaaaagaagtaattttcaatacatcaagattctttaggccaggcatggtggctcacgcctgtaatcccagcactttgggaggctgaggtgggcagattgcttgaccctaagagttcaagaccagcctgggcaacatagtgagaccccatctcaaataaaataaaataaaagattctttaaattatatataattttctatgttctcagttcaggtaactgcatgtataaattggtttccaaattagaacacattttattttatattattttagatcttcccatcagtgaagactctgaggtttatgtgtgataggttctataagaaaaattgatttaggcagttaggaaaaaataacatacccttggatgtggttttttttttcatttattgttctttgaattttagacatttcataaggctcactggagctgaatactttagttccctatcataagcccaaagaaatatcacctacttaaaattttaaaaatttatataaagtttaaattttttaaattatcaaggtaaacggttactagtttaagaaataacatgctttctgtgctgaggatacttggatatttgttctctaaatgtctttcttgcatgtgttaatttaatactccttacatagaaggaggtgtacaaaatcattttttaaaacattttcctaatagatagcttttattcattttttctttcttataaaatattttagttgataattctataaaatgaaattattgttgttttataggcagttgactggtggagtttgggtgttctaatgtatgaattactaactggagcatctcctttcactgttgatggagaaaaaaattcccaagctgagatatctaggtaagatttgacaaaataaaataaatgcattgttttctcaaaggaactgatcacatttctgcggttaggctgatgtaaacgataattttttaaaatgaggatagacaaagtgatgtttatgtggtaaattttcatttctatcatatggcatatagatatgttacctttacatttctttatactgattttatgtgcccagttgaatctgaagttaacttatgatctatagtgtcatgattttggtgtgccccagagcacttagcatattgtcttacacttagtagatacgtcatatattgagaagtttatttaatggatacttttttctctactgtatatgtaatttatttctttgtgactttaacatgaagaaacagtaatgatatttttgaactcatgaatgtagtctcaatagaaacaaatatcgtaaaattatcctcttgtaggtctcagagcattattctcttcttttctttcagagcagctatcacagttgcagtgttgcatttttgtttataattatttgattaatgtctatctgtcacactagattgtaagctctgtgagagtaagggacatgtctggctttgattctcagtacttgctatatagaatgccgtaaatatttgagggataaaatgggttaatgaacaaataagtgaatagtgaccaacattatactaattactagttatgtttttgtcctgtttttacttgaattttgtaactttgagaacagatttgacattaaaaattaaaaatagagattccacttccaaagaagatggaataaacagggaccagatttactttcctgcctgaaacaattttaacaatgggcaaaatatatgaaacaacagatttgaagacattggacatctggaagtgaaggacagtgatctttgagaggcggaaaaataaatgaggtgagccctatgattgccccagcttactgccttgagagcatttccaggccgcaaaacccagacgcagttcaggaggtggaactgagagtccaagaagatcaagacagctagagtttgcaggccagagtatgggagaggagagtggcacccagagggaagtccagaggtgtgcagaggtattcaattgagtgttggtaagcacacagtgagggaactattccatatagtgaagatgttatttcttgccaaattgaactgtagattcaatgcattcacatttccagcaggcatttttttttctttagaaattgacaacctgggtctaaaattcattatgaaaatgcagaggacctagaatagccaaattatctttaaagaaatataagtcttgaaataaactttgttctaagttacagtaatttaagacattgtgatattggtgtcaggatagacaaatgatcaatggcaaatgatttttgacaaagatgcaaagtcacttctgtaaagatagttttgaataaatggtgctggaaccactggctatccagatggaaaaaagtgaacttcaagaaatacttcataccatatagaaaaattaactcaaaatggattatagacctaaatgtaaaacctgaaactataaaacttctggaaggaaacataaaggaagaccgttgtgagcttggtttaggtaaagatttcttagatatgacacaaaaagtgcaatccataaaacattaataaattggacttcatcaaaattaagtatttctgctcttcaaaactgttaagagaatgaaaagacaagccacagactgggataaaattttaaatcatatgtctgctgaaggactggtatccagaatgtataaagaattcttaaaactcaagaaaacaaacaactgcatttaaaaatgggcaaaaaatttgaacagacagttcatcagagaagatgtgtaggtggcaaattagcacatgaaaagactatcaacacctttagtctttagggaaatgcaaattaaaacatcaatgaaataccactatatactcaactagtatggctaaaaataaagagactgataataccaagtgctgataaagacttagaggaactggaactttcatacactgcaaggggaaatgtaaaatggtacaaaaactttggaaaataggcaatttcttaaaaagttaaacgttactcactgtctaatctgtccattccattcctgggtaattaccaagggaaatgaaaacatatgtctatataaaaacttgtacatgaatgttaatgacaactttcatttgtaataactgaaaactggaaataatccaggtatctgtcaacaagtaagtggttaaacaaattgtggtttattcatacaaatggaatactccttagcaatgaaaaggaatttatctaagacatgtgcagtagtgcacctgtagtcacagttgctgaggagggtgaggtggggggattgcttgagcccaggagtttgaggtcagcctgggcaatgtagcaagaccctatctcttttaaaaaaaaaaaggaatgatttgtttatactcttgcaaatggatgaatctcaaaataattacaccaagtgaaagaagcgagaaaatatagaatatataccatatgattccatttctggaaaatgcaaactaacctacagtgacaaaaagcagaatagcagttgcctagggactgggattgggggaggtcaggagagattacagtacgtaggaaaactttggaaggtgatgagtatgtttgtttcttgattgtggcaatggtttcacaggtgtatacatatgtcaaaacttatcaaacttagaacattttcttccatgaaattaaaaaaacataaaattatatactttgtatgtgggaattttattgtacgtcaattgtacttcaataaaactgttaaaaatttaaagtgtaccttttccaggacaggctaggaagtaaatgatttctcactgtttcaatttatttaatgccaaagttaagtgagcagtacttctttttaaaatcagggtgagttaaaatctcacctcttatgaaaaattataaatatgactttgtttattttaaattgattttttggcagtttgaaaatacctcagactataggaaactgtggccaccgtcctgagaatttgggtccagttgtaagatcatacctgtcatggtgacaggtactaagggtcgccttagcctgacaacattaagtggtggcttctctaattcccctctttctgattccacatatacaggcaatctttataaaataattttcctttccactgtaggtctgagtgtggagagaagtatatttcttatgatggcaagaatattctgaacaaagtaatgttcacatttaaattgcttttattccctttatatcaatcaattggcattctggttttagaaagagaaagagagcctgaatcagattgtttaaaaccttacaactaaagcaaatagacttttcaagaatttaaataggattccttccctttaatcaattaattatccactttgtcatggtgtcaacctgtaatttcatggttttgtgtgtgtgtgtgtgtgtgacagaaatttacaaacaatgtgataactaaattatcctacactacattttcctttcaaaataatcattctgagtatctttcctggcataaatcttgtatgtatcatttagataaatgtgccattatctgtccccagtgtcttaattagctcaggctttttatcatcattgaatttttccattcattaattattatgatcttccctgaactctgcatactttccgtattttttgtttgaaatggttcaaagtaatgtattatttaagttatctgttcgccatttttgtctacaggtagcctagaataaaaatgtttttctagtatatcaaatttcaaaatatgctaagaacttagaatgagaagaaacttagagtccagcttttcccctgacataagaatccctttctctgtaagaatccctgatagttgtgccatcatggaaaggatggagcttctataaggtgtttttaaggaagccatgttcattaatggacaactttagttgtatagagttttccccctcttaaactgaaattattattttctcatttctgaatgttaattttggtcctgcctgctcaagaacatggaataattctattatttctttccagacattactttaaggatagttttatctaggataaatcttttagctattcattagaaatcatttctagatttctcatatcctgatactattttgggcaaatattaaattatcagtattattgattggaatgattggtttttagcttttctgtgagtctgtttcttattttttaaaatacatgtacatgtgcttttcttacgtgtcttacactagcttttattttataaatttattttatttatttatttatttttttaatgttgagacagagtctcactctgtcaccaagtctggatatagtggcctgatctcggctcactgcaacctctgcctcccaagttaaagtgattttcctgcctcatcctccccagttgctcgattacaggcacatgccaccacgcccacctaatttttgtatttttagtagagatggggtttcaccatgttggccaggctggtctcaaactcctgacctcaagtgatccgcctgcctcagcctcccaaagtgctgggattacaggatgagccactgcgcctggcttccattagtttttattgcctttctgtatagaacatcttttacgccaatggccactctcagttccttgcaatgtgggctgctctaacctgacaactctctttgtcagagcctgtgagctggaaaggcagtagagtccactaggaagatgggatgccttgtaacctaatcacgcaattgacatcctatcatctttctgtacccagtattggttataaggaaggcactaggtccaacccacaggtaagaggctgtgaatgcaaatatacagtgatcattggggccatcttcaaagtctgcctaccatgagccctttacaaaaaagattgccaacccttggtctaggtaattaattttgagatatgttgcttttggagtcatgtatagagtaactacaagtatctttttttttaccctgttttaagaagaaatcaaatgtattatctttcttggctttcttaggtctttatgataaaatcctttcttggcatattttataaagcctccttgattctcagtttgctgggggtttattcttttcttcctcattttgggtatttctgtacccaatatgagcatctatgtttcccagggttttttgactagttaaccaaaaactttttaaagtttgtcacagtagctactcatctacacattcgtctacacgaggcaattgcagcagctccggactagagtccagcagcaggaggggatggcaaggagaggacagggtgacatggcccttcccttggcacttatactcctcagctctgcatcttctttcctttcttcatttgttttgcactgcttcactctacaacctgttggggtgaatcatactttgttattaattgctctgaggcactccctagcggggtggagcatttggagtcctgaataaaaacctagggataggccaggtgcagtggctcacgcttgtaatcctagcacttggggaggccaaggcaggtggatcacctgaagtcaagagtttgagaccagcctggccaacatggcaaaaccccatctctactaaagattaaaaaattagctgggcatggtgatgggtgcctgtaattccagctactcaggaggctgaggcaggagaatcgttggaaccctgggggcggaggttgcagtgagccgagattgcaccactgcactccaacctgttgtgaaagagtgaaactccatctcaaaaaaaaaaaaaaaaaaaaaaaccctagggatcattcttccaactgtggaaaaggtccatcagaaacatcatcagtctgcctatcatttcccaggccttcttagtctctcaccggagacctggccctctgttgtttccctgatgatgctgcagtgtagattctttgccgccacctctgtgcaccaccccagccagttctctactgctacagtcaacccagagtctaaaaggtcagcctcatacatactggaaagggccgtgaaaggaagaaggtagttttctgtgttcacgactctgtcacacattttggtctctggatcacctgctgtttctcatgtactcatggttctccatggcctcccaaagaaggtctcatcattttgggtgataatcttgtctctatagtctgactgctgctctctgcctctagctcttttcagtttagctttctctttggaattccttgcattgaagtctgcttctgagtgtcttagttttattgtcacatgcagccacttggctccaaggaacccccaaggtctgagtttaccactctcttccatcactatcatcttccccctgttagggaaaggtagtctaagggccatcatggaatgattggagaagtaaaggtttaacagcattgtgtgggctacagaaaaaaaagtgtacaaaggaagagagacaggaagaggtctggcgataaaagtcatactaagtaacttttaaatcttatttaagacacttccaggcacgtctaacaagccagtctagtagctccaccaacaatctaactgtacaagagcggtgaggacctccagcagaccagtttggttcactaaggaagccttagccattgagaggaagggcaatttttggcaatatctatcacttttagatagaagatgctataaattaaaaagaaagctcttttcagcaaaatctttgcagtatcatgcattcatctttggttcccctaactttgtaaaagaaacaagttttttccttcagtcccagaagcaatggccggagtgtgcacctctcagatggcttcccagcagtgtagtaggagacctggttagtgtactgggcagaagagggaaataagatgcttcatgtggccggccgcagtggctcacacgcctataatcctggcactttgggaggctaaggagggtggatcacttgaggtcaggagttcgagaccagcctggccaacatggtgaaacctcgtctctactaaaaatacaaaaattagctgggcgtggtggcgagtgcctgtaatcccagctactcgggagactgaggcaggagaatcacttgaactcaggaggcggaggttgcagtgagccaagattgcaccagtgtactccagcctgggcaacagagggagactccacccaaaaaaaaaaaaaaaaaaaaaaaaaagatgctttatgtgacagtgaagaagagtatttatagcttacataagacatgccctggggacgactccaagagttactgggtgggtgagacttttgagtgcagtcacagattccacagaagcagataaggataccagccaaataatctcaatttattattattaatgacctggctggtgtggcctagggaaacacaggttaagtggatcaaggaagaactcagtaacaccaaaagtgaagtgacagcctgtctcatagctaaaggaagacagactactatagagtgacatcaacagcaccgttcacctggggaccgctgtgtgccagcctctgtgctgagaagtcacccacattgtattctggaatcctcagaaccctgaaaaataagtggtagcatatgcagttttacagatgaagaaactaggatgtgacttgcctgggactcaatgctactgtgaggttggactgggatcaaatacagagttactggaaagttactccatgctgtcttcacgggtatcacttgtttccatgctgctgttttctttccaagtctggcaggtgcttatttcaggtaaaagactgggaagtactggcccacggactgcagggaattgatttcattaatcagtggactatttgttgaataattctttactcctaaggagaaagagaaatagagggtaaagtccttgtcctaagaacatttatttatatagcatttgggaggatatggaataaatacatgaaaattcatagtatcagggagttttgacaaatgtctgagtgcttttaggtaagaagaatgctgggggaggacaaaggaggtttggttccctgggggtgggctgtcagggaagcattcatgatggagatgcggactgggttgggtagaagagaaaagatggtggggaagtacccccagtggcacatgggaggttcaggactccattgcctccttgccactctgtgtactcctgccattgggttcgtgatcttgtaagcgaaactcattttattgttcccactctaaatgtcatgttcattatagtttaagatacgcatatggggtaaagagtcaataataacacgcagagacatatactattaatgttttggtatattatgttttattcttttttacttgtataatgttgtactcatactagaaatataattttgtatttttcagtttttgctgaaatttatgtcgtaaacattttgttctctaattagaaaactctctgtaaacataattttgtaatggctgcttaatgtactattgagtggatacaccataatatgtttcacttttcccctagtgttggacaaaaatgtagagtaagtgaagtttactgagagctgtttctaactcaggcaggcacataaataattttataattctgggaccacatgggaaccaggaagtgaaagtcaagaacgttaagtcatgaaatggaaaagattgtgaacttttaaatggaggacaaatagaaataaataaacaacccatgagaatgcatgccatctgcagaaaagcaaaagagctattgcaggcatctcactgaaactgtgaggaagaaaggtcctgagtgggcaagatacagtaagtagaaaacaatttgacatttatttattcactaaatatttgttgaggagttgctatgtgctaagcaatgttctaggccctggaaataaagcagtgaacaaaacaaagagaattcttactccattagagcttatgttttagttgagagagataaataatagacaaataaacatatggtatgcatgaagaaaaataaaacagagtcaagggataaggagtatgggggtaatggctattcttgataggatggttagagcaagcttctctgaaaagttgacacttgaacaaagacttcagtgggtttaagagcatccccaggcacagtggctcacgcctgtaatcccagcactttgggaggccgaggtgggaggatcatgaggtcaggagatcgagacgatcctggctaacacggtgaaaccctgtctctactaaaaatacaaaaaattagccgggcgtggtggagggcgcctgtagtcccaggtactcaggaggctgaggcaggaggatggcgtgaacctgggaggcggagcttgcagtgagctgagatcgcgccattgcactccagcctggtcgacagagccagactctgtctcaaaaaaaaataataataataataataatgataataataaaagaagtgagcatcgcctattgttactaagacttgtgcttaaaggtcagtgattttttttttgagacaggtctttgttatattttagtgaacacacaaaaacacatgtacaaagcttcataggtttactttttctaaaacattttattataaaagttttcaaacatttgttacagtggacactcacacactcactacctaaattctaccatgaatatttcatcatccttgcttatttcctgtctgcctatgtatctgtacctctcccatcataggtttaattttaattttggtgtctaccctttattctgtacacttgtgatttccttttgccacagaggtttccagaaacttaattcatgagtaggaagaaattttatattcatttttatattactgatgtgtattttaattttatttcatttggttttttacatgccgttcctcaatccatttggaattcatttgggttgtaatataaggcaaggtcttgcttttgtttttttatttcctgtacagctggtttccccaacatttgtggccttttgctatgcgatctggtcatttttttttaaataatgcaagtttttggccgggcacggtggctcacgcctgtaattccaacactttgggaggccgaggcaggcagatcacctgaggtcaggagttcgagaccagtctggccaatatggcgaaaccccatctctactgaaaatacaaaaattagccaggcatggtggtgggtgcctgtaatcccagctacccgggaagctgaggcaagataattgcttgaacctgaggcaggagaattgcgccactgcactccaacctggcaacagagcgagaatccatctcaaaaaataataataataataattcaagtttttatataagcttggttatttttcacaatgtgtcatctatgttcacttgatttggctattaatttatttgctagcacctcactttaacaatttcatttcatgatacattgtaatatgtggctaggcaatcaacccaatttgctttcttagaattttcttacttgtgctgtatattttgcaaatgaatattaaagccacccatgttctaaggccttgttgtaagtttaattaatattcatatttcttgcttttttgaaaggagtctttccgtatctgtgaaagaaggataaaaatagcagtcttttgataggattattatatggattaaataacatacacgtgagtggtttaatatggcttatcaactcagagctttttctgactttacagaaggctctaagatttatttgggctctacctaattgtaattcatttctggagtttcccagatccatttttaagcaagaaaaagataactttgggatattaccaattcagaaatcaagcacattggaggaggagaagtgacagcaacacccaagaaatgtctccctgcccttgttgcaggatcctctagtattgtcatgactaaatgtcccacagaatcgtctaccctcagccccacttctgcagtgcccattctgcataggcagcagtggtctagggttcagattgacgttcacactcacatgtcacaatagactggaatctggcaccagttttatttagctttatataaggatgcaggacaggaaacagtgtatcgacattacagcatcaaacacatcttcatcggggaccttcccaccacctatgcgtggcttcccagcccacacaagacacactcaaccattggtgatgaaaataagggggagcttgtggaccaccccagcatgggaagctcagagcagcaactgtcccttgtagcagcctgtgagcatggcttccaggggcctgcatgcctgctcacacctctcagtccagatgcagctcacttccaggaggagctttcacagcacctgacccacctgccacgccagttatcttaacccagtacatttcaagggtatggtataagaaatagttacatctgggatcactttcttatggagaaaagatgtaacctgctataggccctttctcctcaccacgccactcccagtgtctggttctcttcctgtcactgcagttttctagcaggaataggctttagaacctcctcacatcactgaggaaagcccgtggcactccgtttaccaagacaacagggagcctaagtgatattccttccacatatcttctgttttcacagggtggggcaagatactcctcatcacctgctagggtctcctgctgctgcttctggccataggattttcactcaggaatgggaggggtttaggctatcactggtggttctccaagctccctcatcagcactgttttccgccgacatgctttcagatttgtactcaatttctcccagtgtggtccctgcctcatctgaatttaaaattctagctccctgcatgtggtctccttgtgttcttctttccagacttggcatctcagcagagccatttctgtttttgggtactcctccttttgaggatgaacccaccatggtggacatttctcctttctgccttcgcaggactgactgttctttccccagcagctgatattgagtagatttccaatacaagttgaaatgttcttaaggtttaagaagtaataagatggtgcagagtcagtatgctaagatgatgtcagccaaagtgcatatatttctaccctaattcaacaaaagtaaatgtcacaatttgcttatcttgaccctgatcctttatgcaaagcttttttcctgcaaaaagtacagtagaggtggagaaaatgggaaaagctatgcttatttttccccaagaagcaggattcccagtttctgtctcagacatgcttgtgtctgatctgagaagaggattgtctattaatgccgaaaatccagacaagcagtgagcaatgggagagtattaaagaatcaaaaagcagagagggtgttgcttatttctttcctttctttccttgttttaccaacattttcttgggttcccagaattaagtgctagaggtagaattaactttgagattaacaacactgctggaatcttttgtaaaaaattacagtttcattatcatttcactgattctcagtggctatttgatagagcgtctaggcctattttctatatggttgccttggaatgagggagtataacagtagctcacattgattgagcatttgctatgcgctaggtactatgttaagcactctacaggtcttatttaagcatcatgatacctattttaggtaagtactgatgttatgcccattttacaggtgagaaaactgaggtacagagtttaggtatctcaaggtcacacaaggtcaaggcagagccagcgttgggctcattctggctccaaagtctatattctaactcaccacactatactgtctcttatacattaattatctgttgttgttccataatggttattaatattttaatgcacaatagggaatctttttgcaaacccaattaatggagtaactgtcttcatatatattgtgttaaggttcttaatttcagtcaatccttttaatatttcttactaaattattgatctggttgttaagagggagaaaggtacacttggattggattgatttcttctgtatccttagaataaatttctcatcaagaaactttattaccatcttatgtttttattttccataataaattgtggattttactccatctctgagctctacctgcctcatagggcttgtctggctgttttatagcagcaaacattgaagcaggtacttttaccccatgaaaatccccagctgtagtgcccatttctagatatcaagggttgaaccatctccaagtgggtctgaccccacttgtctcggtggacttccctctgcattcttatgggccccttaggtttgctggcactcaggggaagaggagtgaggtaaagatggttgttctcttttgtccttttaaatctgagtgctcaattcccttacctgaatttgttaagagtgttttatgttgtgaagtctttaatcatagagtctagtctatatacgggaggtctaatctagccccaggcttttccgtttttccccctagtgaaatatttgggatgttagcctcccaccaggattgacttatactgaaaaaatgagccaacattttttgttactgctcttttgagtttcagaaatttgactttatggtatctcattctaaatattttttcaacagtattgaggtattattgattcatgttaagtatttatatctctctttcacatgtggttcagtttcaaagtgtatttcaccatgcttttttttttttttgtcatcctgtttgttttaacagcaagttttgtctgcctacaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcaggtgaaattattgaatagataaatggtttcatactccttgccgttttcagggtccttggcgttcttggtgaaattagtgaacacagtcccctttgggatcattttccactggcattttcacgtacattgcaccttttgttttgttttgtttttaatgatagggaccctttcagtagggccaaaattctacttgtataaacattaatggtatttttctccctcaatggagtgggagtggggaggatcataatagcattcaattttctacatactgattcattagagtttctaggtggtggtttccatttatgatcttgagatctagccatatggactgagacttttactgtacttttcacttctgtctcagttcatgagctattactgccactatgtttcaccttttagatagtgatttcttcacttcctcttttcccagaagtaatctttaaaaattttaaatttacctatttctcagttacatattcatgacacatagagtgttactcatttatttcctttgtcctgtgacagtgcttctcttattctgaaaaagcctaatgagaccattctactgaggaccaactatatctgctcagtttagtacaaaaaaaacaccaaaatattaaacaactgagaaaaaacatttaaattaactgagttggctagttatttccagcctcagtcgtcaaactggggatgccacggctttgatttctaaaactctggagatatgacttttaaataacttcatcatatcagtaagcctgacctaaatatttatggtctaaagggaccatctaggttttattttttattctgtaaattaagcttttacattattatcaccaaaacaaatgaaaataatatagcaaaatgaagaaaaactgtcagttaagcttcatgttgttattattttttaaatatataaaaataaatattgattagaaatgagttatctctgctcttctgtgctcaaaaaaaggcatatttctcttagtctctcaatgtaattattttttataatactactgcacatcttatagaagttcagtaacataatgagaaatacatttagaataaaagaaacttctcactatatgcatttcatagattcacatggcttggaaggattactctttgaacaaactttcaaatatcttgttcagaagtttatctcaaaagttaacagtaaaatttaagaaacaagtcgagcaaagtacacccaatcatattttcctaggatctttttctccattgctccctctatttgggaatattgcaggatgtctttcatattagagaaatttctcttttcagtagcttggaatagtaattttagattacttaattgccttgactttttaaatgatagggacacttttggaaagaccagaattctacttgtaaaggcctaaatggcctttttctctataaatggagcggaggtggaaaggatcataatagcattccattttctacatattaaacattctcctgctaacaacatgtttctttaaattacccctttcctctagaagtttattttaatatatatacaatggccaagcacaagttatgtgcttataatggaaaacattacagctgcagagagaaaaaaacacttaactagaaagtcaagagactgtgttcaaatcctgactcttccaccaactggtgtttgggtgaaaaggttatttcttatttctcggcctcagtttcactggatcaaataaaggagatgaactaaatgatctgaattccattttagctgagaaatttgaagatctgtgatttaattattttgtttctattgcatctacaagacagcataataaaaaacattttatgggccaggcgcagtggctcacacctgtaattattttgttttgggttttttgtttgttttctttttggcttaacacctttctgaagcacttcgggaggccaaggtgggcggatcactaggtcaggagatcgagaccatcctggctaacacagtgaaaccctgtctctgctaaaaatacaaaaaattagccgggcatggtggcggtcgcctgtagtcccagctactcaggaggctgaggcaggagaatggcgtgaactcaggaggtggagcttgcagtagtgagccgagatcgcgccactgccctccagcctgggcgacagagcgagactccgtctcaaaaaaaaaaaaaaaatttatggtagttgattaaacttactaaattttatcaaccaagaagtgcacattttcatattttactgtcactgaaatcagtatgcatgttacagtggccatcatcttatattcttatgattaatacttttttcttcttaatgatacataaaataattgtgtatcttactatcagtaatggcatcttagatttgaaaaaatgtggtagtaggagacctgtaggatttaattcagtaagtgttatctgagattgttttaaatgatagaaggagcacaaagaaacagagcaaagggttggatttcagtaatataactcagtaagtgacctagagggaaaaggggcttgcattattctatgggggacataagaggcagtgtttaaaatgcttgaacacagttgaataagaaaagagtgatcacatccatatgatggtatcatttgaacttctagacataagcacatgcctgatttacagtggatttattttccagtctgtctggatgcccaggaggaaaagcaagtgcaggcagagagctaagtaacactgcctctagaaaataggaacattcttttagagctaatatccacatctgtagagcctttggaaaccctttatttcagttttttattttgttttgggttttttgttttctttttggcttaacacctttctgaggaggctcaggacaaaagtattcttctgttgtctttaaaggtaaactagggtgtcttggtgccccccagaggacactctgagattcaacagcgatagtctcatctttgaggcacagcattggttggagctataaactgctgtgatcttgtttggagaaaatatgttttttattattgatttgaaatatgttctcttatttttatcctctctccctaccagtcaaaatcctaatttatctttgttattcttagaaagtacattttgactattgatttctactttgtaccaactttctttgttttagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcaggtaatttcccatcctgtgcacatgcacattggccatatgtcctttgaaagaaaagattaaatttcccatattgaagtagttttgttggcatcataaaaatgggattctctaatatcctctaaattattaaatgcagaaatattgcacattgttaaccgaagcttatagtttgctcaatagcagatattgtttatgcatttatttttgatataagggaagttttaattttatacctgaaattttatttttgttcagattcttttatagaaaatacaataatcttttattttacctctattcatatttaaaaatttttatttatatagacagggtctcactctgatgcccagactggagtgtagcagtgctgtcctagctcactgcagcctcagactcctgggctcaagtgatcctctcaccttagcctctgggatagctgagaccacaggtgcaaaccagcacacccagctaatttttctattttttgcagagataggatcttgctatgttgcctaagctggtcttgaactcctggcctcaagtgatcctcctgccttggcctcccaaagtgctggcattacaggcatgagccaccacgtccagccaaaaaaattttttttttttaagaaacaaggtctcactctgtcacccaggctggagtgcagtggcatgatcatagctcactgcagcctttttaactgcttggctcaggggatcctcttgcctcagcctcctgaatagctgggaccacaggtgcatgccaccacacccacctaattaaaaaaaaattgtagaaacagggtcttactttgttgcctaagctggtcttgaactctggcctcaagcgatcctcctgccttggcctcccaaagtgctgggattctaggcatgagccaccgtgcccctcaacccccatataaaaacattctttagttcacaatgttaccttattctttaccttcagtaattaatcttaactgctgttaaaaaaagatttagattttatatttagaaaagggcatttgtcacacaagataaaatattctaactattaaatggcatcagagctttgcttctttgacttctataagtatacctttagtatggcttaatctggccatccagacggtgtcttttcttctttgcttatcactgtctagtatgtgactgggcacttattgaacatttttttaaatgtttgttgattagtgaatgttctagcttgaacggattaatcatccgtctttgtaccacttagctcagagcatcattctgccattagactttgttcctttccaaaactcaattttaaatttaattattctgaagatattaataagaatcaaataattgctaaattagaaactaactttagtgagacttgccatttttccagtttgaaaaacaatagcatttaaagaccactttgtggctgggtctggtggctcaggcctttaatcccagcacttttggaggccgaggtgggttgatcacttgaggtcaggggtttgagaccagttcgagacatggtgaaaccccgtcaggcatggtggcatgtgcctataatcccagctacttgggaggctgaggcaggagaatggcttgaacgcaggaggcagaagttgcagtgagccaagatcgcaccactgcactccagcctgggcaacagagccagactcaatctcaaaaaaaaaagaccactttgtttaataccttgactgtatccttttttgagaagttagttatgtttgtaaacaaatttcatcagcaaaccaggagaatttcatctatgagtctgattttgggggtggaatagggaagaagtctttttctacctttatttttgaattggtttagttctaccagaagatggcattatatccttctgaacagcatttttcaaatgatttgaaataaccttgcattttagattgcaaataaaataaaattagactcatctcaacaaatatttgagtgtttttctaaggaaaaaaagtcattacaatctaatctgtgttaaactggaaaactgcaagttgtttttctttatctttctttgtcttgtttttagggctattcctttgttgctccttccatcctattcaagcgtaatgcagctgtcatagaccctcttcagtttcacatgggagttgaacgtcctggagtgacaaatgttgccaggagtgcaatgatgaaggtatatagatgtggtaacttatatgacatatttgtaggttttgtgagtgtttaaataccaactctaattaatgttcttaagtctagtaattcaactaaagtgcaattttaaaagtgggatatagcaatattttccctagagaattaacgtcaagttgaatgaacttctttttacaattatagagaattatgtatcttaaataattatttagatgaaaatagaagttacctataaagatgaattttagattataaatgtattctattcctgtttattaatattaataattttattttactctacaattttattgatcctttgtgtattactgacattttctgaagttaaatgatgttgatttcttgacaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggtatgaccatttttaatataatattctttcttaggtattcatgaattctgtaaattaaaagatatttattttaattgaaaccagtattatattgtaagactttcttacccaaaggtttaaccacttggctcatcagttggtccattatacttttagctctaattgatattttctgataaagtaatccattttagacataaatcatagtcttatttgcttttgagtttatctagagaaaacgtctttgtgacagtgacatatttaatcaggctcacatagtgattttggcagccattgccatttctactagttgtgtatttgaaatatttttctctaaaattatttagcaagctactgatagctttgagagccatctagttgttttggtaactgatgattattattaagattgcatattcttattactctaaattgtcaggaaagtagagcattcatttcctcatatgatttgtacttttctgactcagaaataataattttctccagaatattactttttctagtgtgtggtataattcattactttcatggaaacctcattacagtatactgtaacatgtatattctgaatgcactgtaaataagacaaaattagtcttggggcagtactgatataaaaactttcttgaagagacatgtggatgctaagtgtctcatcttgcaggatggaagccaatactcaaaaggaaataacagctctgaaactctgtgaaggacaccccaatattgtgaagttgcatgaagtttttcatgatcaggtatcctacttttttttttttttttttcccatgtgtactaattcacttacagggttgtacttttcacgcgttttgttggtgctgctgggtcagagtcagggatatagaacatcacccagccaccagaaagggcagtgaaaccaccctctcaaacccctccccaaccacacactgtttcccaaccccaaatcaggttatcccttcacctctcatgcttttctcactcagcagttaaccacctatgacaggaagacggagggccaggagctcagtggtgcagtcactggctacaatgtgcttgttgccagtgccgcttctacccaccatcacttaatcctggagtacctctcaggactcaggaattttgagcctccaacttccctttcacttctagagtaaaactgagagagcctggagcctaattaatgcaagctaaaggacaaataggaagcagaaagcaaagatactccttttatcttctagctccaggtggtaaattctgctcagaaccctggccagatcatgctgccccctcttctgctctcagtcctgctttgcagcaggaactatgggaggatgccagtgtgtccagttcgtgtctgttcacctcacacatgacagaaattgctccattacacttctctgcccctgagaccaggtggggtgatgcagtcctacttaagacaacttggaggcacaagagcacaaaccaatcctgaatgtgctttgccctaattttaccaataaagaaactgagattttgaatgttcataaaacttgtctaaggtcacatagcatgtcaatgcgaatctaataaggagaacctgtactccagttctgggctctctttgttgtgctgttgtaatatctgtgacctaggatcgatggggcccagttctctaccacattgaaatatcctcgagtgctattgccaggaatgatacatcatggtgagaccaggcagcagcagcagtagcaccataaccataatagctgctgccatttattatcacatatcttgtgtggtctaggttctgtaccaggcactctgcatgtattgtcttattcagtccttaccataggtccatgaggtgagaaaatggacactcatagaagttaagtaacaggtcttacagttggtaagtgtggtaaggctgggatctgaatccacacagtccaacttcagagcccaacaagcttttatttactttaaactactgccttagggaaggcagaatcacatctggcagtaagcatcccaaaatggcatcatcctctactcactctttggttcttgtagtcagaaaagaaatgccactgaagcaaggactcagggggaaccgctctccctgatcctctacctcctcttgcctcatcaagccactcgacacaagaggaggtaatgagtcccctggccacgaaggtgcttaagaagaggctcactagacagtctcctgttgaagatgatatagaggaaattcacatcattcaaggaatcaacgggtgatcttagatgctctcctctgggtttgcagctgtgcccataactacatcccagacaagatacttgatctctgaccttcagactaatgtcaggtcccatgaacaacatttctaattttttatttgtgtcacaaattaagtagatgttttgctatttatatattcaggagttactaaaatataaattgtcacatgatataatcctatacaaactagtataaatacattatcaatctaatatgcagttgtaatgtatcttgggttttctcataatggtggcacagttgcctagatcatccctgtatccagtcttttcttcaactaatgggtgaaattggttatggtgggtcttcagcctttgtgcaatagcatagttcattttgtgtgccatgatatgcgtttcacgtactccatgagtttgctattgctgctgcaacaaatcaccacaaacttaaaacaatacaaatttattatcctgcagtctggaggtcagaagtccaaaatcaggcccattggcttaaagtcaagctgtcaccagagctggttccctcttgagcagaaccaggtgcacagcgggaggtgagtggcaggtgagccagcattactgcctgaactccacctcttggcagatcagcgacagccttagattctcactggagtacaaactctattgtgaactgcgcatggcgagggatcaaagttgcagcactccttataagaatctaatgcctgtcccaccccactactgcctcccctcgtccatggaaaaattgccttccgtgaaaccatttcctggtgccaaaaaagttgcggacctggctcatgcctgtaattccagcactttgggaaggtgaggcaggtggatcacttgaggtcaggagtttgagaccagtctggccaacatggtgagaccctatctctaccaaaaaatacaaaaaattagtcaggcgtggtgttgtgcgcctgtagtcctagctactctggaggctgaggtgggataatccgttgaacttgggaggcggaggttgcagtgagccaagactgcaccactgcactccagcctgggtgatagagtgagaccctgtctcaaaaaaataagaaaacaaaaaagaaaaaaaatgttgaggatcactgctctggaggctctaagggacaacccatttactttccttttgtagcttctagacaccccccaacatttccttggctgtgagccttccatgcatcactctaagatcttgcctccagggtctcatctcatactgctaactctgatgaataattcaggataatctcacatctcaagctccttaatttactaatcacatctcaaaaggcccttttgccatccttctaaggtaacaaccacaggttctgggcattaggacatgaacaactttggagggccatcattcaagctctaccacgcatacattttctcattgctatctgcattttattgataaggatcctagaattaataagataaagtagcatcccaagatcatgaataaataacagaactgaccttcaaatccaggttgaactctaaatctgttcgtacaccactgcaagtattgccttacatcttttttaaagctcaccagcctacagttgtagcagacctgcaagctcaactttatctgatgtagaaactcaagttagcttgatgtctagtaggctgggagcaattttcttgttagaagggttgttcactctgcaatttgtctaatgctttcaggataatgtacttataattgtcttttttatgaagcagtttattctgagttttgctaatacagaaagaaacattttgtttgtgaagtgatgttggccttataatgcatagcacctgaattcagtatattgccatgatatctttttctaaaccatttgtgttcatttgagagctgattaagtcctttgctttttttcttttttgagacagggtctctgtcacccaggctggagtgcagtggcacagtgacggctccctgcagccttgacctcccgagctcaagtgattctcccacctcagcctcctgagtagctgggactgtaggcgtgcgccaccatgtctggctaatttttgttattattttttgtagagatgaggtctcactatgttgcctaggctggtcttgagcttctgggctcaagcagtcctctcaccctggcctctaaatgtgctgggatctatagccctttgctttttgataattcctgtattattttttggaaattatccattctgacagaaaagagcctgggtggagaagaagagaaaggatggtaaacatataacttacaaagtaactattaagataatattgttgggattaaagcaaaaacccatagtgagttatgggtatttgtaatgaatattaacaggaaccctgaaactaatctgttgagtcctaacaggaggttcaaaatgacaatatcaaacaatacctttttaaacttttatgttttaattttttttgtacagacagtctcactgtgttgaccaagctggtcttgaactcctgacctcaagcagtcctcccacctcagcctcccaaagtgctgggattacaggtgtgagccactgagcccagcctcattacccttttaaaaagattaatttgccattggatgggtgtgccaggcctcacgtgggcacacccatcctactcagttgcccattctactcagtcagtattcagattctgtattatttaaagcaagtgacttcacattattgtcacattattgtcagcagtttaaaaagaaagatgtgtaaacttgatagagagggttggagtggaattcaaatgaaagaattagctggatgcaattgcacacctatagccccagctcatcgggaggcctgagatgagagaatcccttgagcccaggaattcaagggcagatttctttttagagacttcatctcttaaaacaaaacactgcaaatgaaagaattcatcacagaagggaaaaaggatatacagtataaagatttcactgcagtacttgaaattttccattaccaaaatagaattataaaacagctacattatctttcagcccttttctctaagatatgaggattgccattgattattttaacaggggattatttaaacgtattggtggtagatagtcaataaatgttttatatgttaatagacttctgtgcttcaggaaggccctccacgttattctttctcttttctagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgaggtataaaatcactggatctcttacgtaattcagtctagcaccattattaaagatctcccaaacatgggggaagtttctggggaggtttccttatttttttacttttcaaggctgttaaatagataattgaaaatacgtttctttgatgttttttcttttatatttcagtctaaaataaatttgtctttgtttattttttgccagctgatcatcttgaggttatatttgtaagtgtgagaaccttttatggaaaaaatactttatgcaacagttgtggactaaaaatagcaatggaaatttttatagcagaaaataatatctcttacatataattttagagggttttttttccaaatgatgtattttgaaaacttattttttacatttgtaatcaaattggttagctcatgaataaaaatgtatataattctattctaaatacttaaagagttgtcttggtttaattagttatgccgtctttctatgtgcttttctatgatcgtgctataatatttatagaactatatgtagcaatgcaaaagtaacagctatttatatgtctcctcttatgaaaggctaataaagaatgttctaactcttagaatgatccctttttagtatcaaaaatatgaaaattccctccttttagaaaatcaacaaaataatgaaaattgaaaaacgaaaatcaatactgtataaaaagataatgatgactcatcctttaccatatacaagattatacatattctctccaaaatagaactttgtttaattatcatgtgattataatatgttctcgagtatatataaaatattatttgatgttccttttgtgattaagccacaaaagattatttctctaaaagcactatttttgccttttacttaggtatcttgaattattagaagaggatgttttaaaaatggaattcttttcttctctacttcacatggaaaagaaaatttttaaaatgaaattctgtgcattaaaatatatttggtttattcctttcatgtatttagacttctatgtattttctattaccattattcacagtactagtaattaatcaaaagtaaattctgttttattaacttgcaactatgatagttcccctctgcttccttcatcatagttctcactctcctacataacacccactgaaagtatggtgctctgtacattggagattagctgtctatttttaaatgtgaaagcacaccacttaaatgttttcttgatagacaaggaacaagcatgtagttttttttaattgaaaagatctgttccatgactgtatagaattcattttcacatgttttattctttgataactggccatctgtcacctcatgagtctcaaatgaggcaactgtcctctcttgcagaatttagatttgcattcctcctttcctgataaaaagataacttatgtagcttaattcttcttatttgttataaggcttttctttcaaatactcacttgaaatggggcagaactatcagattatttaggacattctactgcaattatagtcctaaatcaaactagattttggagaaatgaaaatagacctttgaactaacattttcataataaaatgtctttcactttgacttttaaatggcagtgtatattatttctaaactaaaagtttaatattttcccatgtggcactttaaggtctgattatctatcttttggtaggtagctatgtggattcattttctgcataggcagaatcctaagtctaggtaagagtcagataaatttagaagctggctgacattcttagtaagctgccttgtatttttcaaacttgtcccatactcttctgagattaagaaaagttgcatacatccaatttgtttcaggcagaacttgagatgaggataaaaggggattgaatggttacttcccaccattcctgactaggcacaccctcctccatgtagaactgtctctaactttgagctttgagagaagaggtaggcaagtgagcagtgtttctcaattttacatattccggaataggaggaatggattaaagtcaccaaattaaagtgattgccacatcctctcacttcttctgctttaagaagtgaaactggccgagcgcagtggctcacacctgtaatcccagcactttgggaggccgaggcaagcggatcacttgaggacaggagtttgagaccagtctggccaacatggcaaaacctcatctctactaaaaatacaaaaaaagttagccaggcatggtggcgggcacctgtaatcccaggtacttgggaggctgaggcagcagaatcacttgaatccaggaggtggaggttgcagtgagccaagatcgcaccactgcacgccagcctgggcaacagagcaagactgtctctctcaaaaaaaaaaaaaaagaactaaaatcaaggaagcccttttccaatcttaatatagaataaacatggtcatttccaaagacttagcaggctcaatgaagacaaggccagctgtggttcattcagctgttctgtgtggacagtgccttacactgcaaaggagctcaggtgttacttgctaaaagacttctcccaagcacgcatccatcaaccccagccgtggcttcagtgtcacaaattcaagattaaacaatgtatgctagaaaatttaagacaatttttagttaatgttttgtttttctttccacccactttattgactttcagatggaagacttaggagatttttcttctttgcatcagtgataccatctataatgtgttttatttcagctagaatagtattaacaaagcaaataatattccagagctgggaataatttaatgactataaaggcataatggattttgttaggatgcctaaagacgatataatcagatttcacttactttcagtactagcttaatgtacttattaaaataatttgtgcatcagtaagtattaagcatgtgataaatacaaaaagtagtactacagagtcttagtgatcaagaagccttggtggatgaatgattcaaaataataatgttttctgaatatttgaagtattagctgttggagaaaatatttctgaaatgtaatgggtgtctctaccatgtcttcttcaataggcaatactagatattatatagctattttatttatgactttgttcaatgaacacatgtttaccaaagcacctactctatgtctgtgccaggccctggggtagggtcaaaaataaggtagacacatagtccccgtccttatggaattatgacataatggggatgaagacattaagctagcaatacagaggtggtaagtgccagaaaggaaaagtaaatagtgttaggaaaaaatattaaacgttttaacttcagtttggtaggacagttaggatagtatctctaaatgaggagtagatggggggaggtaggttggcggaggaagcaaaagacaaacacaagcagagggaaaagcttagaaaaagggtctgacatcagaagaggcatggtgcagttgaaaaatgtttcacatgacatggtaaaattgaaataataccaaaaagcatcaagcagagagcagcagtgtattgatgtcctgccctcgcgcctccccatgagacctctctgcacatgaatcaactatcaatatacaaagtgttacataaatagtaccagcaattcccaagacatgcctagtgagaaactaatgtaagcattgatatcttgcagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttggtgagttcttttcaatacagtcattaaacctgcttatttctttggtgtcctctctccttatctcactcttcactgtttccttacattcatgaaaaaattggcaaagtggtttcttttctgtacagccagttagaggcctgactgaatagtatttccctgtcttaaaatgtatattaaagaaaatgtaagaatttctattttggtttattttgaaatatttaagttagctgtgttttatatcaatgagagttaaaggaactatagtatatatttttaaagacacatattatattggacataatgtgaaaatagcaaaatgattcatcaatagaaaaacatttttaaaaaacttctgtgaagtttcagactaaaatgtaattacagaataccatttaagctaaattaacaaataaatagatgaaattagaaatatttctactacgtaacttaaagtaatgtgagcatgcttttcacaaaatgtccttggctgctgtgattagaaatagaacgttaagctagaaaaatcttgtgttttttttctccaaatatcattactttttctgcatataatttgtaatgcatgatcttgggaaattttcagacagtacagaaagaaggagcaaggtgaaaattactcatattcttcacattgagaagtgatatacctcaagctctctctctcccttcagcccctcctcccctttagatatgtaggcttttcatctttccacatgttttctatacatgtatacatatttgaattttttaacaaataagattatattatacctgtattttgagtctctgaaacttatgtaaccatttatttactaataagcagttagctttttttcactttttcactaattataagctacacaaatgaattttttttatatatgtgtttgtgtttgtctcaccatttccttaggatagattcccagaagaagggtatgcacaactttcctttaacatgtgtgcctggatttccttctaaaagatttatcagattatgttctcatcaactatatgggagtacattggctatcagttttcatctgaaatgatatcccattgtgataatttgcatgtgtttctttgatgaatatttagttagagcatcttttcatgcatttgaacattagtattttctcttttatgaattactctttttttttttttttttttttttggagacaaagtcttgctctgtctcccaggctggagtgcagtggcacaatcttggctcactgcaacctccgcctcccggattcaagcgattctcctgcctcagcctcctgagtagctgggattacaagtgtgcaccaacatgcctggctaatttttgtatttttagtagagacgaggttttaccatgttggtcaggctggtctcaaactcctgacctcgggtgatccgcctgccttggcctcccaaagtgctgggattacaggcgagagccactgtgcccagcctcttttatgaattgctctttatgagctttgcccattttcctatggggagatttttcttactgcattttaaagctctattaaagactttcattctttgacgttaatattggaaatgttttttctggtgtgtcacttgttttaaaactttgtttatggtaatacggtattttgattttgtttttagaaggatttaaacagagaagattcttaaatgtctatgtagtaagatatgtcagtctttttctttatgatatctgacttttatgtcagattgtcactccactcctatgcccaccgcaagtttatgaaaatattgtcctaaatttttctctagaattattttgttcttacacttaagtctggaatttattttagtgtcagttgttttcccccaatgactagtcagttgtccctgcaggatggttcttcttttatttttaagttttatatagtttttatctcatcggttttcagtcatcatttataattttcaaactaaacttacatatttgtgaataacatttta

SEQ ID NO: 13380 - DNA, 47064 bp, Human
tgaatccacttttctgaaattcaggaaaaggcagaactatagggatggagaattaactttttaccagatgttaagggtcagggagggctaataggagcagcttgagggagttttagggggtgacaactgttctgtgtcttgattgtgatagttacatgcatgtatatttgttaaattcatagaaatgtatacgaaaagagtgatttttactaaatataaatttaaaaataaacctaaaataacggaattcattattcttgtctcagaaacaagccgatatgtaaacacaacaaccactactctgatcctccatccgtattctctgtcttatgttatcttgccatactactcagatggctcagttaaaaaccatggagtcatcctcaactcccttttcttcctcaccagatatctgttacattcatttggcctctaatttttactgaatcaatttcagaaatatttctagaatccaacttgtcttctatgttttcattgtagtaacttgtttagttcacgccttcagcatctttcctatctctctctctgaactatgtaaaaacaaccttttccttaatttgtttaattctattccttaggatcaagtccaaatttcacagctgcattataggaaccatatgtcctctaacctacctttatagctttatgttctgccatgcatcctcattttggacacacttagtctcttactgttcttggttatgcaaggcttcttcaaaaactttgcctttgcatatattccttctgcttgaaatgcttgattctccccatttctctttcctgtttttcctttaaaataggatacccatgaagctttcagaagtccctaaggcacaattagttgccatatcttcactgctctctcaagatttaaagcatgtattttagtgtactccttacaataaaatttgccaattcattagtctgtctcttcaatatcagggatggcagacagatgccagcctctccttctcttgtgtttacttcataagctaattggtcacaacattgtctctggttggacatggatatgtcctctgaatttaacagaataacatactgggtactcactatctactgttaaactgaagttggcaccctgctttaggcagattttgtgtgtgtgtgatgtgtaagtccagaataggttataatatcagtattttaatattcctataagataatatcaagatatcaatactgttacattgttaaagtttataattcactttctaaaagtaaaactagcacatatattcaaatatgaaatatatttgcatatattttatgtatttataaaataggtatataaatgttaatgttttaaaatacatttgcaataaaactacttaaaaataaagtatacatgtattttagtatttcaaaagaactaattatactggagtactaaaaactgatattgtagtcataattcaagtcctgacccttgtggccatagctcttaaggcaatgccttcagtaagtgaaagaagccagaccccaataaatatttgagatgtgcttactggagcctaatatcatatttcattaaaaataagatacttcaaagctggttatttcttgatctagccagaaactgtaatttagaagactttttttttaacccaaataattcatgattatttcctgacagtaattatgtttcagaaaggttaaaacactgtgggggctagggagacaggaaaggttgttgcatcttagaatcaataagatagggtaaactttgtctttgtttagaccaaaattatttgtttaagatattatttctaaaatatgtggtcattttgctctaatcttgatgtggaattaagggaatgtattctttgtacataattttcagaatgggttttgttgacctgttaatcagtgagcctgaatttagttgctagattaagtgtctcatgttgttttgagagagtgagttatcagtgtctgttttcttttctccttcctttaagatgccatggctagtccagggaaagataactatagaatgaaaagttataagaataaagccctaaatcctcaagagatgcgtagacgaagagaagaagaaggaatacagcttagaaaacaaaaaagagaagaacaggtaggtgtttttagctatttaattttgttttttaaaattttaattatttgctaattattggataattttaaatggaaatgttttaagaaattgaatatagctaaatctattatttattagactccaggcatcataattgcaaatttgtgaaacagaactctgtgctactttagtcactgggagaaatggattttctgttttattgataaacctgttgtgttaattatatttttaccctactgctaggaaatttttcctcttgcatctatttagatcacttccatttgtcattgtaaaatttgccccttaaagaaacattaattatatattatttgctgctttgtagttttcataattcttgcccgtaagtaaattattgtcatcttcccatgctattcatactgttcccccattgtcttattagctggatctctgtttatacttttcatatgtgacataaagaatataaaattgtttaagagagtacatctcaacattttttattccaagatgtacttaaatgtagaagtatttgtaagtaagtaaaataatgtggttctcacacatgtgaattaaaactgatgtatgaaaaggactagcagtgaagaaagtagaaaaggcctattctcttctattgtattctattctattgtattctgtaagtagagatggggtcctgctatgttgcccaggctggtattgaactcctcgcctcaagcaatattcctgcctctgtctctcaaagtgctaggattacaggcatgtaataggcaaggcctatttcagaaatatgataatgatttctcatctccctatctacagcgtctaacacaatccttcatacattatagtaggtactaaaaaaattgtgttgaataaatgattagaaggaagattgtttacatattaaagaagaacaggctgggagccctggctcacccctttaatcccagcactttgggaggctgaggcgggcggatcacgaggtcaggagattgagaccatcctggctaacaaggtgaaaccccatctcaaaaaaattagacatgcgtggtggctggcgcctgttgtcccagctactcaggaggctgaggcaggagaatggcgtgaattcgggaggcagagtttgcagtgagccgagttgatgccactgcactccagcctgggcgacagagtaagactccatctcaaaaaaaaaaaaaaaaagaagaacgatatttatttagatgtcaaaaagaatataagcagattttgttttcctcaaattttgatttaggaaatgtagagttatcccttggttccaggatcctctgcagatatcaaaattcactgatgctcaggtcctttatgtaaaatggcatggtatttgcatattacctgcacacatcctcttgtatattttgagtcatctccagattacttataatatctaatacagtgtaaatgctgtgtagttgagttgttatactgtgttgttttaaaatatgtattattgtcgggctcagtggcttatgcctataatcccagcactttgggaggcctaggtgggcgggtcacctgaggtcaggagtttgagaccagcctgaccaacatggtgaaaccccgtctctactaaaaataaaaaaattagccgagcatggtggcgcacgcctataatcccagctactcaggaggtttaggcaggaggatcgcttgaacccaggaggtggaggttgcagtgagccgagattgtgccactgcactctgtcctggagacagagcgagactccgtctcaaaaaataaaataaagtgaaataaaatatgtattattttttattttcgtattttgttgttgttgtttatttttaagagatggggtcttgctgtgttgcccaggttgccctccaattcctgggcttgtgcagccctcccacctcagcttctcaagtagctgagaccagaggcacgtgctgccatgcttggcttattattttttattgttattattatttttgatctgaggttggttgaatctgggaatgtggaactcacagatatggagggccaactgtacctataaatctcctttagtgaactcaccatgtttctttcttctttttttctgcttcatttttatctgctcctgaattaataagcatagtactgtcattcctaagatttgttttctattccttgttaatcagatatactaaatctgttaatgtatcagatgttatctttcatatgcaacagatgtgctttttaagttttcttgcaaaaattcttagatacctcataatccagtgtgtaaatatgtgcttttttaagtgctataaaatgaccatgtgtattccacttacacgcttactgttggtaaaagatctgagattgaaagtgacgtgaagtagtctgtgcagccaaaagctagcccagaaatttgacttctcataaataccttagatcttcctagtataatgattgggaaatactcaaatattcagaattttaagttataaaattgataggtttcttttgtccactcaaatgaaaacatggaattctatggcaacttaatgttttatggaaagctcaatgtgtaaactgatttctctttattacagttgttcaaacgcagaaatgtctatttgcccagaaatgatgaatctatgcttgaaagtcctatacaggatccagatattagttccactgtacccattccagaggtatactttaccaaaatatgtttcaaattatacctcaataattttagcaatagtatgtataacaaatatttatgcatgcaaaattattcatgtaaaatatgtaaatgttaattatatttttgtgtgtgtgttttaggaagaagttgttactacagatatggttcagatgattttttctaataatgctgatcaacagctaacagcaacacagaaatttagaaagctgctttctaaaggcaagaattattttcagtatgcttatttgatattacacgattttttagtagaggtttattttattgtttttttttaaattttaaaatacctttctttgctagacacaggtgttatattctctgcaaaatatattgtaaagtaacatccgtttttgaacatgatgttaccaaagtaacatatgttgactgtagaaaaatcgtaaaaatataaaagcagttaaagaggcaaatataaaaagattaatcctgctgccaagaaataaggttagagatatatattttttaattcttgtagaaatatttttcagacatgattttttatttttatttgtatttatttattttttatttttttgttatactttaagttttagggtacatgtgcacaacgtgcaggtttattacatatgtatacgtgtgccatgttggtgtgctgcacccattaactcgtcatttaacattagttatatctcctaatgctatccctcctccctcctcccaccccacaacaggccccggtgtgtcatgttccccttcctgtgtccatgtgttctcattgttcaattcccacctatgagtgagaacatgcggtgtttggttttttgtccttgcaataattttctgagaatgatggtttccagcttcatccatgtccctacaaaggacatgaactcatccttttttatggctgcatagtgttccatggtgtatatgtgccacattttcttaatccagtctatcattgttggacatttgggttggctccaagtctttgctattgtgaatagtgccgcaatgaacatacgtgtgcatgtgtctttacagcagcatgatttataatcctttgggtatatacccagtaataggatggctgggtcaaatggtatttctagttctagatccctgaggaatcaccacactgacttccaccatggttgaactagtttacagtcccaccaacagtgtaaaagtgttcctatttctccacatcctctccagcacctgttgtttcctaactttttaatgatcgccattctaactggcgtgagatggtatctcattgtggttttgatttgcatttctctgatggtcagtgatgatgagcatttttttatgtgtcttttggctgcatgaatgtcttcttttgggaagtgtctgttcatatccttcgcccacttgttgatggggttgtttgtttttttcttgtaaatttgtttgagttctttgtagattctggatattagtcctttgtcagatgagtagattgcaaaaattttctcccattttgtaggttgcctgttcactctgatggtcgtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttatgtctaacatgtaagtctttaatccatcttgaattaatttttgtataaggtgtaaggaagggatccagtttcagctttctacatatggctagccagttttcccagcaccatttattaaatagggaatcctttctccatttcttgtttttgtcaggtttgtcaaagatcagatagttgtagatacgtggcattatttctgagggctctgttctgttcccattggtctatatctctgttttggtaccagtaccatgctgttttagttactgtaaccttgtgttatagtttgaaatcaggtagcatgatgcctccagttttgttctttttgcttaggattatcttggcaatgcgggctcttttttggttccatatgaactttaaagtagttttttccaattctgtgaagaaagtcattaatagcttgatggggatggcattgaatctaaaaattatcttgggcagtatagccattttcatgatattgattcttcctacccataagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagagtttgctgaatttgcttatcagcttaaggagattttgggctgagacgatggggttttctagatatacaatcagacatgattttttaaatggtatcatatcatagagtgtgagcataaaataatgtaatcaggcatttaaaatcacaaaataatgtaatcaggcatttaaatttttctcaattttagattaccataaaaatgctacaataattgttaagcaatataaatttccttaatatatattcataaaagtgaagtagggggtcaaagggaatacactgtattaatttatgctcccatcttcagtttgtacaagcattcattttactatttttatgaacattcacaattctctttttctttttttttgagacaacatctcactcccgtcacccagactggagtgcaatagcagaatcacagctcactatagcctctgctttccaggctcaggtgattctcctacttcagcttcctgagtagctaggacgacaggcatgcatcaccacgcccagctaatttttagtagagtcagggttttgtcatattgcccaggctggtctcaaactctcctcccacgtttgcctgccaaagttctgtgattacaggtgtgagccaccatgcttggcctcgcagttatctttaagaaaaaaataaatgcttatataatagtaattcattatttggctttttttttgtaattaggttgaatattttgccttatttattggttctttatagtacataattgcctatttgtgttatttgaccaattttatattgagttaataagaattcatttaaataaaaatttaaatctttgtcttgtgtttcatatatggaatttattgaactcgtaattctaattttatgggattgtatatatgaatgggtaaggttttgaaaacgcccttagctcaactgccttattgtcctaagggagacagagtttagtgacacatgaagaatgaaagtaatcttgtgatcaggtcagcatagattacaaggctttcacttttgctttcttactgtaatttatattcataaataaatttaactttcattttctgttcctcacataccttagcaatgtcaagaaacctttttgcaatcaagaatggcttctttcttcctcacaatacttcacagttttggtttttataattgggattattttctgagtcagattaatatttttaaattgttttttaagtatattccttaaagattttattttgacatacatgtcatactgataacagaatttctttagatttaagagttttagagtttgccaccagtgtttttgtaccatttcctcattattgaattctttatcttgattcattttttattagagcattgcttgaagaattttctacccctttcttacccccattctaggaaaattgcattggtacaatttttttaagcctttatatgtctaaatactatatttctgatatctttgagcaagttgtctgggtatcgaattctttgatcagaagactttgtcctcatttactctaattcctcaaggtattctgtttccgttaaactgtactatctttcacagagacaattgtgttctctgtttcttctttgtaatggaattatgcttgcccagttggacatacagcaaggagttaatagatgttttctttcactgattgatgtgagttcctgccacatctatcaggcctagaaaaataatagatttactgtatttttatttgatctgtcaaagtaggaaatatgggaaagcaagcatctagaggccagaactggaagcagaaacaacaggaaactttgcctcttttgcaggcatttctttattgtaattagtgttcttactgtagacactaggaagatatgaatatgccctgggtactgcacagcctatcttagctccagcttttactcctctgacttaagtctgcgacggtgaccttttgttacatcttctatttatttccttttcgtggccactcttgtggatgtaaatcacaaaccatccttttcttcaatcccagttttgtagaaagttctccaaagcttttttcttttgcctgactcttgcttagttttcagtgctgaaggagatattccccctatactacttattgccataatgactaaaagtcttctcggtagcagtttatcaccattataagattatgtagactatcatcctgtcaatataatactaatagtagttcatgatacctgttagataagctgacaatccaagtgcactttaattgctttcttttagatgaagataaatataaatgtgttgcttttaattcaccgggaagaaactatatttgggttcttatgtgtgtgtgtgggggggtatatatcatatcatatctatatttaatatatatagctgacattctcaatgaccacctcgccctacctaccaaccacaaaaccctatattttcttccttctctctcatctctttcataaagagcaagacaaaatttctgtacattaaatttaaaacaaaataggataatatatttatgatttgctttggaaataaaggaaaaacaagaaagtgcaggtgataattgcaaccctataattttgttttgatttttttaagatggaaggtaaaatgattaagaatacttactgttttatcctgttgatgttttataacagtataagttagggtctggaattcagttttccatcttgaagaattggggcttttcatttagaacacccaaacaaaacttgatgggtataactttactaactgcagaaattttctaaattttgtccaagttagaagaatagcaaatttgtagaaaaatgaaaaggaagaaggaagtctgtttctaagtaaatctttcttaacaattgagaacaaggtttctaggatttgagctgacttaaaacttaatgaaaacatttttctatatcaaaaagaatgatttgtacaggtgttttatgtccaccatttgcttattcatcctactcatcaaacacagtatgttaacattaatatatgagttctttatgatcagtaacacagtcaaatagaggaagtaagaagaaaaggaagaatcagaagtggaaatgagtatgctctttttcatgactacatgaatagataacatagtaatatacaatttaggtggtggatgcagggcaagggaaggaataaccatgatgatataatgagtttgattttgggtatgctgcattttgaaagaagtgtgaaaatacattttaaaaggtgttaaaataaaaatgcatcttatagtcacttaggaatatggtctgaaatctaggaaaggagaattcggttaaggttgtaaggtctgtgaattatcacaaatagtaataatatctggtacttgcattaacaaaaataggtacattttctaagatgagaataaacaggaataagactatcccaaaagaacaccaatagggaagttactgaagaaccgtagagggtacgttttgctgaagccaaggtagaggaaagagttctttatacttagatgaccagtacctgaaatgtctttgtctggattttatataagcttcctagatattttatgattctcaaaagctgtctgcatttcatgaaaatttatcagtaattgtagacagtccgttaacatttctgtaaaaaataattcacggacaaaaaagaatcttgtttgacagacattaggtaaattgtggttgataatgaaggagatatgcttagaaattgagggtagtactataaagaattagtggaaacttaattcctcagttggtattttgagttttagacagaaataatcaatgttttaaaggtgtgctcaatagccttcaatttatgaaatttaaatgtttatgtaggaaatatttttaaaatttcttgcagtgaatgagaaagcggaatttgcaaaatgtacaaaaaacattgtaatctggagaaaatttgacttcaattacatctagctaagggttttaatcttgggtcagggaaacctaggaaagagttattttatgtgccctgttaatggacacagggactagattgttttctttttgtgtctttgtaataactgaagtctttttaaatttttagaacctaatccaccaatagatcaagttatacagaaaccaggagttgtacagagatttgtgaaatttcttgaaagaaatgaaaattgcactttacaagtgagtctaaagttttctttcttaatttttctctagaaatgacatgttaaagtttctagtgaaagcaacttctgcagtattgactattgtaagcattaagtgaatacttggtaattaaaggaaaaggtagtgctgcctatcttgtcttggacacggtttcagtgctagtttttttctaggaattgttattttattaagcaattttggaaaaagtatataaaatcattactaatgttaataaacaatttatagttgttaacctttagtaacttttttgttttagaaaacttcagactaaaatattgttaaatttattttgattcttagctagccagggttctaacttttaccttttaaaacactgttagctgactgattagttctttttttcaaaacagaataaattattatttagtattatctagtagaaatgtgaccagaggtaagtttgtcataaagaacattggttctcaaccatgatatagttacaattttaagatgtcttccaaataatttgctactaatggaaatttactgaagtttgtgaatattttaatgttaaaaaaagattggttttccctacattcattgctatgcatattcttaagtcagagtacaggttggaattttatctatgtatcaggaattgcacaagacatacacctaacttataaatgctattgtcaataatggaggactgttacttgttacgtgttgaatttataacttaagagtagtggtctacttagctgaataatttgagaaagatcctcacgttttaggtgtaagtaaaggaatgtattgcatgtgtgaatgtgaaaaattgttgagaatgtttacaataagggtctctaagaggctactttagtcatgttacagttttattgtcaattattttgaactagagatcatgaaatctggttccattcctttatataagccctaagtccagactaaaacccagacctcttgatacctattatttggctttttaattccaattgaatgaaagaagaaatgattgaatgtgaataaataaaattattgagagctagtttgagcaaagcatcatgtaagatattgtagttccaaaattcagatgttgtcctgtctagagaaattcctcactttctcctgggaaagacagacataaaaaagatctgtggtaacatcatatccttagtgctctaacagagctataaacaaagtactctggggacacagaacatagcaacttactctgtttaggggaagtttaagtttaagacttcacaaaggtagtgttgcaggactagtcttgaggatgaaggagcgtttggcagactgaaaagaggaaaattaatgctaggtttagaggatagcgtgtgtagacagcacagtgtgggaagatttgctgggcgtggtgactcacacctgtaatcccagcactttgggaagctgaagagggaggacctcttgaacccaggcgtttgagaccagcctgggaaaatagtgagacctcatctctacaaaaaaataaaaattagctgagtgtggtggcatgcacctgtagtctcatctacttgggaggctgaagtgagagtataacttgagcccagacgtttgaagttatagtgagctgtgatcacaccactgcactccagcctgggccctgtctctaaataaataaacaaacaaacaaacaaacacacacacactgagaagttgagcatttattaatcactgtaattaaaaactatagaaattcaacagtatggtcttgggacagctacatgttgtgccatgttacccaagtgcttgtgaaatatgttagttaatatgattggtccatctaacaggccttaaattgggggcctacaaacaagttttgttggcctgaacatgttttaaagcgtgaattagatattacatgttaaaaaattgggggatttcaaatgaatatccaggtttttggctccttttaacaaatcagaggtgttggcactgttgtcagatagttaaaaatgaaaggaggttgaataggcattctgtctctattttcttttttcaactggaaagtttaccttttttttaaaattgtagccacacactctaggttttcacagttgtcacttgcttatcactcgttttatgtttaattggttgctggcaggcttctgactttaccagtcttcactaaggctttcttctagggatactagtgacaagtttgtagagtaacctttcagttgtccactagcttatttcattatctacaattggttagaactatggtctccattatttttaaatataaattccctttaaaatttttcttagtcctacacgtaaaagtaactgtactttttaatatttcagtaatgcttttgggtacattttttgttacttataatgacgtgtacgtttacgtgaaaagttatttatgtgaaatattaaaaaaatttttttcatggttaattttatatgtcaaatatgtgaaatattttttaaactatattcactgcttagtttgcctgtggatttgtaggttgttttcagtaattcactagttcattgttttggagccatggttgaattttctcagttgcttttattttaaatccataatgtatatgtatattcagattttaattgagttgatacgataacttctcagagactctgcagcttaaaaaaaatatcagaagtcccagcactggctctgttaataatgaaagcttgatgttgaacaaatacctaatctctcaacttctaatttttttgtttcttaaatagtaggttgaggttacatgatctgtagagaaataagtacctcttatgattctaagtgtcctaaatatactgttgttataagtagtgtctcttatttatttttaaactgcttgctttagaatgcttgcctctgtaataataaacaggagttttatgcattataaattcaaaggtgtttatatattgttgattttgtatattttcattatatttttctcagttcttatttttccatattaaagaatacttttctgtaatcagtgatctttgatgacaattacttttttttctatgagtttttatccttaaatctgacttcacaatgaatcttaatataagtcagtctttcacacttgtcctggcaggtctttactccctctctttccttctttgcctttctgacaattctttggttctttcatttattttaccttttttttcttcttagtttgaagctgcatgggcattaacaaatatagcatctggaacttttctgcataccaaggtagtgattgaaactggggctgttccgatttttatcaaacttcttaattctgaacatgaagatgttcaggaacaggtacgtctctaatttgtattgttgtatgtactagaattcagttttctcttgaaagtaccatttgtaattacgatgtgtaattcatttttgtttctaattgctgtatattgcattaaattgtagtagtgttttggtgttaagttagaagggaggaagaatgaacagttccagacataatcctgggttctctgtgagtgtgatcacagctagcataggaattactattcctgtttataaaagtgcatactgaggctgggcatggtggctcatgcctgtattctcagcacttgggaaagctgaggcaagcagatcacttgaggccaggagtttgagaccagcctggccaacatggcaaaatcccagctctgctaaaaatacaaaaattagccaggcgtggtgccacagctcctcaagaagctgaggcacaagaattccttgagcctgggaggcagaggttgcagagagccgagatcatgccactgcactccagcctgggcgacagagcgagatttgtttcaaaaaaaaagtgtatactgagactcaaaagttagtaacttacctaaagtcacaacgaatggcagagccgggttttaaagctgaactggtttgacttcttgttctctgcatatatgtagattattttgttgtttgttttaagaatatcacattactttgaatagaaccattttttaataaacttaatgaataaagttttgttgtaagaggtaaaatttaattacatataattgtaccatctaaataaaatcaagtcatttaacatttttttgcatcatttttatgtacataaatctgttgttctgtctcccattttattcatcatttcattttatatatattttttcagttaacactaatattgggagcctttttttatggcagtaattattcttccatggaaattttactgattactcaatatctgctcagatatgtaccataatttgccatctgttcaattgttgtacatttggattatttctagcttattggtggtgttaataatattgtgatgaatatcattatatgtcatcactctttatgtaccttttgattattttactaggaaaaatgagtaccctgtcaaaagataaattttttttttttttttgagatgaagtcttgctctcgtcccccacgctggaatgcaatggcgcgatctcggctcactgcaacttccaccttccaggttcaagcgattctcctgcctcagccttccgagtagctgggattacaggcgcctgccaccacgcccggctagtttttatatttctaatagagatggtgtttcaccatgttggccaggctggtttcgaactcctgacttcaggtgatctgcccacctaggcctcccaaagtgctgggattacaggtgtgagccaccgcgcccggccaaaagataaaatttttaaagctcttactatgtatttcaaagtcagactccaagaatattataccaattaagatctccaccaacagaatattatattccacaaggtagaaaatatctttagtttaaaggtttttcttaaaaacaaacaaaaaaatcttaggtctagagtagatgttaaaaatactaacttatgttttaaacattaaaataaaactttcccaattgaaaagtaacatgtctacttttgtactaacatgaaaagtttatggtgagaataaaataaaatgataatttgcatttgcataatttcttacctaattgaaatttaataaatgaatatgtgttctgagaaatacattttcatcattgtgcaaattccatggagtctatttacacaaacctggatggtttatagtatggccttttgcatccagtctacaaacctatacagcatgttactgtactaaatgctgtaggcaattttttttttttttgagacagagtcttgctgtgtcactcaggctgcagtgcagtgacatgatctcagctcactgcaaccaccacctcctgggtttcaagcagttcttatgcttcagcctcctgaatagctgggattacaggcacctgcaatcacacccagctagtttttgtatttttagtagagatggggtttcaccatgttggccaggctggtcgcaaactcctgacctcaagtgatctgcccacctcacctcccaaagtgctggaattacaggcatgagccactgcacccgacctactatagacaattgtatatacagtggtaagtatttgtgtatctacacatgcaaaaggtacagtaaagataatggtgttataatattatgagactaccatcttatgtgcagtctgtcatcgactaaaatgttatgcagtgcatgattataattggaaaatttgctaaatagatgtattttgtctctccatgtaaattcatagtaaactatgctctttgttgaacagtatagatatttcactaatatgcaaggaaaactttttttttttggagacagggtttcgctctgttgcccaaggtggagcaaggctccttgcaacctctgcctcctgggctcaagtgatcctgccaccttagcctcctaagtagctgagatgacaggtgcgtgccaccacacccagctaatttttgtcatttttcagtagagacagagttttaccatgttgcccaggctggttttgaactcctagactcaagcgatctgtccacctcagcttgccaaagtgctgggattacacgcgtgagccaccttgttcagctggaaaactttttaaatgtcctatctttcaatttgaataaaaatattaaattgaattttaaaagtttttcttttctactgtttttttttaacatatcagaaactgttgctttgttcattgtgtactaaaatctcattcctaaaggaaagcctctaatttaaaatattgtcttaagataatttttttttttcctaaggctgtttgggcacttggtaatattgctggtgacaatgcagaatgcagagattttgttttgaattgtgaaatacttccacctcttttagagtaagtactttatcacaattaagtatatatcaaaaactatatactccatgatattctacatacataattaagttcttcagtcatacttgtaaatttgtcttatggttatcaagcctgcagtagcttgacagcaggtagaaccaagagaaattttcaaattgttatctctgtcttttatgttcccttaaaccacacgtaacagtggtcattgcttacttgatgcttactgatctaaaataattattctgcaaaaacaaggatatatagtagtttataatacaataaaatttacatattgctatagtagggaatccttaatacttgaacagacagtatatttaggatgtcagtatgttttaaattttattaaaagaaccaagattttaagatagagatttttctttcaggattagagttttacttcaagtgatttatctagtagtttcttctactactttacgtatttttttaaaaaagaaattaccctataatgtaaggtcctttatagaaatgacataaaattttttgaaatacaggtttatacatattgtttatgattaagaggatctttatgtaggataaatgctaatggcaggtagtgaagaaaaatactaatcgaggagatggctagaagtaaatattttactcttcatttctgcatggaggtgcgttttccatgctctccagctgaggaattgaataggaagaatacatttctagacactagttttcaaaaaacattttactctagctttctgtggacagaagttatttcttggcatggtttcacttaaccaatattaatcgaagatctgtgtacaaaccactgaactactcactataatttcatttattatgggcttaaagttaatggtccatagtaattgagaatttagctgagctataaaagaaagtactgatttagagttcagtatgaatcattttgaagtctgtactattaaaaacatctcttaaagtttcaatttgagacttgtctcacctgatttatgtggtatataaattaactgagcactttttgtttttgttgttctgtctctatgtcattttattatttgttaatatctcaagtaggtagtggtttatgaagtagtaaacatttcttaggtctaatctctttaaatgtcctaaggagtcttttaaccatggctgaaaccaaactaaaaaataaaacaaaggaagaataaccagtacccagctatgtagtaatagttataaaaacaatttcaggctgggcgtggtggctcacgcctgtaatcccagcaccctgggaggccaaggcgggtggatcccctgaggtcaggagttcgagaccagcctgaccaacatggagaaaccccgtctctactgaaaatacaaaattagctgagtgtggtggtgcatgcttgtaatcccagctactcaagaggctgaggcagcagaatcgcttgtacccaggaggtggaggttgtggtgacctgagatcatgccattgcactccagcctgggcaacaagagcgaaactccatttcagataataataataatttccaaaaagggtattaaaaagttggaaagtttcagagtttcattataaaacttcgtcttagaaagtttcaaagtatttaaaaaaataagaaaagtaattaaaaggaagttaagttagatactctctctggagttgggcaaaaggaaaaattttcagcttaaaaaatgattatgcaggccgggcgcagtggctcacgcctgtaatcccagcactttggggaggccgagttgggtgggtcatgaggtcaggagatcgagaccatcctggctaacacggtgaaaccccatctctactaaaaatacaaaaaattagccaggcgtggtggcaggcgcctgtagtcccagctactcgggaggctgaggcaggaggatggcttgtacccaggaggtggagcttgcagtgagccaagatcacgccactgcactccaacttgggtgacagagcgagagactgtctcaaaaaaaaaaaatgattatgcattatttgttgttcacattgtaattcacatttagtaatgcttaagtaaatgtaaaacttattaatgtatcattttatctgtttgagtgatattttaatttattttattagtattcatttgattctcagtaaatgtaaatcttttactactataaactatcctgatacaattttgctgtaatttaactcaactttaatttataatgtagcatatttgtactttctcataataaccccattaatacaaaaaaagaacaatagtatacaacaggggttggccagctttatctctcaggtcaaatctggcttgcttcacgtttttgtaaattaagttttatcggaacacagtcacacctattcatttacttaatgtctttggttgctttcatgctacatcagcataggtgagtaataaaaacgagaaggagggcctgcaaaccctaaaatatttactgaaaaaattgtcaactcttagcatacaaaagcagtataactattttatttctaaatctgttgtattttggggaaatctaacatctatttttaggaaagcctttagaacagaaactttttttagtgtaatagaatacatgtaaccagtttaaccattttaaagtatacaatttagtggcagtaagtagatttacaacattgtacaactatcactgctatctagttccagaatttttttaccaccttaaacagaaacccagtacccattaagcagtcacatcccgttttgccatcaccttgtgccttggaaactacaaatctgttttctctctctatgtatactgtatatatcacataagtggaatcatacaatatattacctttgtgtctggcttcttttagcttactgttttcaaggttcatccatattatagtgaatgtatcaggatttcgttctttttatggctgaattatattccattttatgcatgtgccacattttgttcattcattaatagatggacacttcggtgtgtccaccttttgactactgtaaatagtgctcctatgaacattcatgtacaaggttttgtctcagtactggtttttaattcttgtgggtatgtaaatacgtaggagtggaatttggtaatatggtaattctatctttaattttttagagactaccaaactttttcacagcagctgtaccattttacattgtcctagcaatgtatgagtgttctaatttctctatatcatcaccaacacatattatctgttattctgatttagatcatcttagtgggtgtaagttgactttttcatttctataaaaaagtcattgtcattttgataggggtttcatttactctgtagatcactttgagcagtattgccatcttaataatattaaggcttccaattcatgaacctgggaaatcttttaattaattaaggtctttaattttaacaacattttgtagattttagtaaacaggtcgtatacctctttggttaaatgtattccaaagtattttattcttttttattcaaatgtaaatgaaattgttttcttaatttcttttttgacttgttccttggtagtgtatagaaatacaactaactgatttttgtgtgttgattatttatttttttatttaatttgagacagggtcttgctctgtcacctaggctggagtgcagtggcataatcttggcttactgcagtctgtgcctcccaggttcaagcgatgctcgtgcctcagcctcccaagtagctgggattacagtcgtgtacaaccatacctggctaatttttgtatttttagtagagacggagtttcaccatgttggccaggctggtcttgaactcctggcctcaagtgatacatccccccttgacctcccaaaactctgggattacaagtgtgagccaccacacctggcctgtatgttgatcttgcatcctgcaactttgttgaatttattaacactaatagtttttttgtagattgttgtggatttccatatattagatcatgtcatctgtcaataatgttagtttcattgctgagcataatggcacatgcctgtagtctcagatacttgggaggctgagtagggagggtcgtttgaggtcaggagcctcctgggttcaagcggttctcatgcctcaactctcccaagtagctgggaatacaggcgtgcaccaccatgcctggctgatttttgtatttttggtagaaatggagtttcatcacattggccaggctggtcttgaagtcgaatttgaggtcaagatcatttgaggctgtagtgcactataataatgcttgtgaatagtcattgcactctagcctgtgcaacatggtaagactccatctctaaattttttttaaaaaaagatagtttcatttcttgctttccaagttggctgtgtgaattctttttgttgcacagttgctttggatagagcttccattacaatgttatttagaagtggcaaaaatgagtgtctttgtcttctttcttatctcagagtaaaaactaactctttcaccattcagtttgatgttagctatggtttttgataaatgccctttatcctgttgaggtagtttccttctatttcttttttttttttcgagacggagtcatgctctgtcgccaggcttgagtacagtggcatgatcttggctcactgcagcctctgcctcctgggttcaattctcctgcctcagcctcccaggtagctgggactacaagcgtgcactaccacgcccagctaatttttgtatttttagtagagacagggtttcaccatgttggccaggatggtctccatctcctaacctcgtgatccgcccgcctcgacctcccaaggtgctgggattacaggcatgagtcactgtgcctgacctgtttagtgtttttatcataaaaggatgttgagctcttttaaatactttttgcatccaatgagataacttgtttttttaaattcattatattaatatggtttattattttgattgatatttgtatcttgaagcttccttgcattgcttggttaaatgccatgtggtcatagtataagctgctagattcagtttcctaggattttgttgaggatttttgtatgtatattccgaagaaatattttttcttttgtaacttttgttttgatgtctttgtctttggtatcagggtaatgctatcctcatagaattgatgaggaagtgttctctttttttaaaaaaaaaattttgcggctacatagtagatatgtttatttatggggtacacgcggtgttttgatacaggcattcaatgtgaaataagcacataatggagtatctatgccttcaagcttttatcctttgagttacaaataatccagttacattctttccattattttaagtgttctcttattttttgaaagggtttgagaattattcattaatgtttggtagaattcaccagtgaagccatctggtgctggacttttcctttttgggaagtgtttgattagaattctatatcttgttatagttctatttagattttctattcttaagtcagtttggtagtttctgtgtttctaagtggtttttcatttcttccagcttatctttcttggcttttgatgataatattctcatataatttttttttgttgaagtgctgatagtaatgtctctactttcattcttaattgtagtaatattattttatatatatatatatatatatttttttttttttttttttgagttggagtcttgctctgttgcacaggctggagtgtaatggcatgatctcgactcacggcacactctgcctcccgggttcaagcgattctttcacctccgcctcccaagtagctgggattacaggtgcatgccaccatgcctggctaatttttgcatttttgtagagacatggtttcaccatgttggccaggctggtcttgaactcctgacctcaggtgatccgcttgcctcagcctcctgaagtgctgggattacaggtgtgagccaccgcgcccagccaaattgtagtaatatgaatctttttccttttgtccatctagataaaggcttgtttttgttgatttttttttttttttgggtcaaagaactgcctttttgtttagttgattttctgtagtgtttttctattctgtattttatctctggtcttaactttattttcttcctcctgctagctatgagttttgtttactctaatttttgtaatttctgaaggtggaaggttatctttttttcatatggggtgttaacaactataaatttttttctgagtattaatttcactacatcccttaagttttggtgtgtttttttttttatttatctcaaagtattttctgcatatgtgtgtgtgtgtgtgtgtgtgtgtgttttaactcactagttatttaagagtatgttactctactcatagttctgaattttctagttttctgtctgtatttttagtttcattccattgttgtcagagaagatactttttatgatttcacttttcaaaaatttatcagagctcaagtgatctgcctgccttggtctcccaaagcctcctgagtagctgggattaccggcatgtgccaccaagcccagctaatttttgtatttttagtagaaatgaggttttgccacgttggcccggctggtctcaaatccctgcctcacgtgagccacctgccttggtctcccgaagtgttgggattacaggcgtgagccactgcgctaggcctagaccatgtaagtttttaagtgatacttctttttctttttgagacagaatcttgctctgttgcccaggctggagtgcagtggtgcagcctcggctcattgaacctccgcccccaggtttaagtgattctcctgcctcagcctcctgaatagcagggaccacagacacgtgccaccatgcctagctaatttttgtatctttagtagagatgggtctcaccatgttggtcagactggtctcgaacttttggcctcaggcgatctacccaccttagcctcccaaagtgctgggattacaagcatgagccaccacatctgacccatgtgttacttcttcctgatagattgactttttatcaatatatgatgttcttctttgtctctgaaaacaatttttgacttacagtctagtttgtctcattagtgtaactattcggatctctgttattatttgcatggaaaatcgcttctcggccttttggctaagatcaagtgtattatttgcatggaaaatctttttctatttcactttcaacctatttatgtctttgattctaaaatgagtcatttgtagacagcatcgtagacttatgggttttgttttgttttgtttaatatattctgccagttactacttttaatttgagagtttaattcatttacatttaatataactactgataaatggggacttacttttgccgttttactattagttaagcttttgtagagacagagtctcgttatgttgcctaggctggtcttaaactcctggcctcaagcgattctcctgcattggcctcccaaggcactgggattataggtgtgagccatagcacctggccattgttatttgttttccacatgtcactttttttttaaaataatttatactattgattcctttcttgtttcctttcctatttttttaaaaagtttttttttaatgtaccctaaggagtataattaacactttaaacttgtaaccaccttgattgaattactcgcagtttaccttcaaaattatacaaaaacactactcctatacatatctgtctcacccttcttaagttgttattgccacaaattgcattattatacattgtgtgcccattaccctagatttataatgattttttttttgcattttacttttaagtcatgtagggaaaaaaagaggaattacaaaccaaaaaatccataatactagctcttagagttacctatgtagctatctttagcagtattctttatttctttgtatggttttgaggtattgtttatggccctttcatttcagcataaaggattccctttagctattcttgtaaagccaatctgctagtgatgcctttcctcagcttttgctcatgtgggaatctcactttctccttctgtttggaaggattgttttgctggatattgaagtcttggttgagagcagcactttaaatatgtcatcccattgcctctgtccttcatgatttttgatgagaaatcggctattgatctttatgaggaatctttttacactacgggtcacttctctctttttgctttcaagattctgtctttgtcttttgattacttgtgtcttggtatgtgtctttttgagtttatccttagagtttattcagcttcttggatgtgtagattcatttcttttataaagtttgaaaagttttcagtaattatttcttcagatattctttttgctccttttcttcttggatttccattatgcatatattggtatgcttgatggtattttacagctttcttagactgtgttcatttcttgtcattctttttctttctgcttctcagtttgaataatttcaattaacctatcttagggttgtggattctttcttctccctgctcaatctgctgtcaaacccctatagtgaaattttaatttcagttttatacttacagcttcataattcctatttagttcctttttataatgtctgtttccatagtgatgattctctatttgttgagacattgtttttctagttttctttagtttttttgtgcataggtcctttagctcttttgaacatgttagacaatgaatttaaaatctttgcatagtaaatccaatgtctgtgatttctcagggaaaatttcttttaatttatatatttcactgttaatggaccacacttttaaaatttctttgcatgcctcataatttcttgttgaaaaactggactgattattgtaactatggttaactatggaaatcagattctcctctccttccaggttttcatgttgctgcttgttgtagttatttatttggggacttttaaaattaattttataaagcctctattccttgtcatgcgtggtctctgaaatctcttttcccttaactcagtgggtagctagtggtttgacagcagagagtgctttaaatatctggagccaaaaataaacaaaaagaaaagtctccaggtttttacagattggccctgcattgagccacctcttcaattcttagtcaggctgattacagctatgacttagcactactttactccctgcttgtgctaagcctaaaggaaaactagaagtaaaagcgtaggtctcttcatgttttttctgattgtggactctgccctggacatgtgcatgggccttcagactgtctgatacatgtgggagcttttcacatccctcatagcccaagtatcttactccccacctttccagccaggttttcaacatgtgtcttgtttgcctcaactgtatcttttgttgaggtttcaacatctcattcatttgccttttaatgtttttgaggaccattctttatttacaaagctacttttccaccctgagagaattcccagttatgcaaaacaaaggcaagccctttgcatcagtttttcagggaacctccaaacaggtcaaaacagacaaacacaatttcttggaaacaagttctgctctactccttccagaaccaggaacccacagtgagaactcaggctgctgtcttaaaggttgctgccaggctggggagggggttgcgtaagagtaggttaaaatgccgcaaagctttcctactacatttcagccctttcctggttaaaagttatcttagttgccataaacttttgactatcttcagagttctaataaacttgattctgacagtgtttgcaagtttcttggtgttcctgggagggacaagcacctggagttccattctgcaccatttttgcatatgtcactctaaaacagggatttttttaacctaggttctttgtacttctagcaggtttgtggaggtccttaggaggttaacaaactcctgaaattgcatgccaaattttgatgtatgtgctttttttctaaggtaaggatccattatggtctcaagggggtccacaactctaaaagtttcaattactactattttaggggctctcctatttaaataactaaaacataaagttatgctttgaaaaaaatacctataagtagtaactccttaggagctgagaagaaaaattctcattttaggtactcagtagataccaaggttcattgcaaactaggtaaaaaaatactaagacatactctgttaaaaacacaacaaaagaacttctcttgtcaataggtaatctttatataatttaaaactgtattccttgctttctgaattcatatattattttcatgattaaagaaattaatctggccgggagtggtggttcacgcctgtaatcctagcactttgggagcctgaggcaggtggatcacgaggtcgggagttgaagaccagcctggccaagatggtgaaaccttatctctactaaaaatacaaaaattatccaggcgtggtggcaggcgcctgtaatcccagctacttgggaggctgcggcaggagaatcgcttgacccagggggcagaggttgcagtgagccaagatcgtgccactgcactccagcatgggtgacagagtgagactctgactcaaaaaaaaaaagaaaaagaaaaattaatctagtattctttttaatatatatagaaataagtaaatttcccacggcattctcttaagaattcttttaagaattcagattgtagattcactttagaaaatagaactgtaatatgcttatttagcttgtgaaaacataatgaattttagattcttttttcctattttgctagtttgaatatcttataaaatatattggagagaaattttgtattatgatagctaaagaggaaaaatgaatgtaaggtgataattcttttttttctttttcttggcaggttattaacaaattcaaacagactcacaacaacaagaaatgccgtgtgggccctctcaaatttatgtagaggcaaaaaccctcctccaaactttagtaaggtatgagtaaaatacacaaattaaaatatttgtttccataaacctaagtttctatataatagctttttgatgtttaaggaactccactttttgtttagtaattattttctttattgaccaatgtttgcacatatacagtattcaaaagctttacaatataaaggaagtgtcccttgtacttttcctcacacaccttaaattcctgtgcccagaggcagtcactgcaaccacatgtatcaaggaattgatttcagaaatcttctagtctagctctctcatttataggaaaataagtcccccaaaagattaaataattcctttatgttcaccatttgtactttttcattgtaacttttatctcttaggatatctgtttccctatctactgatattttgcctctagaaatacagatgattaattaattcccagtttagttgtattgtttaagatgctgttaggaaggtagaaagggggtaaatttttagaataccattgtacttcttttgaatttagtatctaaaatggcacaatgactctagcactaagagaagtttaaactttggtaaagatctagtgataaagtttctggggataaaaaataatacatttctaattcacaaaggtaatgcatgaactagtatgccttctcatttttacttttcatttcatttcataagatattcaaaagacacaaactcaagagttgagatttaataaaagtagtaatttttactgcctattcacgttaactcttaaataaaactggctcttccccacccactgcccttttaaccgaggtgaagaatacaaagataggtagtacattttgatactactgccgtgatttgtgctaacatgccaacagttttacctgccagtgtttttgtacctttagtgcaaatgtcaacaaaatgagaaagacgaatgatgtcttagtattattatgaaaatagttttgacatcacatatacccccaaaagggttttaggaatcccccaggggtccatggatcacactttgacaaccactgtcttacaacagtctccttgtaggtagctacttgactgattccctcatctttgtttgcttagaagtcacatttttttatgagctctactgttaccactatttttaataatgtaatctgtcactgtggtaccggtggaaggtatccaagttactggtggcaaatccatatgggtctgcagcaacctcatttcttgcatcctcagaagaaagaattcaactgagagcattaggtagaaaaagagaccaaggcaagtttcagagcaggagtggaagtttatttaaaaggctttagaacaggaaagaaaggaaagtacgcttggaagggacccaagcaggcactgaggtgaagtgccgtgtttaaattaaccttgatcctaggactttatagactggcccctttcccatgattcttcccttaagggtgcgctgcctccatgtccagtgccctccttacacttgggaggtgagcatgagcagtgtgtttaggaagttgtatacatgcccatctgaggctttcttcccttttccaatagtgtgccccccccaccgccagaaagttatactccgtcattttgtctcttaatggacatgcctgagaagttgcatctccttggtgcctgcattcagttaacactttagtgcagcaggtgaggatcatcaggaaatggcctcttcctggcaccggctgccaatttatcacttttaaagatgtaatgtgataattgccaaaccatcacctgacattcctagtgggtgggggagcagccctctcatgccctgcttaagcgtgtctacctactgtaacaactgccctcaccccatgagtatacctgaccttcttcatttttactctgtttctttcaaatcaccttttaacataatatatgtgtttttctatgtcttttaattttttttttcttttttttttttttgagatggagtctcgctctgtcacccaggctggagtgcagtggcacgatctcagctcactgcaacctccgcctcccgggttcaagctattctcctgccccagcctcttgagtagctgggattacaggcgcatgctacctcgcccagctaatttttgtatttttagtagagacagggtttcaccatgttggtcaggctggtctcgaactcctgacctcaggcaagctacctgcctcggcctcccaaagtgctggcattacaggtgtgagccaccatgcctggcccttatttatgtattttaatttttaaaaatcttccactaaaatgtgaactcctgagggaaactttgtctgttgtttacttatgtgttccaaacttatgaaataatatcacattttggggcttaagacttgtttgttaagtacattttctgtaattttatatgagagatttgttttttaatcattcactttttttgaaattttcttttttttttcttctttttttgagatggagtttcactctgtcgcccaggctggagtgcagtggtacgatctcagctcactgcaacctctgcctcccgggttcaagcaattctcctgcctcagccccccaagtagctgggattacagacacctgccaccatgcctggctaatttttatattttattagagacggagtttcaccatgttggccaggctggtgccaggttggccagctcaagctcccgacctcaggtgatgatctgtccatctcagcctcccaaagtgctgggattacaggcatgagccaccacaccaagccggaaattttcatttctacaatcctattttatcttttcaataagtagttgtcttgctctctggttgctcatctttatgtagaattctgttcttttatggacccagcaaattgtcatatctaaggatttatagtgttatttgtttgtttgttttttggcatctttgtttctttgtgctttttttgttttgtttgtggtttgtcttaatcactttaatgttggaggctgtcttcatttatctggtgatttttgaacaaatttcggaagaaactaaaaactgattggaaatgagtgtataaatggacttcattgtaggataattgggcagcaaaaccatattttcttagaggaacactaaatttcagtctcttttgtgagaccattcagtttttttagagacagattttgcattcttttgctggaagatgggtagattgggttgaggtatagagtaggtaacatacctggctactacatatcctgcagctgggcactgtgtctcatgctgtaatcctagcactttgggaggctgaggtgagaggatggtttgagcccaggggttcgaggccagcctgggcaacattgtaagagcctgtctctacaaaaaaatttaaaaaattagctgactgtggtagcacatgcctgtactcccagctactcaggaggctgagatggggaggattgcttgatcctgggaggttgagacagcagtgagctgtgatcatgccactgcaccttgagcttgggcaacagagcaagaccctgtctcaaaaataaaaaatacaaataataaacatctgggaactgagtattgggaaagagctagaggttttcactagtcagtatgcagacttacacttatctcctactttctagtctagtgcttcatttcaacctccactgtgctttatatcccaaagttctgtttctgtgattcacattttgttgtccagtttctccttcaaataaacttccagtctttggtagcattgagaatgctagtcacctacctttgtagtagggacccaaagtctatcctgcttcttatcagatttttaacctcttcctctactttagcaccgtttcccctgctgtctgtgatacctggttcctctgatttctaagcatttggagttgatggtggggagataaattagctttcctcttattggtagttccctctcctggcattaagcttccacttttctcccctcttctaagtcggttactgtttctttattcacttttgtctttatatattgtgggcaggattattaatgtctactggccttttcaaagttggaatttgtatttctgtttctttttttttttcctgagaagatactggggcagaaatgtttttactttgctcacttaatactggaaataggtattagttcattgttttttaactcagcgaaaaggtatatgtcagctatattaatttttttaaacatactttatatttgcttcaaaaacccgatatttggctgggtgtggcggctcatgcctgttattccagcattttgggaggttgaggtgggtggattgttttgagcacaggagttctagaccagcctaggcaacatggtgaaaccctgtctgtacaaaaattagctgggcatggtggctcacacctatgatcccagctactcaggaggctgaggctggaggattgcttgagcccaggaagcagaggttgcactccagcctgggcaacagagtgagaccctgtctcaaaaacaaaacaaaacaaaaaacgaaaaacaaaccctgatttctctgttcaaggaagaggtggttggcaagggtggaagcttgattgctggagaaggatccagttgtgctgattttatttgcccactaacagatagacatacctattatgtaagctaactgatttgtgtacatgagtcctagggtcatctttagatggtaactacttccagaaaatgtggtatatattctgataatcttgaaaatcatctttagaggacaggcccagcagagatggtaactgctttcagaagaggatagtttatatgctgataatcttgaaaatcatctttagaggacaggcccagcagagatggtaactgctttcagaagaggatcgtttatatactgatattctttaaaataggggtaaagagaaaagtcatctaaaatattagaacatttaagaaaaatgtcatcactttttatttgtgagatacataacatataacatagttctttttttttgttttttagtagagatcgggtttctccatgttggtcaggctggtctcgaactcctgacctcaagttatctacccgcctcggcctcccaaagtgctgagattacaggcatgagccaccgtgcccagcttaacatacttcttaactgaggagaaagactaagggatatgttaggttgcttattttaaaaaaacagctttaaggaacatagcatcaatagtgatcatgggaatttaaaaaaagccaacatttgagtgcctactctatgtcaggcactgttcttaggtgctacatgccttcttatcagtgtaatagtttattaatgacttccacttgagtacccttcacaaatatatttatttttgtactttctgtaccttagttcctcaaatgattattagatttatttccagttaagtacatgtaatgagtacagtgaggctcattaaagttagattatattctgtgatcatcatatcaaacacttaactggaacatttgaacttctcagttttggtatgctttttttgtgggggtgtgtgtgatttagacacagacaagagatctcaaatattttactattttttaaaacaaatttaactacatatcttattcaatataacataatagtagtcataatcagcttcatattcatacatctgattataattttaaaacaatataaattttctggtatttttataacattaaatttttgttttaaaatgaatttctatatttttctaaggaaacttggttttaaatagagaaaaaatttaaatatgctctttcttcccttacaggtttcaccttgcttaaatgtcctgtcacgactgttgtttagcagtgacccagatgtgttagcagacgtgtgttgggccctttcttatctctccgatggacccaatgataaaattcaagcagtcattgattctggagtctgtcgaagattggtggaacttttgatgtaactataaataatttatgcttaataattgtatgattgagattaaaattagcaattcaagtaatagctttgtaaatatctcaagagtcactgtcttcagggaaaattaaaaagctactgacccaacacttaacagaatagccataatcctagaaagttgaccctaaaatttggaacttatgtcctatagttggaactaattattttgtaaatgaatttccttagtttaatgtgatctctttatgaattagataaacttaataagtatttatggaatgcctgttatctgctaaggtgttgtgtgagacattaatgaagtatagaacacagtttctcctctcacagaacaaataatctagtttattattcattataataattaatttgagtaaaagtccatgtagtgaaaatcatttagtatttcacctctattaaagataacatgtttctctttgctgggctgttatagctattttccttaaaaagaacagcttttctatacaaagaagttaaaaacgttgaagaaaacttgttttaaaaagatgttgtaacttcataacttcatctacttaccctctttaaaaaatgtattatcttccttcctttcttcttttgtcgagaagccattgtaggcccaaacaaggtagatggcacaaagataggtctgataaggagttgggggtcccagcatgaggatagcatcagtggagggtgggcatgcaggttcagcatgggggatcagggccccaacttgataatgacacccactggggtgagcagataagcaggctggagcaggacttggagccagcacatcatggggtaccagtctggctgaggtaaaagattggctgatatagggaggttaggaaaatagaagctatttcctgttatcggagaatagagataaaaatatagaagaggagaaagcctgaataatttaattattttagattagaactagaaatatcagtgtgaactcatggctcttaacatagctaggtatggaaataaatatatacatgtgtgtaggtatgtgtgtgtgcatcctcttgaagggcatgggaacagtaacacttctacattaataagctgaggaaactgaagttcaaatcgaagtttctaaacactactctccattgaaaggaaccaagattgttggagaaatgactggtttcaggactgggactgagaaaaatgtaagatgaatgcaggaagtaatgagtgctcaagtaatggacagatgtcaaaagaacacagaagcctatttgaaggggttctcactatccaaacctgggacagtttgtgctttgaaataaattgcattaatgtatattttattgaataaaatatgaaacccataagtccacactaaagcatgtagttagaatgatagtattagaaatacatcactggtaataatactaataattaccaatacttcagataataagcatcaagagatgctaaaatctagtggtaaagtaggttaaggagtgggattttgcattatctcaaagtattttgttgcaaaatattaattatattaattataaatgggaaaacaataatggtaaaatggaaaagtctggcagacatcatcataattagtgaccagaattcagtaccaatataatgggaaaaaacagattgggatataatgaaaaggttatagcacttacgatatcccccagccaaagtatataacctgggtcttaatcatgaaaaacattggataaacccaaataatgggcttatgatcttcaaaaatggcaaaatcatgaaaattaagggaagactgagaaatcattctggagagacatgaaaactggctgtaatgaacgatcctggattagatcctttgttataaagattatcagaataattagtaaaacttcaatgggatctttggctgaacaccccgcaggagtttgtagtatttttgtaacttctgtgtaaattttaaattcttactagtatttaggttcatgtttttattatttttaggcacaatgattataaagttgtatcacctgcattaagggcagttggtaatattgtgactggtgatgatattcaaacacaggtgagttcaaacttgagtatcataaattgttaacataaaggactttaaaaaatttatgtttcatacaacttgattacatattaatcaagattttagcatcaccataattgtgtgtgtgtctgtatctgtgtcttggaggatggtgagatgtcaaagaagatgtgctgtcaagattgactccagccagatttgggttacaatctttttatttatttagtaagttagtttagttagagacaggatattgctctttctcctaggctggggtgcagtggtgtgatcatggctcactgcagcctttacctccctggcttaagcagtcctcctggctcaagcagtcctcccgcctcagccttccaagtagttgggactgcaggtgtgcaccaccacacctggctaatttatttatttatttattttttagggacagggtcttgctatgttgcccaagttggtctcaaattcctgagctcaagtgatcctcctgctttggcctctcaaagcgttagacttacaggcatgagccagtatgtccagcacaatctttcttgaagatagaaacttaaattatttaacacgttagattctcctttgtttaccgccttacagtgtattttttattctaacctacatattttctttcagttttatccttttaaaggcctatttggatactaatcatagttattaaatagttgctctttagtaattgacagttattcatttaatatagctcttgaaatgaaaatgccattctagacatatactgtaattttcagttggatttccagtgcactgctccacacttcttcaccagatgaatttaatgtaaatcattggagtattttgaatataggaacataattaatcttgcaatggaataaagaatgtaaagggacaatgcagaatatacttgtttacagaagaagagtaagatagtaaaaatttttatgaagccaattgattctacatgctgtttttaatggttgtagaattggattttctcagactgtatgatatatgtatttttttcaccaattcatttggcaaaactagaggttggatcctgacctcggtcaccaaatcttttttcagttttatcagttgaactctgagaacatttgtaaatatgaaggatacacctctgattttcattttattgggttgagaacagggcagttccttatagtggcaggagactaggtttatcaatagcagacgtgtagaagacagcaagttttactttgggaggaatttctcctttcttaatttcactttctagaatgggttttgtacatctaaataattcattagtagattttcatataggttatttactataaaactttttgtttccatttctaacttgttttaggtaattttgaattgttctgcattaccctgtctcttacatttattgagtagcccaaaggagtcaattagaaaagaagcctgctggactgtttctaacatcactgctggaaatagagctcagattcaggtaactacccttcagatctgagagtagaacagcaaggtctaagaagccagtttggacaaaagttaacacttttactaaaaaagattcctttttaaaaagataccgaaaaagtattttaaagaacatgggctttcctcctctaaaataataacatttacttgtagtattctagtgaagaacatcaagtgtgtgtgtgtgtgtgtgtgtctagcacagtgcctgacacataatggtttgtctttagaaagatatttttttgcattagttttaaataagttatgcaataatcttcctctcaaagcttttaatgatttattagggttctatcaagcttcttgtgtcagtgattacttatccattttgatcagtcacatggcttgtgctttatcatctctaaaatttatattttgctattctccagtctttaaaaagctaatttcctatgtaaaaagaaaaatatttgaaaagtttgctgacagaatagaaattaaaaatttattttaatgtcaaggttccaaaaaccttgacattttgaagccattgagtttcaagattttttttactggtaatattttagaaacagtatttgtactgattatatatttttccccctctcaggctgttatagatgcaaatatttttcctgttttgattgagattcttcagaaagcagagtttcgtaccagaaaagaagcagcttgggctataactaatgcaacatcaggaggtactccagagcaaataaggtatgatataaacttcttaattgttttttacatgtaaatgagacaaaagttgaaataaaacatattttaatttactgatggaactaaaatattatttctaagtcagtttgataatatgaaatgacagcatgtattatatcagttactcattcacaatttttttttccccatttaacgtgtaattaacatcattctccttgataggctgcttaagaaaaatcagagattaaaaaatccaaacgggaacggtctatgttaatttgcagagtacactgtcatgggcattaaatattttttaatcacaaaaatatagctttattatatagaaatggctaataaatttgaatatccacttactttaaataaaattgaaatagacattgtttatatggtgatgttctggtcctcattgattgttagccttgcctatggatagtatcttttatttttctatactagttaccttttttttatattagctttttgagtctaggctttttaaatttatttattctgctgacaatgtaaataataggtgcatgggcttttaagtcagcctgatttcaaatcctgctccttcagtaaaagttgtgtggtcttgacaaagtcatttaacccctctaatctagtttcttcattttaaaaaatgagttccagtaatgaatagttatggcagtgtaagtcagccttccatatccttgggttttgcatctgtggattcaaccacctgcaggtcaaaaatattaaaaaagaaaaagacagtaaaaaatgccagtacaacactacaaaataatgcaaatttaaaaacacaatacaacaattagtaacatcatagcaattacattgttttaggtattataagtaatctaaagataatttcaaatacttggaaagatatgcataggttgtatgcaaatactatgccattttatataaaggaattgagcatctgtggattttggtattgagaggaagggtgtcttggaaccaatctccgatgaaaccgagggactgtatcttgatagttaagtgaaatttatgtctttgaagtgtcagcacagtgcctaaacatattattaataactaatagataattaagaatagctactgttattatttgtaatcatcataatttttattatcagtattgattcctgaatcttttatcatgtactttcactcttttttatctcccatagcaaagtttcacttacacctctactaaaagcttctacagaatcgtcttgttcggaggatccctccatgaaactagacttcttagaaaatattttctaatgcatatttgatttatttttcaatttataaaacaagtcaaactacagtgctattttataaatcacataattttgaaatctacctattgtgaaattgtcgtcttttattgccttcatttgtagtattatcttgctctctcaaatttgtatagctgtatattgctagcatctgtctctgccttttattttctattctatctctttgctttcatcagtatttccactttgtgtcatggatacaagcagtaataaatgaagacccttcctttgttctattttgtatttttttaatgttgatgttacttttattttatttgggctgcaagtttgttcacctgcaaatagttgtattttttcaattaatttttgtggttatatctattctgtatattattgctttaatttattagtatggattaagtatccaaactgagataattatttttctaaccacttttatcatttcattaagtttgcatatttgggaaaagacctcttgatctcagattaagttatgcatccataccactagttgagtgcctactattgccagttattgtgctaagtaagtcatttcagttattgagcaccagcaatgtgtctggtactttcatgtattttatctcctgtaatctcttaactatgaggcagttattcattcaacagatatttttgaccaattacagtacagtatagggcaaatgagtgctctggtgaaggtatatacatcttttttttttaagagggacagaaacttttattaaatgtctattgtgttcttacaactactctctgaagttggtactattattattcccatttttaagatggggaaactgagacacagagtaattgctcaaggtcacacaactaataaggggtggaattgggacttgaaggcacacagcctggcttcatagtatgtttttaacctttgtacttaatatggactttttgccaagtgaacaaatcagttacttcatttacattatagagtacagaaaaccagccaataactagaaaaggacatgcattcagaaattaaagaatttttttgtgaatattatttatgaacattattcacaagagagcctgttttgttcctacaggccttctatccttctgaaacacagtatatgtttcagaacattagctgtgattgtttttatgggaaattttctcaagtttaatttagatgtctcttctttctttccatttctgtctacccccatatgacctccgtgtgtgtgtgtgtgtgtgtgtgtgtgtgtgtgtgtgtgtgtctgtgtgtaggcttgcctttaaaaaaaaaaaaaaacaacctttcgaacctacgtttaatgctcagatgagcaccatgaaaaacaggccgaagtaccagtttgtgtctgtattttatagtctttgcaagaccatttattgctaattatgttaaattagagaataggtgagtaaagaaaattttaagtttcctatgtgagaatttaaatgtgtgtaatgtttgcatttgtataggaatactttttcttaattgcttatgtaacatttcactatgaaaaatatttttgtgtcattgttacaaacagtacttaagtctttttaaatctttttttccctgtttcttctcttttatattaatctgaaggtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtaagcaatcagttaaaaatttgcaattatagtcagttcttatatctgtcatactttccccttccagttccctacaatttttttgttgtaaaagcagtatgtatttttttaagttttaaaatgtcacccgtaattttattaccctaacaatttatttttattatttacctttttttaacattgtctgtatgcacaaatactttacattgacttaattgtattgtatgtatagttttatgttctactttttaacattttggagaaattttacatttctacataatttttattataatggccacataatgttatgtatatactatatatatataaaaatatgtaattttttttttttttttttttgagacacagttttactccgtctcccaggctggagtgcggtggtgtggtcttggctcactgaaacctccacctcccatgttcaagcaattcatgtgcctcagcttcctgagtagctgggattacaggtgcatgccaccatgcccggctgatttttgtatttttagtagagacggggtctctccatgttggctagactggtctcgagctcctggcctcaagtgatccagccacctcaacctcccaaagtgctggaattacagatatgagccaccatgtctggccataatgctacatattgagtcaagttttagccatttgaatggaagtttaaccataacctgttgttgaccattagtttgttcccagtttatcactttatgtataccaaaataagcatctttctgtgtatatgtttatttcttttatggaattaatatctggggataaattttcaggaatacagttgctgagtcttagggcactgacttctttttaagcttttgatgtcttctcattttgctttccaaaggcctgttgctgacagtgtcactggcattgtatgaatctattctacaacctcatacttgttttgtttattttgtggactcagcagatgtaaaatagtacaccaagttgcttttatgtacattttttggtttatttcctatagatagtagtatgtatttttcatgagttagtctgtgtccttatccaaattgcatatttattgtactttgtctggttatctatttgacttttttttttggtaaaaatttgaattttattttatagtagtttattttgatatgactttttcctcggtctattttttttcagatcatccattgaacacattcttttattttaataaaacataccatgttcatttatgtttaaataactcagtctaattttctattctttcaaagtttacaaagtcattgcctccacagagatttgatgaaaattaatttttttatttgccaagttttaaaaattaggttcttaaaacatttaatcatatggaatttattttagataaggcatgaatctaaattgattttcttttatttgcattaaatattcacttttctgtattaagtcctcttacattgtatgggtgattcagacttttatttttgattcttaaagcccatgatatcactttgtctttctttcaaattatataacatcactggataagacattacatgaatacaagatattagtcactgatttaagaatattgtcttactacagtcattattttgaccccgagtcagactagggtttgagctattctgtgattgtgtatagataggactgctttgctgcttttttttctgtgataatctgattgaagtcgtttatctgtaattaaatgaaatgtattttcagcactacccagacttacgtgtagagctttttctgataagcagtaaaatcgattgctatagattcttctcatcttttcaaaatgaggcctttcagtttcaattgtagattgtaattcttttaaaccgcacaacagccatatgttttttattgtatgggtttggaaattttacacatttatttcatagtgatactctctggctcagcgtgttttattttcttcatttaatttgttttgttgctttccctttttgggctttgttaattactctagaaaggacctgtggagttaatctaaaactgccattttacagttgagaaacagaagaactaaacttacctggccaagatcacacacctagcagggtggtgtctgtgatcttactcccaggcctatggtccttcttcgtatgacactgctacatactctcattcttgaagtataaatcgtaagtgatggctatcggtatgtgcaacagttagattaaaatagtcccgttgccagtgaggtgatagatgatgttcacttattattttgatttaaacatatactgaaattgtagtaacagtttgtttatatatatatatatatatatatatatatactttgtataacaggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcaggtaactcctctttgttgccaatgtaagaatgtttgtttttttacatagaacagtaaagagaatttgatgcacttttagaaagcaaaatgaaacaaaaatttccattcagatgcaacctttcattgtagtttgttgttgttttagttttgttgttgtgcctgtatttatatcttctattgtttggatttttgtatctatttgtgaataattgaatatgcaattatttagtaatttaagcttgaaaaggagaattttggtgaagcattacttagtaattctgaattttttcaagcattcttggaaactgcacattagcagtaaacctattgataattgcattttggcagtaagtcttacacatctaatctctactaaatctacctctatcttgaagcagaaataaaaacaaaaaagcttcagaagcatgaaataatgcaaatgctaaattagaatgtgaaaatatttattaccttaaattatacatatcactgtgctgtaggttatactttgcaaaaaattgcaacagaaaacctataaaatttatttataaaacagaagaaatattatactgataatccattaaaatgtggcaattgtgaagggagaagctgtttttcatgttgaacacattaaaaagattactttataaaatgtttaaatatttctgtttttaacatataagtgctatgtatattagtatattttgtatttcaaccaaatatgctaccatttttgaaatagtgttttattgtttttcactcattgttttaaagagcatcatgacagagatgtcatcatgaatctaaagtagtgctgcatatctaaaataataactaattatttctctgatttttcagagcagtaattgaaaagtttcattttctgtataatagtactagtttaagtttaagtacaagtacaagtttaggtactcgaatgacaaaattaccctgaagaaataaccttattatgtgttaaattgtattaaatgcatttaacatttggatgctaaatgataatgaaaattgctaaaggttctttaatatggttcaaatctataagacttttttcttttagtaatactcagagggtcattctgctgcttgttatgaatcatagattacattcatgtcagattgatcaatatgtatgttttatgatttaacagcaaaaacctcttcaaacggaaaatttgaaagaaaggtttcaatagaaaaattatatatatatttatacatatatatgtgtgtgtgttactctcacagttcaactactgttgaactcaatcttttaatttatagttatacgtaggctatttatgtgtccaattgtatacctagaatacttacttaaaacttagtttacaactctttttaagatgagaactaaggcaattttgatatgattcatggtctattctttaaaaaaagatttcatttatgatagtatttgtaatgtttctgctggaaatcagaggcacgttccaagaggaaaatgtatataggagtacttttaaagaatatgtcactttgtaaattacatatcatgaaactaagcttttgacaagatacttaaaacctacagctgtaaaatacaggtttaaatggtgttcgtaatgctgagtgcatctgccagcccttttttattattaagtagaagattgtatctgtgccccttttttcgtagtggaaggtatatagccgagtataaaatggttttcttttgcattatctgtattcaaaaaacagggtagttatattaaagcttaccaaattgatggtgaatttatcagattaacctttttgtggtgcagatggttctaagtatcaggtgacagggtattctactctttctagtcaattaaaattgataatgcagcatgattcataaactaaccagctgtgcctccttttattttgaggaccctgtagtcactataataaatttctaagccaaatttttcaaacaagatagttcttatagaaggagaaataataaatatgtgtgtgttgatgcatgcacacagaatgac

SEQ ID NO: 13381 - DNA, 23946 bp, Human
ctgaatctacctgaacataacagcaatcttttttaaaaaggagtctgtggaatatctcttaaaagaaacacaagaagccagttagcccgtgggtagctggtggacaggaaggacgagataatttttttttttttttgagatggagtcttgctctgtcacccacgctggagagcagtggcgcagtctcggctcactgcaacctccgccccccgggttcaagcaattctcctgcctcagcctcctgagtagctgggactacaggaactctccgccacggccggctaatttttgtatttttagtaggggcggcatttcgccatgttggtcaggctcgtctcgatctccttacctcaggtgatccgcccgcctcggcctcccaaagtgctgggattacaagcttgagccgccgcgcccggccaagagagaattttctatatactttttgtaacttttgaatatagaaccatgtcaatattctagtcaatggtaaagtaaattaaaactagaccaagaagctgggtgtgatggctcacgcctgtaatcccaacactttgggacaccgagacgggaggatcgcttgagcccaagagttcgagacctgtcagggcaacacaacgagacccccatctctacaacaattttttttttaatttagcgggacgtggtggcgcgggagtgtagttccagctacttgggaggctgaagccggagattcgcttgagcccaggaggtccaggatgcagtaggtcgtgatcgcgcggctgcatcacagcctgggcgacggagcgagcccccactcaaaaattaaaaaataaaaacgacgagaggccagacgtggtggctcactcctgtaatcccaacactttgggtggccgaggcaggaggatcgcttgagctcaggagttcagaccagcttaggtaacagagacccatcgcaaaaaaagaacaataataaacaacaagggagcgagaaggcaagaaaatggtgcaaatttacccggatgtcaacagggggcggggccaagcgctgctaccgaagatgccaagatggacgccaggcagccaggagaaagatcccaaccccacccgcgcagatatccgcgaggccccgcgctcagcctcctcacccccgctatccgcggcctccgggtcctcctccgccttccgcttgagcttctgggaggaggggctcaccggcgcgtcccccagcaggtacttatgctcctggccccgcaggtgcttgaggtagcggtccttcagggactgccacgagtgctgcgtgagcgagctcttctccatcgctttccacaaggcgttaccggtgacggagctgggcgagcgggcattttccttcacgtaggtaaggatggctacgtcgtccgcatccgtgaaggcgatccgcccggcgtgccgctgcggctccggctccgcggcgccctcggccagggccccgggctttgcttccgagccggtgtccgccgccgaggcggggcccagccgataggcctccagctccagcctctcgttgcgctccacgcagtccaggatgtactgcgtggagatgaaatcacccgaggcctcggccagcgcctccccgggctgggccagcagcacggccccgggctcctgcactcggcacacggtgccgccgccgtgcaggatgagcgtcgacagccgacgcttggccgggctgggccgcacgtagaaggacatggagctgccgtcgtccctcacgaacagagtcgaggaatgggtgggcccgttggggtctttgcccaaatccatcgcctccgccatgtctgacgccgagcactactagaagagctaccccctcgcgagcgcctggcacacagagctcaactgactgagctgtcaccgcagacgcctctgccgcgaagcgcagcactgggcctgcgcagcagcagccgcggcgcatcgagagtgcccgccccctctcccccggaagaggtggggcttcgcaccttgacctggaaattaacgtactatcctccttacttttgggtcgggccctccgggaagatggcggccgtgcaggcggccgaggtgaaagtggatggcagcgagccgaaactgagcaagaagtgagtgtcgctgcgagtctttaaagcctttgcggtaggagagtctgggctgggaagcgccgcgaggttcccaccaaggctgctgtgccggggccttcttgccggctctcgtgggtacgcacatgctgagacgtggtggctgcgccctgcagaccacgtaccccgggataccccgggcacgccggctccccgttcccagctggcaccggcgggatgctccctatcatactcctagagttaagagactgtggaggaggaactaggacgagaactaagagttatcagaaaagaaaagcgaaacttcctgcttagcttcatcctcctttctgagaaatgcattcttttgttgagccactcagtaaacgtggaagttggagaaatgttaaataccctagcttttcagaaagaccttcaaaattttctgggcctcactaaggtcattctgaacgttatgtattaaaagggatcagttctaaaactgtcatgcatctacccgtatgggttattcagtagatacctgtgagtattaagtgatcaacgtctaacagtagagaccatcttaattcagcctgatatctttgttaaccactcccaaatccctggagtatgtaggttaacatagataagtcaggattagccaccctttaactggctgtcttatattctcattagcgttccccatttgaaccacagaacacaggtaattgagtgttttatcattgctaggaagatggtacatagtaccattccagaggcatacgagagggcttaatccccgtggcgcgcacttgttatcccagctactcgggagactgaggcaggagaatcgctttaacccaggaggcggaggttgcagtgtgctgaagtcgtgccactgcactccagcctgggagacttgaggtagtggtccttcagggactgccagaagtgctgcgtgagcgagcccttctccatcgctttccccaaggagttactgagacggagccagaccctgaatgaaaaagaaaagagaaatgatgtttctttttttttttttttaagatggagtctcgctctgtcgccaggctggagtgcagtggcgcgatctcagctcactgcaaccttcgctgccagggttcaagcgattctcctgcctcagcctcccgagtagctgggattacaggcgtgtgccaccatggctggccaatttttgtatttttagtagagacagggtttcaccatgttgggcaggatggtctcaatctcgttaccttgtgatccgcccaccttggcctcccaaagtgctgggatgacaggcgtgagcctgagccaccacccctggcctgatgtttccttttgtgtccctggctttgtgcttcaaatatcttagaaaaagtataagagaaattgtcgaagtttatagttgggtaggaccttaatatattgtcctttattagagcaatccgatggacttccataaaagtttggaacctggtctttggactgctaccttagagaaaattgacttgactttattaagtcaaatttaattgaatgtggtatatctgtgatatacgatcctaaagtttagttcattctttcaaaccacctatgataatcaattacattgaattgaactttaggactgtatatcacaggtgaaagcacggtttccagttcagagtgtgtttttaggtaaacggaaaaaactggttaattcctctttactgactttttttttttttttttttttttggaggcagagtcgttgttgccccggctggattgcagcggtgcgatttcagcccacggcaacttgcaactcccgggttcaagcaattctggtgcttcagcctcccaagtacctgggactacaggtgcatgccacaacacccggttaaatttttgtgttttagtagagacgggatttgaccttgttgcccaggctggcgtcaaactgctgagctcaggtgatccgtccgcctcaaccccacaaagcgctaggattataggcgtgagccaccactccctgcttcactgacttttctaaaattaaatacagctactacttttttgaccagcttttctgtgccaggcacaatgctagatctctacaagctttctgtctagtgtcagtaataaccttgcaagaggagttattgtccatttttcaaattaataaactgaggtcctagtaattaaatgcactattaaagtgtgcattcctaaaatatagtctagcagtgatccagagcactggagcacggatctgaactcaggcctgtgactccacagtccatgctctgtatcctgactgcacagcactactcacgttgtcttacctgtcattgatgtctattcctctcgttaccatgagctaaaataatttttttctgattaacatttccttccgtttattgttctggggaattccttggtctgaaatttttagtaagcaccattttgtgccaggtattgactccaagtttaaaagcagatgtgctccctgcccaagtgaaatagcctcctcaaatttatttgaacacggtaaagaaggtgatctctgtaattctgttgccttccagtgttgataatgtataaacataacgcagtctaaggaccttcctgaaattctcctttccccttgttcctagagttccaaacaagtcttctctttgacacgtatttttgtgtggcttgcatttatctttgtctagagtttgcaattgatagtgacagtttcctcttattttatatgcttcctattgccatcttgtggccaggtatttcctctccaggtgagaaaccacacttcagggcttcagaaagtgcctcacatcctgttcccatattctaggatgttgtgagcaattttacctgtaagctatccattaacttgctgttggctttaccccagatatgcatgttttttccatagtcaggactaagaacattgtcagttacagttgtagcacagagagtgttacagggttgctatcagttaagacagtcttaagttaaatgggactaaaaggtagtagaagcatggtccccctccccaacccataagagagttggttgggtatatgtatactgtctgtcccatctgacaccacatctctgtgtttcccgctaggtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaaggttggtgcccattaccttctttattgctctggaagcaaaaattatttccttacttggttcattttccgttaagcctctggctaagtctttggacttgttgctaaggaaacaaggagccctaataccaaaaccaatagtcctttctcattttctctttaataaattcaaatcgtctctccttagagtcttgagatgacatgtggatcttattctagaagagtgctaagaacaaaacctttgtttgaacaaataatttctaatgccagctatttcccttttctgtctttctggagttttgtgtgctcttgagattaatttggtttctagtcttagtgctatccctaggacctttttggattatccttaagattgatttgatttaagaggagcacctggttgagtggaaaacagatttatcttaattctagaagaactagacagcctaatcttagcagtccactgactgaattatagcatgataacaccagcacagtgttttggaaaggttgtctttacaaatgttataagacattatatgtagaaaaagctgtcaactttgaaaccattcagaatctgtttttcttttttacaagatgaaagattcggccaggcgtggtggctcacgcctgtaatcccagcactttgggaggccaagacaggcagatcacgaggtcaggagatcaagaccatcctggctaacacggtgaaaccccatcttcactaaaaataccaaaaaaattagccgggcatggtggcgggcacctgtagtcccagctactccggaggctgaggcaggaaaatggtgtgaacccgggaggcagagcttacagtgatctgagatcgcaccactgcactccagcctgggcaacacagcgagactctgtctcaaaaaaaaaaaaaaaaggtgaaagattcaaaacctcaattcattttttaaagttattctaaattcatatcgaaaatgaaggatgtgtcctgaagccagaatgtttgcgggcatgacttgggatcttctgctgtggttcactattgcagaatatttgattatgttcagcggtttgaaagaatgatccataaattgtctttgaatagtaaagatatccctccctacaccaatctgtttagtttctggtttcagatagcaaattcagactataagagacatgaacatatcatacagaacagctcagagttgtccgcattactttggtttttcaggttcaagtgataagtatcaagagtttggataccaagtgatttaaccagaaatgtatttaaatctatatgaggcacagagagtaaagggttaagatactaaaagatacctagaaagctcacatttggttagctgaatgccagggtcagggtaatccctttatacaaacattatctcattacacaccataacaactggtgggggttgtctattattattttcgtttcacaggtgagaagttaattcactcgtccaagtcacataattgacaagtgtgttggaatttagtcccaggcagcctgactacaaagatggtatattaccccctgtactatactgctttgcacaccgttctattttgttgtctaagtcaggctccagtgggcaaagtgagactaatgctgacagccattcttggagagactgttggtaggggaggtctccttgagtgctaaagagccggctcttccttactatcatcctaactcactcttaggggagggatagagagagggggtagcagagggctggagatgttgccttatcatgtattagatctggcattggaggggtcaggtggctcacacctgtaatcctagcactttgggaggccaaggtgggcagatcacttgaggaaaggagtttgagaccagtctggccaacgtggtgaaacctcgtctcactaaaaatacataaattagttgactgtggtggtacacacctgtaatcccagctactcaggaggctgaggcacgagaatctcttgaaacccgggaggcagagattgcagtaagctgagattgtgactgcactccagcctgggccacagagcaaaactctgtctcataaaaaaaaaaaaaaaaaaaaaaaaaaaaaaaagacctggcactgttggaacttcaccttctagggggatactaaacaactaagattcagtcactgtcctcaaggagctccctaacctaattagctcaagaaaagcctattctaattttctagaaaaccttttctcctattcaaaactaatgcataggattttctttgtcttggtacatcttggttttagttgggacctaatgccaaggacctgagactggcaagcagagactgagagtgatttttcacatctttgttctaagcttatttttccctttgtgtctttcacataaagagtttagtgacaagctacttgagctgagctgtgggtgtggaattgaggggtatagaactgagcaagagcgtttctcctgggcgattcatgtttttgataagttgctaggggcagaacatagaggactcttcaggcagctaacacattgaacgctttcatctttccaacagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatgtgagttccctgggccaccagcatggttgggcacaggaaagcttctgatgaggcttctggcagattctttgggactggacagtaggagggaccagtacgcctgaggtcactgccagggataagggagggtctcccactgcatctggttaaaggcacagaccctgagtgttttttatgtcaacccccaaaaggcatttgagagagtccagcattcaagtgaattaaccttccttggaattagcttgaccttgaggccccagggaaagtgtctctctaaagattgcctgaggtttactttagaccaggggctggccaactacagtccaccagccaaacccactctccatgcccccactttatccttccctccctggttttttgtttttgtttttgtttttttgaggcaaagtctcattctgtcacccaggctggagtgcagtggtgtgatctcactgcaacctccgcctccccggttcaagtgattctccttcctcagcctcccaagtaactggtattagaggcgcacaccactacaccctgttaatgttggccaggctggtcttgaactcctggcctcaagtgatccacccgcctcgggctcccagagtactaggattacaggcatgagccaccacaccttgcccctccttggttttactagtaaaattgtattggaacacagctgtgctcatttgtttacgtatttctgaggctgctttccccctgaaacagcagagttgagaagttgcatcagaaaagctttgtgagaaaggctgctgtagagtattccttgtttacattctccaggccccatgccttggggaaaagtctgatgtgtcgccagaggtaggagagtagttaagaacataagcagttaagaacgtaagtgactcgactcaccatgcaaatgtggtctacaaaagtgacaacaaggccacctgtaccaattaaaaattaaacttttatgattttaggcagaactcaggtttttctttttgttgactcttgcattttgaaatgctggcctctggccgccctgcatattttaagtgcaaatctcactccatattcaatcctgtaatgcagaggtcttggttaaagaaaacaatgtattggggtcactcgggggcagaatactgccctctgctaggtgggccccactggtctgaccaggttcaacttctgaagggcttttttttttttttttttaacagcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggaactctccctggcaaatcactgaactcccacagcaggtaggcctgcggcttcagtagcacaagggaaggtctgggttggtcttgttctcaagtagcctgtgtctgaagctactttactaaggacagtgccattatatctatacagaaagaagcagagcagccctgagacatggaatcatattccagatgaggtagtgctacaaagagaggggctttctctataaggattcccttcatcagcaagaatcagcggtagaagtctcaggcttctaagaattccagtctttggcctaagaatgctttgcactgagacagtatttctagaacattgctcttttggagttgtagtatcttgggtgagatcttcttttcctaaatttaaaaaacaaaaaaaaaaaatcacatcttttccttgccctctcccaccaaatagtaaaactatcagttgtagaaaatttagaatagtcaaagaagcacagagagaaggttttgattacgcataatcctaccacccagagagaatttctggcaggacctaaatgcccaaaagatttcttctttaaagtgcagtgattttactaaaatctttttttttttttttttttttgagatatagtctcactctgtctcccaggctggaatgcagtggtgccatctcagcttactgcaacctctgccccccaggttcaagcaattctcttgcctcagcctcccgagtacctgggattacaggcacctgccaccacgcccggctaagttttgtatttttagtagagatggggcttcgccatattgaccaggctggtctcgaactcctgacctcaggtgatccacctgcctcggcttcccaaagtgctgggattacaggcgtgagccgccacaccctgccactaaaatatttattgatgttagttattctagttcagtattctcagatacacagtgtgctctgagatcttttcacatctgtgtattcagatttttttttatttttttatttttatttttttgaggcgaagtcttgctcttgtcccccaggctgtagtgcaatggcgcaatctcggctcactgcaacctccgccttccgggttcaagcgattctcctgcctcagcctccccagtagctgggattacaggcgcctgccaccacgcccagctaatttttgtatctttagtagagacggagtttcaccatgttggccaggctggtcttgaactcctgacctcaggtgatccacctgccacggccttccaaagtgctgggattacaggcatgagccgctgctcccagcagatcttttttattttaattgtttgtttttattctgtttcttgctttacatttcctttgggacttttatctgcatactggatcatcttgattcttttcgataattgtcactttatctcaaatcctttttatctttctttatactttgatttttaaattttatcctccttttcactttctgtttctcttaaggcattatttgttgtatttagtcactattatttccttatagcttagtctgcattttctgaaagattttttactttatttctaattctttcatgtgttatcacctcatttcttagtttttctagttctaatttgtgttctttcatgttttgcgtctttttcttcatgtctttcagctcatttttgaatagtaagttagaattttttgcttttcacggcacgtactcactcataagtgagagttgaacaataagaacacatggacacagggaggggaacatcacacactggggcctgtcaaggggcggggggaccggggagggacagggttaggacaaatacctaatgcatgcagagcttaaaacctagatgacaggttgataggtacagcaaaccaccatggcacatgtatacctatatgacaaatctgcgtgttctgcacatgtgtcccagaacttaaagtaaaataaaaaaaaaaaaaggaactttttgtttttctaagcatgtctgtcttgagtgcttttattttgtctagaggggtgttattctccttctatctctccatttttagttttttaagtaactttatatggtatgtgagcccagtgcttttatgttgcttacatttacatgaaatcagttttcctgaatgttcaaaggaagcacggtttcgtttttccagtgagctccctcttgtttttgtggcatgttcagaaatactgcagcttgttttttgagatttcctggttctcttcttcttcctcactttttttgggtcttctttttttttttttttttggtctcttttttccttgtcctgttagtttttacggtcttgtcctagaagggagcctggctgttgagagggtttctgtgggctctactcctcattccctttagattttttttttttttttttgagactgagttttgctcttattgcccaggctggagtgcaatgccgtgatctcagctcactgcaacctccgcctcccaggttcaagcgattctcctgcctcagcctcccaagtagctgggattacaggcatgcgccaccacgcctggctaattctgtatttttttttagtagagacagggtttctccatgttggtcaggctggtcttgaactcccagccttacgtgatctgcctgcctcggcctcccaaagtcctgggattacaagcgtgagccacagcacctggcctcctttagatcttcttaatgcaaccctcacctgtatggaaacggacacatcccctccctgtttcagctgctctcccccagtgagcctggaggaaaaggttcacattttccagaggatacctttggccatttgggggctttccagttctcagatccctcccataccccatttctccccactgctttttccccgtatagaggtcttatggctcttggtggtttgcctccttgcttatatttgggggtccttggcaacgtcttcccacagcattttgttgtaaattttgtccatggatttttcgcttcgcctctctagctgtgctttctatttttatgtgaggattcagggaaatccaaaaactatgctgctaccagcaccaccatcttctaggcatccagtgacttaatcttgaaagctagatcctgaaagcatgtctttaactggtttgaatggacattgttggtttgagggaaaagatggggattaaacctcaagctaaaatcagattgtactgctttgcattgtgccctgaccaaaaaaaaaaaaaaaatgcaggccgggtgtgggggctcacacctgtaatcccagcactttgggaggctgaggtgggtggatcacttcagcccaggagttcaagaccagcctgggcaacatggtgaaaccccctctctactttaaaaaaaaaaagaaaaattagccgagtgtggtggtgtgcacctgtaatcccagctactcaggaggctgaaacaggagagtcacttgaacctgggaggcggaggttgcattgagctgagatcgtgccactgcactccagcctgggcaacagagcaagactctgtcccaaaaaaaacaaaaaaaaaaatgcagagggagtttttttttgacactgataccataaaatgacttctggttctgtcagtcagtatttttgctcttctttttctaggtaggatccatgccaaaagagcttctgggggaaagctcatcttctatgatcttcgaggagagggggtgaagttgcaagtcatggccaattccaggtatctcgaaatacccagttatagacctttcttggttggcctagagcaacacagcaataggctgatgtggtcttactggtatttgaagttagagtaagaaggagtgggacatggttggggaaggctgagaagaggataatgtggccacctggtcacctgtaaagtaatgactactctcaagttatatgacagtaaagtaaaggatagtccttttttaatagtggcccctgaatctgacgtccttcttgggctcacattaactaggtattaacagttgagtgagggttccagaggagaccagtggtcagtgttcatttgaattgttgttactgaattacatttctttttcactcagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggtaagcgttcttggcctcctagctgtggcctcctagctttctgtttgttttatcatacctttggatcagacataccagtgatttctaactgctgcttttggtttaggaaacaaggtatcgccagagatacttggacttgatcctgaatgactttgtgaggcagaaatttatcatccgctctaagatcatcacatatataagaagtttcttagatgagctgggattcctagaggtaaggagagttccttgcctgacgtgatgagctgccttgcaatgcttgcctcctcctctcccttgccttccttttccaaagcgtatcctgtgtcaggatccttcatgcctaatgagaatgtccccttttcttgccatcgtctctgttctaccttgtcctgattaggaaggcaggacctgacttccaagataatggacaaggtatagggccatccacatgctaatgatgtcacattcaatatgtattcacgtcattttgcttttttgtagcattaagaaatattttttgattatatgagaaaggcaaacacacgtaccataaaacaaattcaaacaataaattaaatagaagcaaaactgaaagtgctctttcactccttctgactaacttccctacccaaacttgagtttgatatgtatccttccacaccatttactgggcatatatacgtatgtacatatgcatgttgcagatggagtgcacatatgtaaacattttggaggagttttatttttggtttaaatatgaatgaagtcacactatgtgtattgtgatggacctgcttttatttcacttaagatattctggatctctttgtatgagatagatagatactctttcttaatgctgcattatttgttccaacaagcatctttatacacatgttcaaatgtttctgtaggatggatttctagaagtagaataagtcaaacaatataagcagttaaaattttttttaaacaatcagttgagataactcactaccttcagaccagcctaaatttttaataaatactgggaattgggccgggcgcagtggctcacacctgtaatcccagcactttgggaggccgaggtgagcagatcacaaggtcaggagatcgagaccatcctggctaacacagtgaaaccctgtctctactaaaaacacaaaaaattagccaggcgtggtggcaggcacctgtagtcccagctactttggagtctgagtcaggagaatggtgtgaacccaggaggcggagcttgccatgagccgagatcgcgctgctgcactccagcctgggcaacagagcaagactccgtcttaaaaaaaattaaataaatactgcaaattgaactcaagaaaggctatatccatttagattctaatttacagcttgtgaaagttcgtggtactatattaatgatattaggtattaatagaaattgagacactgtcgtagaaaatcatagtgtccttttttgtcaagcacttgcacattactgttgaacttattaacatttagtttggggtataacaggcttagactatattacatgcaaagcatggtctgtccccaaggcctctggttatctaaggactgatgtttctccctgccttttttagattgaaactcccatgatgaacatcatcccagggggagccgtggccaagcctttcatcacttatcacaacgagctggacatgaacttatatatgagaattgctccagaactctatcataaggtagtcagtaatagtacacccttttcccttaaagaagcagaaagctggaataccactggctagatgggtatagtcagaaataagaggaacagagagagtaaagcagccaagaaagtgttctgatgggtcaggtgtgtggatgtgagtaacacttccagaatttctctacaagattaatagagcattgtagggcagagaccaaaggggttgtctttcccatgtatacaggcactccttacctactttggttcccctaaaacttttaagataaagtcttacgtggattagatctgatttaagtctttcacagaagaaagagcctaatctgtctgtggaagttggaaataagcatcttcaggcctggcgcgggcctcacacctgtaatcccagcgctttgggaggccaaggcggatggatcacttgaggtcaagagtttgaaaccaacctggccaacatggtgaaacccagtgtctacaaaaatacaaaaattagctgggcgtggtggcatgtgcctgtaatcccagctacttgggagactgaggcaggaggattgcttgaacccgggaggcggaggttgcagtgagccgagatcctgcaactgcactccagcctgggtgacagaatgagacttcgtctcaaaaaaaaaaaaaaaaaaaagtatcttcaaatcactataaagatgtcttgtcaaattcccaggtaaatattgaagattattattcaggattcttagttgcagacaacagaaactgttataactagtttaagcaaaataaaaatttattcagctctataggtgaggtattgctcctcacaagagggcattagctgcgggggtctgcctgcagaccctgacctaaacgatggatgaataaaacgtacactgaaacacagatactctgttttgccagtcctgctgagtgtccgatcacctgcacaccaagagaggtgtatttgtcattgcggccgaccctgagcagctctcactccaggcatttatttagtatagaattaacaacagaagctttgagtaaacacacttgtggataattaacatcgtaagagaggagttctaggaattattaaagtccaggtaccatggtctaaagtaaataccattagggagcagtatctttggtcaacctccccccaagagggccatctggctgaaaggttagttaatggaggtagggtaaacagacttaactggggaagcctctattttccgtagtatttaccctatgacctaatgctgtacggtaagaactggctgccttcagcctgttcagttattacaagctacgtaacctttcggccttccaaaaggtttgtgactattccttataactttccccaatatttccctttaatatttctgccaccatcctgagtgaatcccaacatagaggaagctcacagtccccaggaggatcagagaatcaggcttggaaactatacaactaggaatgattctgagtcatattagaatgggctgttctcatggagaacccagtgtattttcctagtaggcacagttactacagctcataatcctggcactaggcacaagtcattgccgctaggacctctgcaatctaaaagctacgtgtgactggcccccttcaccagaatgaattctatgcaatacccacatcttttgttagtagtttccatgctgaagtctcacaagtgtatctgactggtggagcttgggtcacacgcctgcagcctaaccccaagagaggctgcttccttggggaggttcagactcaatgatgggggatgcccaagacaggaagagtatcgagaagtcctaggcagccaaaaaaggggtaactatccacactacaagggtataaagagagcagggtgcttggcaatttgaccagagacctgagagtatacctaacctgtgaaaaccaagttacggcttttggagactgaaacttcccagagctgttaatacaagattagctgtcatggggccgggcgcggtggctcatgcctgtaatcccagcactttgggaggcggaggcaggcagatcacctgaggtcgggagttcgagaccagcctgaccaatacagagaaaccctgtctctactaaaaatacaaaaaaattagccaggcgtggtggcacatgcctgtaatcccagctactagggaggctggggcaggagaattgcttgaacctaggaggcggaggttgcggtgagctgagatcttgccattgcactccagcctaggcaacaagagcaaaactccatctcaaaaaaaaaaagattagctgtcatgaccgtggccatgtgttgttgttagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcaggtgactcctgctctctctcatactcatcgggtggttggtatgctgctttcagaggagggctgcctggatttcattcccgctaaataacaggtttctctcccagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaaggtaaagtgacaacactcactcctccgttgtaaggccctccttcctgttcagctctgaatttgattgggtcagagctagaatttcccacactattctctttatgtacatttttacttggctagtgtgatgtctcctgccctaacttttgcatttgtgtcccagaaactcgcaaaattcttgatgatatctgtgtggcaaaagctgttgaatgccctccacctcggaccacagccaggctccttgacaaggtgagaaggccctgccttcttgtacatgtcctcatctggtgctgaatggttccctcttccctgggaaaatgaaccccactggggagagttcatttctgcagcttcacaggaaaaccctagagagagaacaagagaattaacagacttttaactgtcatactaagctctgtgccaaataatttatgtgtgtgatctcagttaatcccgtccagcttttaaaaagctatagggtagggtgggcatggtggctcacacctgtaatcccagcacttcaggaggccgaggcagatgaatcacctgaggtcaggagttcgaaaccagcctggccaacatggtgaaaccctgtctctacaaaaaatccaaaaatgagctgggtatggtggcgggcacctgtaatccccgctattcaggaggctgaggcacgagaatcactggaaccaggatgcggaggttgcagcaagccgagatcatgccactgcactccagcctgggcgacagagcgagactccatctcaataataataataataataataataaataaataaaaagctataggataaacccatctggatgggagctgagatcttctgtctgggctgggacgatcaaatactattcagaaatggtgactgactctgctttgctttctcattaagcttgttggggagttcctggaagtgacttgcatcaatcctacattcatctgtgatcacccacagataatgagccctttggctaaatggtaagattccagttacctattgctgcataacagccccaaaacttagtggtgttaacaatttattgtcaagattttgtggtttgactggtggtctttctgctgggtggtgttgaccagggtaacccaagtggctttttttcaactggggattctgccagggcactttggttctcctccacgtggtcactccacatacgatcttatcctccagggcctcttcatgtggcctgtctggcagcacagcctgggcttcccttcagcatggtggttgggctctaaggggaagcttccaaaagaacagacctcattgtgcaaacacgtatcaagcctctggtgataacccattggccaaaccaagacatgttgccagcgcagagtccaggtgaaggagactacacatgggcatgaatgcaagaggtgtggtccattttaacagtctgcccgctggcctgttaggaagatcattaaaccttcctggtctctctcaccctcctcaccgttgtaccaaatgatttgttgctgagactgcatgcaggcttctgactgcaatcagtaacacttttgagtccactagaattcaattattgtattagatgtttgatcgttagaccaacctggccaatatggcgaaaccctgtctctactaaaaatacaaaaattagccaggcatagtggcatgggcctgtgatcccggctactcaaggctgaggcaggagaagtgcttgaacccaggagacagaggttgcagtgagccgagatcacaccactgcactccagcctgcgtgacagagcgagactccgtctcaaaaaaaaagaaaaaacaaaatttagctcattaggggcctctatattcagcctcctctttggtctcctgtccctaggcaccgctctaaagagggtctgactgagcgctttgagctgtttgtcatgaagaaagagatatgcaatgcgtatactgagctgaatgatcccatgcggcagcggcagctttttgaagaacaggccaaggtgagaaaggggactgtgagcagaagctgtgccaactcaccaggaaataccagccttaaccctgatctgtgtcagcgtatacgttcttggtgacttcagaagtgaaagataaagccataggcttgctggaggagtcacatttcaagatggtgacttcatctggtattgagtctgtcgtacataagaggaacttcattattaatctccgtatggaaagcgtgacgcttgccttgaaaatacacttgccaagcaagaacattattttcttagattgtacatgtattaaggtggcttagggctgggaggtaggtagagatgaatggagaagacagaacccccacaggctgcctgcagcaggtgttgacagggctgttttcaggaaatgggagaaagactcttgtaattgtcacagtctctgagaattaacctgtttggagtcccagagccccaagcagcagaagggttttctttcagagaaatttgtatgtgttctgaggtcgatttcatcagtcctgacctccaggtctttgaaagaaacggctgcatcttggagttactaggaaatgaattcccagcaagtcctgagtgtcaggagcatctctggaatgatggtactcccacctcggagcctggtaacatgttcactcacacactgagatatcttagaagaaggtcaccttttggttctctttcctcttctaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggtacgtagcaaccctccacagagcacacttcctgaggaagctgcattgtgttggagccagggcatggtgggcctggaggataaaattaaggaagggctttgggctgggaagaggagcaggcagaggagttccatgccactcacaggagggccagagcctctgaccttaaaggatttgggttttttcctaccaggggcagaaggaatactaattgtttgcatttcttgaggatccagggaagtctccgtgcattatttcagctaattaagtcagccttatgaggtgtagaaactgttgtttcccatttttatagatgaggaaatcaaattttcatagaaatgcgtctattcatccttttgacatagtgccctaggcagtgctatgcatttgttctttgtcatctgtaacttgagagggtctgagttgaaataaaagaacacatgagccttttcagctggaatatactaatctctggattttggtggtaacaacagaggcaagaggaatgggtagatagctgtgaaaaaatgttgagagtgcttctcagcttcaaggtacattcttatctcccacaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataagccatttgtctcttctctttacttttagaatatcaacttttttccccagacttctggcctaatgaatgtttaggattttaccatcttattcatttaacaaatttgtattaatgtctgccctgtgccaggcattattctaagagattggggacacagcagggaacaaaagccaagttcctgcttttgtggaaattgtattctttctttggggtagggagaagaagtagacaaacaaaaaaacaagtaaatacatgttctttctggtggtggtatatactaagaagaaaaatggagcagggtaaggggacagaggtgctattttagaggtggaaggaacagtgctactttatggtggtcaggaagacctctgctgggcatttcagtagaggtctggagactgagctggggaggtctgtgggaaaaggccattcagactaaaggaccatgtttttgaggaatggcagagggtctggtgtgactggacagggatgagtgaaggtcagtgaggggccagatcacgcaggcccctggaagccactcagaaaagtatgtgttttctgagggaaatgagataccatggaaggattttgagcagaggagtgtttttcaaggattattctagtttctgtgtggaggacaagagcaacgaagggagaccagctgagcattcaccatgggctgaggagacagtggctgcgacgtgcatggaccagtggaaatggttacaagtggttgtactttgcctgtgttcctgagggcagaagaatttggtgatgggaatgtgggttgtgagaaaaagaagccaaaaatgatttcaaggttttggacctgaacagctggaagaaagttgccctctactgagatgggaaaaacaggaagttcaggtttcagagggaaggttggaagtttggttttggacatgttaaatttgacatgcctgttagccagatggaaatagcagaatgttgaataatgaatctgaagttttctcattattttcagctccattcaatagagctaagaacgtgacaagggtgtggctgagagcctgccatcaaagtggagcccctctttcctgacacggagacagctgggaagaccttttttcacatgacggaagactttaccttctgcacctcagcaaaacctctgcaagcatcccagtttgggagcagccagtctcctttcacagagcaggtttctgtttctgtagctggtaaaacaacctaagcattcagaattgcctaaatgaactacctcaggcagtgaggaacatccctacccctgctggtgtttaagcagtacgtgaccaggtggcatttcagaagaaacattttcaaatggcacatcctcagaaagggagtggtaactaaaacgggagataatcatctcaccaagggaggtggtggaaggtcaaggacaggtaagggactaggtttcaggtaatactgtcaatgcagacaattgaaaaaggctacaaggattgatgatatgagtgactttacaaagtggtttaatggaaggatggaggcagaatccagctgtctggtcttaaggaggctagggatagaaaggaactgaggcagcagtagacaacttgtatgtgagggttggcaggaaaaatgaccgagtgtgaaagctagaagggacagaagggtcataaagtccccatttctcttcaaacagttgcaggctcacaatttgctaactgctttgctggggtgagcagaaacaggcgtggtctcaaacttcatcaagcatctacacttgtaaagaaaatagatagtaataaatcatcctccaaaattgtataaaatggcagctcaggtaaatggtttgaaggagaggtccacggggtgttgagaagctataatggacatggacctagttagaggaggtttctctgaggacatgagatctgaagggaagaaggctttccgtggtatggcaacaagtgcaaaagccctgtggtaggaagggacatggagacca

SEQ ID NO: 13382 - DNA, 15358 bp, Human
acaatttcataaacattaagctccaggaccagagagagatggaacagtaggatggatacaccgtccagcatttcttggactagagatgaagcctctatcagtcatttccaaacctatgagcaggagatgcctgggggacaaggggactagggaaggtcctcaaattcacatacaaacctggcactgactacagacacacacacagagatgacagtatatttaactttgggggtactttttaggtgctatggtgatacaaaaactacatacatctgttgaagtgttaaaaccagattgaggccgggcgtggtggcacatgcctgtaatcccagcactttgggaggccgaggtgggcggatcacgaggtcaggagatcaagaccatcctgactaacacagtgaaaccccgtctctactaaaaaaaatacaaaaaaattagctgggcatggcaacatgcacctgtagtcccagctacttgggaggctgaggcaggagaatggtgtgaacccgggaggcggagcttgcagcgagccaagatcgtgccactgcactccagcctgggcgacagagcgagactctgtctcaaaaaaaaaaaaaaaaaaaaaaacaaaacagactgagaataactttctgttaatgagaaaatatatcatgagcagatgccaagggcacagacatcatatcatggtggggagatttttcataattttcagtggtgcagatgacgctcttcccatgtctggggaattgcctgcccagagtctgggagagacacaaggcctgggagccgctttcctggcctgccgtgcagctgaggcactggcacgcagcctaagccaggcacacttgcccatgccctggaatggagagccagtgacccagagtagtggggatgtgagcttctccttctctgggggtggagcaatggcagtgagaccaaggggctggggcagtggttgagcgatgctgacaacagggctgatggcacctagtgtttggcagtggcagtagcatcctcttcagacctgtttatggtgtgatttgaggcattcttcctggctgtggaccccacacaagattcactagccctcccagtgactctaggatctaccttcaaatgtttgcataaatttccttttaagtcagcctgagtctgtttctgctgctttacaaagaagacccttactgaatcaccactaagtgctgggggagaggacacagaggacagagggcccacatatttgtttctcaacacattaaaagggggtctttgggccaggcatggtggctcacacctgtaatcctaacactttgggaggccaaggcagggggatcgcttgagggcaggactagcctagacaacacagaatctacaaaaaaaaaaaaaaattagccaggggtggtggtgcatgcctgtagtcccagctactcaggaagctgaggctgcaatgacctgcaatcttgccactgcattccagcctgggtgatagagaccctgtcaaaaaaggggggaaggcaggtgtctttggattcaaaactggagtacaaaaagttaataacagacaatttatttattcgctgcattagaatgtgttgtttactaacttttctcatctctacacaaagccacttctccttctgctgttctttgttcccagcagttactggcccagagtggcacccagagcaggtaccctagacagtgactgaactgttctgaaaaatccaagtacgaattatttgtcaaacaatactccttcctggaaatatgtgctaggtgtaaatcaaaatctcacccagaaacatctaacacctatgacaactgtaaaatccatggaaaaaaaaaagatatgcacatttctaaatgtgctccaggccaaaatctcaatgttaaatggtgaagccatccttgcacaatttcaaaaagttcctgattatggttccttcataagaggttcctctcttcagctcttcttcccttctgaaaaaagaaagccaactttcctttcaaatacacaccccaacccgccccggcatacacagaaatggggactgcgagcagaagcaacatcgctcgccatctgcaaaccaatctcattctattttgtgtcggtaaggttctttttcttctcctccttcattttatttaaatcaactgctatttttcacctaatgcatttatattttaagctccttcagattaatttttaaatgtataacattatgaaaactgcctaagaggataagtttcctttttcccctgagaaatagacaataaaaaaatagctgagaaaaagtttcatattaaccttgaaaagtctctttgctattatgctaattggagacaatctgaccaaagggttgaaaatattcttaaaatcgtaggtataagttatcaataatttaattatcatacaaacttgatctgcacatagaaagcaataaatgattatttgctgaatattttcaaagaacaatttctataaaagtacttttcatttaagaaaaaaaaaactgccatgactccaatagccatcccatagtatatctatttttaaaattctgtctacttctgtttttttatctatgaaagagaaaggatttccaatacatctagtaatctcagatttgcccacacaatttggattatagggcagggaaggggggaaagttcttaattttttctcatctgtgaagaaatatatcaaaatgttaatgggagttatttcaggcaaaaggactatgggtgactttttgcttctacttttaataacctgttttttgctaataagtatatattactttcatagactattttaattagcattattttaaagaagaattcctgtcttttagagatatattctgaaagatgcagataaaatggctgggatttgctctaaaataatatgggagtgagggagtaggtgggaggagaaaagaaacaagattgggtcgaagccatgtgatggcagggggttgactgtactacttcgctactttgatatgttagaaatttgaaatctaatataataaagctttgggctgggcgtggtggttcatgcctgtaatcccagcactttgggggccaaggtgagaggatcacttgagctcaggagttcaagaccagcatgaacaacataatgagacccccatttctacacaagaaaaaaaaatagctgggcgtgatggcacctgcactgcacctgcagtcccacccacctgggaggctgaggcaggaggatcacttgagcccaggactttcaggctatagggagctgtgattgtgccactgcactccagcctgggcaacagagcaagacatttacttacttcttacttactagatagagagacagctttgtttaaatgtcaagaattagttctcttcctactttcaatatggcttttttgtttgtttgagacggagtctcgctctgtcacccaggctggagtgcagtggcaagatctcggctcactgcaagctccgcctcccgggttcacgccattctcctgcctcagcctcccgagtagctgggactacaggcatctgccaccacacccggctaattttttgtatttttagtagagacagcgtttcaccgtgttagccaggatggtctcgatctcctgacctcgtgatccgcccgcctcggcctcccataatgctgggattacaggcatgagccaccatgcccagcctcaatatggttttttaaaataataagaataatctttctattccctccatggaggaaataaatcttcaaccttttcattggatactgtgtttaaaaaacaattcctagaatatgaggattcttaaaagaaatcattcacagaagcaggctgtggtgtgacatatccaaacttctcttttttgttaataggttgcctaactggttgggggagggaaccacagtttcatcacaagttcctgctcacagaggaaatcattacaattggttttctcccacacatagcctaattgggaagaaggtggaaataagtagagatatgaaattccaaagttacaaatacctgtttttatcctatactactagtttttaaagaaaagtgttgaaagtcagctatccccgccaccccaacctctattttttttttttttttttttgagacaagagtctcactctgtcacccaggctagagtgcagtggcacaatctcagctcactgcaacctccacctcctacgttcaagcgattctcctgcttcagcctcccaagtagctgggattacaggcgtccaccaccacacctggctaattttttgtatttttagtaaagatggggttttaccatgttggccaggctagtctcgaacgcctgacctcaggtgatctgcccgcctcggcatcccaaagtgctgggattacaggcgtgagccaccatgcccagcctctattccttttatagagacaggatctcacaatgctgcccaggctggagtgcacgtccagactctattcctttaatagagacagggactcacaatgctgcccaggctggagtgcagtggtgccatcacagctcactgcagcctggaattcctgggctcaatcagcctccggtctcagcctcctgagtagctgtgactaatggccacaccaccacgcctggctctttggcttcccttttaaaaacactacccaatttggaaggctgaggcgagtggattgcttgagcccaggagtttaagaccaggctggccaacatcgcaaaaccctgtctctactaaaaataaaaaaattagccaggcgtggtggtgcacacctatagtctcagctactccagaggctgcagtgagaggattgcttgagcccagaagacaaaggctacagtaagttagccaagatcacaccactgcattccagtttgggcgacacagtgggaccctatctcaaaaataaaaatgtgtaaataatggaatcgtccactttttaaaaataattttacaaataaaaataaaaacattatctgaaagatgacttgagactgagacagtgcttaactttgctaagttttggcagacccaattccattttaaatttccactcagtatatactataaaatgtttcactgtacttgtaaggtgcttgagtctgggcaggagacatgaggttgtatttctcagacttgagagggaatccaatccccttggctggagatggagctgagctgggcctcccacagacacgaagctcagagaagcttgcaggcctcctccaggtgactgcaccctcttgtctggtttgcatttatcaggtcaccacagagctcccagctcatctcatgttgcacaaatactaaaatataacatgatgagaagagagcaaggcgcagtggctcacacctgtaatcccagcactttggaaggccgaggcaagcgggtcgcttgagtttaggggtgcaagatcagcctaggtaacaaggtgaaaccctgtctctacaaaaaatacaaaaattagctgggcacagtgctgcaggcctacagtcccagctacttttgagaagctaaggcaggatgatggcttgaacctgggaggtcacagttgcagtgtgccgtgattgcaccattgcactccagcctgggagacagagactctgtccaaaaacaataacaaaaatgaaaacaaaaacaaaaaaacatggtgagaagagactcgcatcacaaacgccatgattctaactttaattcctctgctgttatgaatggggatccataagagaaacgctaagagaaaaaagcccctgtctgaaaattaagcatcagaccacttggatgacttttcagtttcatttacagtagcaaaggacaaactcacacaaataggaccatttgggaatatatgaccaggcggaactcagaccaaaaacttgacaaattccaatttgtctcaaccaatactattttacctatggcctcccctgccgcaaaagaagggtttagggcgggtctttccatttgtgcactcgagtggctttccagcttcacatgcctgggatataaaggccaaggtgggggactcaatcctcataacttggaagagcaccacatggtggacagtacactggagtgggtgactaatcccagctctgtgaacaccttgtggctagacgtccacaaccatctctccaacagccatctgacactgtgggaacagtagcagtggcggctgcagcagcaatcgctcccttgtatttaatacttactatagcttaggcaggtaaacacttcctaggcatcatcttgaacgtcacactaactgcatgaggtcaacaatactatccccattttctaatgaggaaactgagatactgagattataatgctgggaacaggcagagctaggatttgaactcaagtctgtgctctttatcacaatattgttaattaaataagataaatgctacaagggcctacaaagcagcacacacgccagggagaaaccaaatctgcttagctatggcctggcgagctcatatggtccctgctcagtaatcaaagacatggtaggctaagccagggctgcatttccacaggtgtacatgttgccttttatcatgtttcccaaagggacaccaggctcacaaagaaacaattgtgaatggccatgaattcctggcgatctcaactcccacaaagcacaaacatcgctgctgctcataggctccatcagcggcagcaacgttcgtctggggacacaggttaccacactgaacacagcactctggggaggccagggtgcggacaagaaagcaggcaggagattaagtgattggatcgaaggaaagcttgtaaggagcaagagtcacagatggaccccaaacttctgagtccaatacggtgccacctctatgcaggcctcctgcacagggactctgttcccctgaagcctctctagggctggcctccagtgaacagacatcatgtgacccagcaggtcaaggtcagaaaacaggaggagttggggcaagtgaggaccactggtgtttatttttagtcttatttatattgggattaaggtaagaaaaataacagaatggctgggtttcctacctcaaaaatataataaaagcacaaagtgaggtggcaggcccattaacccactcatctgcttcctcccacaggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaagtgaggcagacaagttcacagtgagggaggccctcaaagaaaaccaagtttccctcactgtaaacagagtgacttcaaatgacagtgcaatttacatctgtggaatagcattccccagtgtgccggaagcgagagctaaacagacaggaggagggaccacactggtggtaagaggtcagtcagcgaggctttatttcagtgcatcattgcatcttgttcaggcctgtaaaatcattacctcactcacatgtagaaatcaggagataaatttgctaagttaataccctagccagtgatgggtgtgatctgaacacaagtcaccatgaggtttggactaaagaactactccaactggctgggcgtggtggctcacacctgtaatcccagcactttgaggctgaggtggacgaatcacttgaggtcaggagttcaagactagcctggccaacatggtgaaaccccatctctactcaaaatacaaaaattagccgcgcatggtggcatgcacctgtagtcccagctgcttgggaggttgaggcaggagaatcgcttgtaacccaggaggcgaaggttgcagtgaaccgagatcgcactactgcactccagtctgggcaacaaagcaagactccatctcagaaaaacaaaagaactactccaatccatctcgaacatccactaacacaaagtcagtgatttgctgggtgctctattctccctacatggtgatgtttaaccaaccatgttcacctcttttgtatattacagtgatttagtgtaaagtaccatgtccaaagggaaccttgtggtgagtaactatcagctttctcaggaactagtctggtaatgcaccacctagaacaaagcactagagaagtgtaaaagatcaataaattggacccacagaaactatgcaacatggagaataagcacagatttggagagaagctactcagggatccctgacccttcccattctgcctggacatcagtgaacggaaagtgatgactctcacttcctgagatttgataaaacccatgacaattcctcagccgagcgaggacatcaaacatagctaaatcctatcagtaatttcaccaagtcattcccttgagtaaactgagattaagacattcccgagaaaaaaaaaagggggaatttcagagaaaaagctttacatgattctgaaggaaaaaagagaacagcagcaactcctcgccttgttggggtctcttcccttaggaaggaccctggtatgatgagcagagattgttaaaacatgaactcaaaatcaaccagcccttcgatttcaaaataggactctgaggaagggagaccatccagtattataacctgtgcttttaaactacgagggttctaatgggcttttgatattcaaatgtcatttaaccttagtttattctcatctgtcagctaaattataaataagttaaggcacttaaagcatttttaatagtgcctggcatatagcaaataacaaatgttagctactgatatgaaaacacacacagctttagagatttgtatgtctcactgcattagccttctaaaaacatgttagtcaaagggaaaaatggcttgtaaaaagatgaaggtctcaaagctgcaaggcttatataaagtgaagtgaaagtgaaaggcagaattgaaagtgttaaggcagacatggcaacttcctgtctcttctacagaactcctattttcacactgaagcttttttattttagttgtatagatgtggttaatttgttagtttcacaaataaaaatgtatgctgcataaactgcattcacaggataagcatctatgggatttttctttctttttttttaagacaagagtcttgctctgtcgcccgggctggagtgccgtggcgtgatctcagctcactgcaaccaacctccaccttccgggttcaagcgattctcctgcctcaacctcctgagtagctgggattacaggcatgtgcgaccacgcccagctaattttggtatttttagtagagatggggtttcgccatgttggccaggctggtgtcaaactcctgatctcaagtgatctgcccacctcggcctctcaaagtgctgggattacaggcatgagccatcacactcagtctcatctatgggatatttagttggaaagtacaggctattcagacagtaagtacaaatctaattgtattttgtactccaaatagtcaggtaattgaagacatggcatgttacttaatccctacccagagcacaagacaatttctgcaaggagagagaaattccgaatgtgaaaatggattcaataactctatttccagaattttatcataaagaaagaagagcacatttggcaaaagtgcctgtctttcaagcacgcagtgagcactgcgctcctcaatgtatggccttcccaggttctttcacagatgggactcttcagctatgtgtactagttccaaggctataaatatcacccttaacaaatacatatgaaaatatcttaaccacataggcagactcttgatgatactggtaaaccgtttctaccaaaagagattttagatgcccttgaacaaactgtctggaaatgtttatctaacttcaaataatcctttatctaaaaagtgatgcttagcaatatgacaaatggttggttgaatttttttaatgtttaaaaacgagtaacatttttggtttaacacatttaaagaactgatgaactggctttaactattacatacttgagtaccttttgaggtctagtttttatacgaataggcaagcagagtaagttcacgtttcacctctaaaacgcagtgtgaaggatactttacacatgtatttgaaagaataggctttaatagtcaatgtgcttctttctgtttttgtcattaagaaattaagctgctcagcaaggaactgcggagcttcctgacagctcttgtatcactgctctctgtctatgtgaccggtgtgtgcgtggccttcatactcctctccaaagtaagtcaaatcctcttgcatggaatgtccctatatccttgaatattatcaaaagaaaaataatttctatctctccacaagttatgggcctcagcaagagctccctaattaacattttcctgtgcatctgcagggaacaccacctgcagaagaggtctttggaagaaggcatcatacattctcatcactgaaattattagccaggggacatagtttgctgttttctctttaaagcccagtagcatgggattaagaagagagccatccactatgctatctttctgctgtaggggtgaggtgtgggcaggtggagggcgagatattactgttatctacgaaagccttaagaacagtctttaagaacaaaaatgggttgatgaagaaactaaaagccgccttaaaatcttcaaaaagggctaaagttattaaaaaagaataccttttggctatgtgtataagaagggagatgtataccattgtgttaggattactataaatcctacaatcaacgtcagtttgttcaattagtttttaatggagtaaaagcatctcaaaaatgatgtaaaaattaagtctcattgtatatcacttaaatattaagttagtttaatcttattagggcatgagatatctgccaccattgttatgagtacataaaatgtttcatagactttccttctcttcttggcagtcaaaatccaaccctctaagaaacaaagaaataaaagaagactcacaaaaggtacagaccaacacttgaaaaatattttttaaattgtggctggttgtaacgatttcaaaactgaaatattttttagcttttaaatatttaaatgttaagtttaaacagaatatcaaggtaactttcaactgcagacactatttcctattgttgagaaactcaatgacaaaataatctcaaggggtaaactgtgacttaaattggacagttctcaaccataaattatatttaaagttctcaaatacaaaagagttaactgtaggcacatatgtgttgggggagggggtagtttttgggaccggtggcaatagagcaagaaaagttctgatgatgcgtcgttatcatcgcttatattcccaaaagagaatttttttttctcatttgtctttatagaagaagagtgctcggcgtatttttcaggaaattgctcaagaactataccataagagacatgtggaaacaaatcagcaatctgtaagtgtaaaatgtcaaaaaaaaatgtaaatacagatataaagcacgtttgaaaaaactaagctgccaaggagctgtcaagaaccatgttttccttcagaagagtctgaaagagaactttcacaagaatgtatttttatatagaacctgttttaataaatacataacaaaagacatctgatacaatattaaatagccccaggctggcatcttagtgacatggaaactttcagaaacacattagacacgagcaatgttttcaatacagacaatgatgctttaaaaggatagattaaaagctactctgtacagtatcctgcatgcagtggtaggcgttcagtagatactgcaaatgtttgtgggtcaaattatgaaaaaaaattacttgttacttataaggcaaaaataaattcacattagaaaagatgcagctaatgatattaaaaaacaagtatttctccagtgtctggagttgaactgaaaagaatacatgtatatctataatacatcctgaaagtattcctttaaagtcttatataaacaggttcttcaaacaaaatattatcttaatgccaatagaacagatactttgtttccatgatgcatgatgagatagctcaaataagctaaaatgtatacaaaataaggttaatttatttttatttattttttaaaatttatggaatgcttcacaaatttgcatgtcatctttgtgtaggggccatgctaatcttctctgtatcattccaattttagtgtaagtgctgccaaagcgagcacaaaataagctgaactgataaactagtaaagatattttcctcttaaacagcagccaagagggcaaatgcatcaggagactgaaataaggcgatttttttaagtccaacttttactttaattgttttctttttaaaaaaatatggaacgcttcacgaacttgtgtgtcatccttgcccaggggccatgctaatcttctctatattgttccaattttagtgtatgtgctgccaaagcaagcgctaaaaatctaactttcacaaaggatttttgccaaggaaagaatattgtctaagtagtcgtttcatcctacagtgtatatatgaatacataaagataggtggtctaattactaagatgccatgctgagtaattacaaatcatttttctttctgaggctgggacatgttttcaacaacaaggccgaggtatgtggcctgaaagcagtcttagaagtgagaattgtaaagctcccagccacgattttgacagtagcatccaaacaaaaaaaaaaagtatttttcagttcccacatcctactctaaatacggatggggaaaacggtaatctggcctttaagattaccatatggacacttaggacccagaatccaagatggcccagtggtttgcatgttccttggcagttggcttcattggttacataaccttaaacatggctttctatttatttattattgcaggagaaagataacaacacttatgaaaacagaagagtactttccaactatgaaaggccatagaaacgttttaattttcaatgaagtcactgaaaatccaactccaggagctatggcagtgttaatgaacatatatcatcaggtcttaaaaaaaaataaaggtaaactgaaaagacaactggctacaaagaaggatgtcagaatgtaaggaaactataactaatagtcattaccaaaatactaaaacccaacaaaatgcaactgaaaaataccttccaaatttgccaagaaaaaaaattctattttaaacttgtatcctgagtctgtttcattcaacatgagatgtgtgatgactgccatcctgaagatctgaagccaaaccatgtgcctcagtcttgagtggaagaatcacctttatggtttgtggaaatcatggcacaattaaaataagttgggagggacaacgtgacaaaatttgagttagagacattcattttgaaaagcaccttagtaaagttatttcctctgatgttgtaatggggcagtggggtaacgcacatttgcctgccagggtatgcaaagtaacttacatcatgctatcagcaaaatgagaataatatagtggctagagtaagaccataaaagccaaaatacagaaaatccaaagctgaaggttaaacagaggtaacttcagaacaaataagccacaacggactctagatgtcagtgttgtgccaaataacagcaccagggaagatgtgggcaacacatctactttacaagcacgtttgtaatactgattttttttcttttcttttttttttttttttgagacagagtctcgttctgttgcccagggtggagtgcagtggtgcaatctcggctcactacaacctccacctcccgggttcatgccattcttctgcctcagtttcccaagtagctgggattacaggtacgcaccaccacgcccggctaatttttttttttttttttttttgtatttttagtagagacggggtttcaccatgttggccaggctggtctcaaactcaagacctcagatgatctgcctgaaatggcctcccaaagtgctgggattacaggcgtgagccaccgcgcacagtctataatactgatttttaaccaatttaggagggaaatgtcagataggaggcatggtacaaggatatttatggaattcattaccacttcactaagaaaacatgatataaattgtcctttgaaagctactttggtataaaaaaatctaaagtgcccataagtatgcattcattattagacacaaattacaaccttacaacctactatgtttatttcattaaagtgtctcttttaggccgggtgtggtggctcacgcctgtaatcccaacactttgggaggctgaggcaggtgaatcatgagatcaggagttcgagaccagcctgaacaacatgatgaaacccgtctctactaaaaatacaaaaaaatttagcggggtttggtggcacacacctgtaatcccagctatttgggaggctgaggcaggagatcacttgaacccaggatgcggaggttgcagtgagctgagatcacgccactgcaccccagcctaggtgacagagcaagactgtctcaaaaataaataaataaataaataaataaataaaataaagtgtttcttttaaactggtattgcctaaggtgtattctttataaaacttagaattgttaaatattttaagattcctttgaaagtgtttttgcattgatggtttaaatcagtgatatcaaactttcctgatcctatgtgcccagaaaaatgggcaggggaaaggaggcagcatggaacctcatttttttgtgtgtatctgtgtgtacacgtgagtgcacatgtgtatatgtgtggggccacatgtgttttgtatacggtatatgcatgaaaatgtacctttgtaccttatacacaaaaacaaattaaacaatggcataagcagcaatataaataaaaaatgctaatactttcctgccatattccaaaataaactgtcttgtgtactctgcagtgtgtacttccccactctgagaccactagctcaggtaaagtaatgagcttctaagccagactgcaaaaaagggcaagcactaataccatcgaaatgaacagaagtgttgaattcgatcatttgcttttcatttctgggagtcattacattttggtactgaattccaggactgaaaatacactgttcattgtctaaccaggagacaaaatccctcagataaactagtatttgactcacaatatgc

SEQ ID NO: 13383 - DNA, 58108 bp, Human
tctcataccttaggaaagaactgaaacacttcttaaatctgccttcacaactggttcaatggaagtaacatagaaagtttgttgaaaaataaggcagtaaagatttccctttgtcttttattagctcccatttgtttatctaatgaccaactgctaacttccaagatcaatagagattgaaggcccaaggtactcataaacttagatacacaggagatattttcttcgaattcagtttcagagtctgcatgttataggaatagtgaaaacttagcctcaataaagctagggcctccacctaccttcctcctaggtttgcatatgaattccagaatagtttatataatgccacaatgccatctgtctatgctgacatatgctgaggtttcctatcagctgcccggtccgtaggcatcagtccacatggtttgctaccagcatgtttcctatcaacatgtcccctttggtctggcccagtctgtgctagcacctcatacacaggcaataattctgctgctactgcagtatgctggagcctggggacccttggaggttgtttaagcccatttatctaaagcagagggtctcaaactagcagcctgtggccacttcaaatatgcacatgtttttcaacctgcatgattatatcagttatttatcactgcttaacaaaccaccccaaaatttagtagtgtgaaatacaccattctatttgttcccaattctgtggctcagcagttcgggccagatttaactggtggttcttctgctggtcttgcctgggatcacacatgttctgcagtcacctggcagccagactgcctcattcacatgtctggcagttcctgtggggcttgcagggctgttgcctggacctctggaggccagcccagcttctctgcactgtggtctcaggctgcaagaatgggccctgtcctaaggcacaggcatgtttcaaactctgtgtcatgtttgctactagccaaagaaaaagaccctacctcttgatgggaggaacagcaaagtcacattcaaaggggcacacatacaaggataggaggaattggagcattttttgccatctaccacagggtggtttctctgtctctctcactctaattaccaatggttaaaaattggagcttcatcttatcttgaaaaatcagctagcctactttattcacttacacttcctccctcatctgttggcatttgagttgtgataatgcctaatttacaagattgtttttgtgaagttagatatggaaaaatctgacaaaagcagaaactcaatatatgttttctcctttctgaacaccactagtcatgaagctgctacctgccaatgaccaaggagagcggccaagatgaagaacaagggagtcatagaggaggtggctggagaataatcccttggtctgttttagaagtatagaggcattaggaaacaaaactcttaaagaatttataagaaaactaaacgtactttaagaaattaaaaggagcagtaggaaacatatcagtttgctctaagtgaaatatctcaggctctgaatggttcacccaagaacctgagctcattcctgggaggcacctgcagaaaactggttctggtcctggtccctgtcttcaggtggctgtgtgtaaacatcttaccccagtgtacacatctgcagctggtaaatgcctgggggttttctcactgctctccaggagactcagcactgccctgttccttcctagcctgagtcaggactgagcagagaatcctccaccacacacagcaggcactatctgccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaaggtaagaaaccatctgacaagtttgctatggcttcttcagccaaaatttatggaagtttctgagaacttcagggtatcagagttggaaaagacttagagaggccctggttcaaacccctgtgttcagaggcttccctgtggtgtctgtgggcacagctggagctgaagaacaagggaaaggtgataaaggaaagaaatgaagctcttattggtcatcccttgcctttgttcatttcaattattgtcttggaaatctgtagacatcctaagagctcccctccactacggacatgcacgtttctctctatgtctttttcccaacccctgctctgacaccttcccattgctgcagcctcatggaccacttccggtgaccagttagatatgcttgatctatttagttaattaaggctctgaatcagcccttggccagaagaagcacctcctctaggaaatcattccttctttttagtaatacgcaattgaaaagtatgtgtgggttatgtgctgttaggtgctaagcattttagctatgaattaactcataatcctcaaaataaatctggggtatagagagaggttcttgtttcaattagaaaagtaatgcttggagagactatgatttgcccaaggtcactgccaatagatgacttgattagaagcagggtatgtttgaatgcgaagtccaggctcaaaaaggggccttagtggctcctactagactggtatcttaaggcaaggaaaacagaatatgtccctaatatctaaaaccatgcctagtgcccaggccaggcttgaatcaatgctcaacgcatgcatgtgtaactgaacagaactgcccagaaccttggctcaggccaagtaggccagaccaccccacaacagacatcttccctgaatgcagggtttgagaagtgccctaatgccctctaactgatgctgagtttgaagaatccatcagttaaggggaggtgtttctgagtttgaagaatcaaacaccttcctaattggtaggaatcctgaaaacactccacaccggagtaaaagactttggttttttatctttatgcctgactaaaagttaactctcattctttcattcagcaaatattttgtgctagtgcatgacactgcagattaatatcgtagatgaactgagtctgggctaggtagagtcaaaaaaaaatttcctaaaggagcctgtacctaaactgagtcttcagagagaagttggaactggcaaagtgaggaaggacggggtctggagggaagagtgagtgcaaaggcacagcacatacagaatgcctgcatgctctagaatccaaaactgtgtcagccaaatttgagttgatggagggacagccaaactgagatacccaggcggtggttggatttatggatctggatttcaggggagtgggcagggctaggggaatagaactgagggtcatgatgtcagtggtaggagttgaagtcttggaagaaagagtagatagaaactttgttttctgatgaacattctatgaggaagttcagcagaggttggaaacatctttaccatttataaataaattttatgtaaaatcctatcctgctgtcatgtttaagcaacttattatgcacagcaccaggacatcaatgtaaattgcatgccagtctttgctctcagtttcaaaggcattcttccctgcctgctgtctaatctttacaaagaaaggttaactccagaggtcaggaatctgaacacagaaaaccagattgcatcatattcattctaatcaataaacattatataatttttaaaactgtttctcatcttttatttcttcattttaatgaatatgtcaacacaaagccgtaaatgaaatcacatttacacaaaagtacaactggggtaagaaaattcaaaagataaagtaataaaattaaatttaaaatgaaataccctatgtatttgagtaagttgcttagcttctcccaaccttggtttcctcatttctaaaacgaagaacttgcttaatattcaggctctgggccccaccaccaaatccttgattcactggctctgggtctgtatgtaacaagcttctggagtgattctaatgattagccagagacaggacctactattctacgtaactgatttcctcttgctgctgtaaaaaattaccacaaatttattggcttaaaacaacacaaatgtattatcttgaagttgtggaggtcagaagtctgaaatcggtttcactgggctaaagtcgaggtgtcagtgtggctgtttcttctggagactctatgagagattgtgttttcctgccttttccatggattctgtttcctcttctagaggctacccacattccttggtttgtagcctcttcctcgatcttcaaaaaaatgtatctctgcttttgtaatcacgtcacattttctcctcttataagtcaaatctccctttgcctccctcttataatgacacttgtgattacatttaggatacacccaaataattaggatatctccccatcccaagatccttaattatatatgcaaaagtctgtttggctagaaaagataatactcacaggtttcaggggttaagccatacatatctttcagagtgagccattagccattattcagcctactgcgataatgtgcaagttccctttacaatctatgttctatgttcccatcaaggttaattagaaatattagactctttttccacagaaaaaaaaaatgtagcagtagtttcatctctaccctgacttctctctctttccttcatgcccagtaagaggaagtgaggtgcaccatctgttcatctcatcaggtgttacctagaatcagagtcaggagaaagcacctcataaaactactctgacaagtaaaccatatcctggggaccaggtgagaattaaaaagctgtatactcataagctgccaaagagctgatggtactgaagtcacatggagctcaggaatttattcttgcatttagaaagtatgcatataattctctcgaaaagaaatgaaatcatatttttctgtcggatcaaattattcagaaatccgaactgtagaaaacatacaaacacacttgcttaatgttagctttttaatcttatttttgtacacagtatacttttacataggcactgaaccagctggaaatgaatgcttggattttcgcagctgataaaagcagagttcagattctgtccttgagctcaatgtctggagaaagcagctgtgaatactgcttccttaattcagatgcctttggccgtgaggggcatggcattttaaagctgcaataaactctgtactttttctctcaggggattagaaaaaccaattgatttgatagtgactcagcagttttcaccttcctctttagccaatgccctgcagctaagattgagaaacggattcagaactcacacctcttggtgcttggtggctcccttccaaaccatcagctgttctttctactttctttcctattttttaaagcacagtctgaatcaagtgcttcagaaccatttatactaactcgtgttccaaacacataaccctgaaccctcttctaaggccaccagttacaaagaatggggaaggttaatgagtaactccaccagtgcctgccagaaagctcagctgtactccagccttccttcctctcttgcagagagaaacaatgcggcagttgaacaaagcgaaggcactgtaatgcccagtggcttcagtcacaggctggtctaaaattccatttcacagaattgaagataatttggggttattaccaattctcagcagctcaaattcaatcccgttgatggtgagcatggggttcattttgagagtagaaaattggatgcagtggagaatcagaatgttggatggtctctgccatttccccaaagatatcatcctaactgcatgctgctgcttttaacaaatcagtatacaacttagtattttttgtgttgacaaattttcaaatatacaaaatattgagtctgaaggcaaaaagaataatttttcacttccattgcttcctaggtcataacattcacatctgatatttcttccaaatacagactgttgttggcctgatcatcactcacacatccaggcttgttacatctccacgccactgagtatcagggaacctgccccaatattcacgtaggttcttttctattttccctaagcgtcggccaactttagaaataaagggacagagtacaaaagagagaaattttaaagccgggcatccgggggaggcatcacatttcggtaggttccgtgatgccccacaagccacaaaaaccagcaagtttgtattagggattttcaaatggggaggcagtgtgcaaataggtgtgggtcacagacatcaagtactttacaaggtaatagaatatcacaaggcaagtggaggcagggtgagatcacaggaccacaggaccgaggcgaaattaaaattgctaatgaagtttcgggcaccattgtcattgataacatcttatcaggagacagggtttttaggatcaactggtctgaccaaaatttattaggcgggaatttcctcttcctaataagcctgggagcgctgtgggagactggggtctatttcacccctgcagtctcgaccataagagacaggcgcacctggaggggggctgtttataagcctatacctcctggctcgtattctctttctcagggatgttccatgctgagaaaaagaattcagcgatatttctcccatttgcttttgaaagaagagaaatatggctctgttctgcctggctcaccagcagtcagagtttaaggttatctctcttattccctgaacaattgctgttatcctgttcttttttcaaggtgtccacatttcatgttgctcaaacacacatgctgtacaatttgtgcagttaatgcaattattacagggtcctgaggcaatatacatcctcctcagctgacaggattaagagattaaagtaaagacaggcataaatcacaaggatattgactggggaagtgataagtgtccatgaaatctttacaatttatgtttagagattgcagtaaagacaggcataagaaattacaaaagtattaatttggggaactaataaatgtccatgaaatcttcacaatccacgaacttctgccatggcttcagctgatccctccgtttggagtcccagacttcccgcaacaactgagaactctggagggcctacccttcacccacttccacccttcttatatctcttaaggagctgtgttcagatggttacatttcgcttgctgagcaagactgcattttcattatcctgggctaaaatcaattggtatttaagttagagcaaaaagggttctaaccctatttacagcagcacacatacacttacattagaattggctttaagggaaaaattcaatcaatcgacaaatttccactgattaccttctatgagccaagactgccatagtctcagccttcatgcagcttataggctagcaaaaaagccagacagtgcacaagaactcacaagtgtgttgagtgttgcaagagtaagtttcaggggctctccatgacttacctggttgagaaaccctttaactttttttttcctctgggtgtaaagtgaagagatggcaatcagagtaggttccattgtgtcattgtgaaaagatgctgggctggcgtgtctcctgaaggccacccatatctttaaactttattttcatgcattcgcacaaatatagatgtgttccatagatgaggcagatagcagaggcttctgcctacagcaaggctagtttggagagggttttgctgtcagggttggacccacacacctcttcatagatgctttttcttttttttcccagagtttgaaagggaaatggagtctcaagttcagggaggttacagtgtagacccacaaatcagctaagtacagctaagggtggagaagtctatgcaatatccagcactcttctgattaattagaagtctttaaaattcacagaaaccatattgtcttccctaaatgattcatatgtcaagacacagtaaagatattatatgtggaacatcatacacaaacataggtccatatagaaattcttaccttagtaaactgccaattttctgaaatgctctttaaatcctgctaatggtggcatttgtgtctttgtcacctacagtacatttctggatttgggaatgagtgttcttcagaggatcctcgctgcccaggttccctgccagaaggacaggtatgagcaaataaagtgcttagaagagctctgaatcctattcctggatgactagctttcaggccaaagtgcctccacccaccgtggctcttccaatctagcctgtgaactgtctagaggtttcccaagtcataggggcaatgaagatacagagcaatgacaacacaaagattaaaattggattggtggcacagcagccaatccaaactagtgaaattaactgtagggtttccagtaggatccccaaaaatccagagttaaagagaatccctcatattccccttgaacaccatggatgtgagcattatgataaaataacaaggtgctttcacatgtatgcacaaagatgttcatactagtgctggttagaaaagcaacaacacgggaaacaaaaatattttcaaaactttttgcaggccgtatcatagcataaaaaaatcctcatttcttaaaaaaaaaaaggaaaaaatgcctgattattacagggttacaggtatgatagggtcacaattttggaggataagaatgcaaggaaaaataccaacatgtgaacgcttggttatttctggttgtgagataatgggtgatatcatatagtttatacattttctacaataaatatatattacttttataatcggggggcaagtcacatcaaaagttgttacaagaaacatatcgggttgcagatggtcatgtgcagtcgcccagagcatccccatccccctactgagttggttggtgggaaggtgggatgcttttcggatgggagtaatattgtttattgcatcctttgtttcagaataatcctcaggtctgcccctacaatctctatgctgagcagctctcaggatcggctttcacttgtccacggagcaccaataagagaaggtacaaggattagatgaattctgacctgcagactgtgggtactatgacagggactttgtgctgcctccttcccctgggccacagcctcccagagctgcccaagatcctgcttcttataggctatggtctgggtcatggtcagaagagaatgaacttcctgccagctagcaccaagtgactggtggaagaaggtgaaggaaagctgcacagagctgggaaaatacacatgtccagttccatttacaaattacctcctatattcagaaggaaatattcctaatagtttggtcttcttctaaagactgtcctgttgagttttggcttggggtttacctgttttgttttgttttataatgactaagtcacaattatggaagattcagagcaatatctttctcagctgactagaggtatgttctttgcaagaaaatgttgggtaaacgaagtttggatagttaaaaagtcacatattatggcccactgtggtttgaattaataaggtttttactctggtattcgcctttgctagaaaccagcatattcatttacatactgtgccatgttccatgtttgctctaatcctacatccaggtcaatgaacgtaatcccttgattaactcatatcaggcaggttggatgcagtatgtgttatagttttgggaggcagtaagtgttatgatttaaacaaatagtgtctaattataaaaattttaggctgaggtatttgtgaagaggaatgctgctggtattagagactcggggagaagggcatgtggtcttgtactgcttagtagggcagcctgggtttatctccacaggtccttctgagaagcaaatgagatagtaagtaaaaaactataatggaccacacaaatgataaagattgcaaggtttaatcatggccaccctggaggcaggccccctaagtataaatcctggctccttttccagctgtgtggccttgggtaaatcatctgccctcttggatcctctagttcttcattcgtaaaacaaagataattatggtacctatttcatagctgtggtgaggattaaaagaaaggatgtgtgtaaagcacattagcttagcttagcacattggcacaggcacatggttagtgctcagttaatgctagttattgtcatgataactatcattaagtattgccatcatagcagagtttctgcctcatttccagggtatctctaggaggctgtcaagagaactgggcatgatatgtggcaagtgctatgttacaatgtcagtatcaacagtacttttctctcaatagatatatgcgtgggaagaggaagagatagagaaagatttctatacatgtcaaaaatcaggggataattccttcactatttaatcatctctctctctctctctgtaagcccaaatagggtaagataagcacgcagataattctgtccattctaatttatgacaacctgtcctctatgactatgttcttgactttatggcccattccctaacaggccacctggtctccggattctgcagcctgtccccattattcagcaatatcttcagccagcaggagctgagctttgttccagcaggctgaaaaggagctgttggcatttcattaagaagctggcactgttccctgaatcagaattaaatctctgttcagggcaatgtagtactgcctggggagttttataaactcagctaaaaaataagggacactaggtatggctcacccatctatttagaagaactctccaaagatatccacaagaattttgtggaaatgcttcccacccaaaatctccagtgggaaaatgggaccagtcttatccataagtaggccagcctgaaattcttagttactactcatctgaaccatagcatacagggccaccacaaaactattaaagagtctatctacctacctacgtacctacctacctacctatcagggattaatttttatcagattagctagctgattgatcccttgggtcttgaaaaggcaaaagtctggagagataatttggaaaatgtggactgtgataaaaattcagaagattaagagaagaaaggcaatttaacaaacacatgataagccagcagctactgtatgccaggcatttttggtacacaaactctctgagttctcacaacaatcttaggtgacaaggatgaagaacataaggttcaggaagtctagtaactctcccaggatcacacaggtggttccaagacatacacacatgctctgaacttcatatactgggagctggagaggcttagtaagaccaaggtctgaggtcacgtcatcaagagatggagaaatcaaatggaaactaaacagatctagccctttttcccccagatggctcaatgttgggccaggccaactcaactcactgaggtagactgtccttggtcttgaaagggccagagcctgttgattcaggtctggtcttccgttgtccttctgtattttgtcagggcagtaccctctgaaaggacttgggtccctcttagtgagcttcaatgtcccttccagcttctggaaggtcttatcctggtgtcctttcagattcctttatcagagtcttcttcccttcctgaagcctgagatctggtcctggtagagaggacacactttaaaaagaaaagaaagaaagacaaataaaggcataaatgtactacaataaaacatggacatacactcttataattttagagtacagaagtgttaatttatttttattttattttaagttccagggtataggtgcaggatgcacaggtttgttacataggtaaatgtgtgccatggtggtttgctgcacttatcaacctatcacctaagtattaagcccagcatacattagccatttttttaatgctctccctcccccaactcccaccccccaacaggccccagtgtgtgttattcccctcactgtgtccatgtgttctcattgttcagctcccacttatgagtgagaacatgcagtgtttggttttctgttcctgctttagttcgctgagaatattggcttccagttccatccatgtccctgcaaaggtcatgatctcattcctttttatggctgcatagtattccatggtgtatatgtaccacattttctttatccagtctatcattgatgggcatttgggttgattctatgtctttgcattgtgaatagtgctgcaataaacatacgtgtgcatgtatcttcataacagattgatttatattcctttgggtatacacccagtaatgggattgctgggtcaaatggtatttctcattgtaggtctttgaggaatcaccacactgccttccacaatggttgaactaatttacattcccaccaacagtgtaaaagcattcttatctctccacagcctttccagaatctttttctcttataaattaatatcaaaaagacaaacccaatagaaaatgataaaggacttctacaagtaattcacagaaaaactataaagagccaataaacaaatagacttgttttttggaaatattttgtattttctaattcataataaaggaaatacaaaataaaatgagatactatttttcacctaaaacactaaaatttttaataatactccagatttgtgaagatgtgggtgaccaggcactctcacacgttgttagtatgataataaagagttaaaatgatctgataattttgtttagaaatgcactggacgtatctgaaagaatatataagaaatatataagaaaatcactaagctctgatgcctctgaggaatagccctgaagaaactggaggacgaaggtgccatttacctttcaggactttttaattacttgaattatttttacctttggcatgtattacttttgtaattttaaaggagaaaattgatttactatttcaaaaataacaaagataccacccatattctctcaagctgcgtagaactcattgttcttgccttccagagcaaggactagcatcctatgatacacacataagctaatgtttttctatggattttcctacacagatatccctcaaggtacttccccttcccttatagtttttagaaaagacaattcttcattttttggcagcatggaaataaccatgagtcagagtccatttgaagcatgatgggtggaatgaaaaagtgagaagaggccagggctgtgggcagcagatggccatgaaaagtgatgctgtatcattgcttcactgcttcacacattagagcctacaggtcgttgttgacttgagtgtcttcctgatggtactgcctgagccattctgtgtatcactcagaacattactctaaggcttgtatatcttgtatgtttttccctctagctggctgtataggattctaccttcagtttctcacaagccctttgaatccattgacgaaggccaagtcactcacaactgggatgaagttgatcctgatcctaaccaggtaacctggtcctgtgaattgaagcttatcatatacccaaagccttgactagaaatacctaaatagaataccatggtcattggaaaaaatagatagttttttaaagtattattttaataaatgctaaagtgtgtctgttttctgctcaaacttgggtggtgtattagtccattctcatgctgctatgaaaaaataaccaagactgggtaatttataaaggacatatttttaattgactcacagttctgcatggctgaggaggcctcaagaaacttacaatcatggcggaaagggaagcaaacacatccttcttcatatggcggcaggagagagaagtgttaagtgaaagggggaaaatccccttataaaactatcatatcttgtgagaactcactatcatgagggtaaccatccccatgattcaattacctcccaccatgaatgtccctcccacaaaacgtgaggattatgggaactataattcaagatgagatttgggtgagacacagacaaatgatatgaggtgggaattttggaaatgatggattgattatgtatatacatattgttaaaagaaaaacctttgacaaatctaatttaacagagtttaattgggcaaaggacaattcacaaattattctacctgagccaggataggttctgagagattccagtgcagacactagtagaagacgatttatggacagaaaaaggaaagtgatgtacagaaaacagaaatgaggtacagaaatagccagattggttgcagctcggcatatgacttacttgaacacagttttaatagtgtgtcaccatgattggcacaagagtaggttacacatccaattaggttatggttcactatgtatggagaaacctttaggcagaacttaaaatatgtaaggaggcaactttaggacaaacttgattaacagtctgcgtgtgtgtgtgtgtgtgtgtgtgtgtgtgtgtgtgtgtgtgcacatgcgcacataagcttgtatttttctagcctaatggcatatagatggacacaggagtagttcggacttactagaactgctcaggtgaattggatgagcggaaattttataggttggtcaaaatattttatattttataggttggtcaaaatatctacatgctcatggttttttttttgtttttaatctaaacttaccacaaaatatagaaaatacattcaatacagacatctttgaagagaggcctttgaaatctggcataggggtgagagtcttgctatctgggctgaattatgcaagtctattgtggtcacagatcactatcacagtctcttcagacctaggacttccattctttttctaggagtttcctccttttggtctagtaatagtgggcgttttctctaattatcgttattacttacgtactctgcttgcagagtatataagataaaatgagacagaaccagtactatagcaatgagatagacccagtgctataaacgactgagctctttttttaaccttctgagaaccccagtgtattgcctttgtccctgagtttaagtacatgttgctgataataggtatgtagggcaggaagaaaaacagacctgggtttgcatccctgcccatctacttactagctgtgtcttaagctatgatgtttcaattgtaaaatgggatgataacatttgcctcacagtgctattgtgaagattatgagagaataggtgtgaacctgcttcatacaatgcctggcatgtgataggcaagaaccatgattctgatacagctatttatatttacctgaatttacattattcaggtaactttatttcttcattttatattattttttactctgaaggcttcttctgccctctttccctccctcctactctctctctcctccctctctccccaccccgccactttccacaacccaaggaaatctcctgcttcccctttgtttaccatgacattttgtctatacctgccaatctccctcccctaagtgcttagactttttataagacaaaagtcaaaataatttatagacacctttggtttcctgcccagttctctctcttgtcttaattatggaaatctcagcgaaataagcatctgcttgaatgttaccacccctctctaccagggacaggaagggagggaggcatttagggtggaaaaatgtgaattggtatttaaaatactatctacctcatagccactttgaaactaagatattttgtctaaataattgacccttaaactcgtatgaagtttaatgcataaagcagacatcctccctggtccccagctggcctatatattgcctttaagcacattgcaaaatgcagcccctattctaacccccaaccccttagactcagtcccccacacaaagggacacagacgaggcattcagctcctccctttccccttcagtgggacaaggcccttgcacagggcacagcttgcacaaccaacctggggaccctgacttcacctcattcctgagtctcatgtggattcaagtaatatgggtatagtaattatgtatatgaagttaactaaatgagggattataagaaaagtccatgggcagatttggataatttaaattattgtttatttataatgaaaaataattatttattattattttgcttcaagatagcaatcaaatcagtagtggttaacagggtaggctggggagttccagggctcctgcctgctcatgtcgatcacaacaattttctaagcctctcaaccttaataaatcttcatagatctgtttatagttgtgtggacaacagtggagccatacttcttttacatagttttattcggggtgggaggttaggttttaaacctaacctttaaagaaaatatgtgatgtgactctactttgagtgtgatgtgtaatatgctcagtaatatacctttattatatattattatttccttgactatcattgctacattttatttaacatgaatacaccctttcataggaactattttggagttcgtgtgacatatccatggaagacaatcttgttctaatagaatttttctagctttgtctttttttttttttttttttttttttgagacaagagtctcaccctgttgctcaggcgggagtacagtggtgtgatcacagctcactgcagccttgacttcccaggctcagatgatcctcctacctcagtcccctgagtagctgggaatacaggtgtgcaccacaatggccagctaattttttgtatttttggtagagaaagggttttaccatattgctcaggctggtctcgaactcctgggctcaagcaatctgcctgcctgagcctcccaaagtgctggaattacaggcatgcaccactgcacccagcttagctttgtctgattgtatgagtaaaatatacttataaaaacccaaaagtattgtagaaattaataaaatattactggacgtctcccatcattaagtgagagtcaagtatataagttgtacatgttaattcattatttcataaatagttgacatacattttgaccaggaagtttgaagcaactggattaaaaagcttgagttaatacagaggcatcaaaatagctgtatcagggtgggcatggtggctcatgcctgtaatcccagcactttgggaggccaaggcaggcagatgacctgagactgggagtttgagaccagccttacctgaggtcaggagatcgagaacagcttgaccaacatggagaaacaccatctctactaaaaatacaaaattagccaggtgtggtggtgcatgcctgaattcccaactactcgggaggctgaggcaggaaaattgcttgaacccaggaggcggaggttgtggtgagccaagattgcaccattggactacagcctgggcaacaagagcaaaactccatctcaaaataataatgacaataataataatagctgcattggaagtttctgcttgttttctagcagaccctcagcccatatttgttccccttctccccgcttcccatgtctcccattctaacctatggttagaatggctttgcttttgtccttgaacttgttgcctttcttctgttttgaattccctgaacactttctatatggtagccaccaaatgaatttcttctccaatatcttccctgctcctttgagaccttgtcttcacacacactgggagagatgtgcctcagaattcaatagcgtctcagtgtctctgtgaacaccggctccaaccaggtagcagtttattatctttctgacttgtgacctctgtcacctgccaactacttctctctccatgataaaccctggctgatcttgcaaaatctacccttttgtcttttcttttacaccttctttacaagttaatatctctttccaattttatacttcattatttaaccacagcattttgcattcatcactttctccctcataacctcctccaaatatgtactccagactctcagcaagaaaggctgagaaaattatatttaggcaccctctgacagtccttcccagctgaagcctgtgtgataggtatgtcttcacctgtcatagaccaaatccaatacttcatcagcttcaccaactatccacattagtcatctctgggaatttgaagacctgaggattgcctgatgattcctccagtgtaacatttagtcccaaaggcagcatcttgcaatatgtgatcatcactgtcatccttgataccctctcaggaagactgggggctgctccccctaaagccttcattttctttagtgtatatttaatcagttatccaagaattaatgcaacctctttttgagtgtatttaaattcagcctgaggacataaattcaattaattaatacctcacataagaagtatacctaattttatgtgtctgcctctaatttctgaagtctcagaatttaatgaactaatctacatccaatttaaccatgattttacagatttcagctagaattcctgaattagcacttctctttaagagtcctttaaaatttatttttcttattatttcattctaacctcttgattgttgaaaaatcagattcttgactcagttaagactcagctgagaaaattacctcttggttcttaaccagtataatttggatcaagtgagaaatacctcaaagctaattaaagaacatatcataaaatgccttctgtctctagtacatgcaaattataaaaaaaagtttcaaaacaatatacccttacagggtatttgctgtctaatttgtcaaactttccaggttttgccatcctgaaatccccttccctccacaaatgtcttggatttttctgcctctcttgcccaagtctgtcctagtcacagccagactccttgagaaataatctaaacccactttatcaccctcattcactctttaaccctatgcaattcagcctgcccagatgactctattgaaaatatttataccctctttacacaatagtgcatcactctctaattaatacatatttttatttaaaacttacattaaagtgtcaatgcccagtaattccactaacacagagttaacaacttctaatgttttgggttctttccagtcctttctttttgtacatatatgtaaataaataattcctagggtcccatgtagccagtaaccaagagtaatttaaaataatatctggccaggcacagtggctcatgcctgtaatcccagcactttgggaggccaagatgagaggttcacttgagtccaggagtttgagaccagccctggcaacatagcaagaccctggctctacacaaatgtgaaaaaaaattagctgagcatggtggcaagcaccggtagtcccaggcactcaggaggctgaggtgggaagactgctcgagcctgggaggtcagggctgtggtgagccctgttcatgccactgcactccagcctgggcaacagtgtgaaaccctatctcagaaaaaaaaaaaaaaaaaaaggaagaaaaaagaaagaaggaaagaaagaaagaaaagaaagagaaaagaaaagttaatctttacttgtttttcctgaagacattaaacagtatccaatatatgacccacagcaacactttttaaaatcccctttttccagtttttcccagactccaaccctctcacatctgtcttctctcacctcacctctcaccttccccaagctcttcatgccttgtcaccattgattgttggcttctctcttcctccctgtacattctgcctctagaaaatgatacctgcactgtagatcccctaccccatttggctgggatcacacatggtgttatgtgggataacacacacataacagtgacctccatggcaatactggagttcaaaggactccagtgagaataggcaaatctgaattttccgcagagatcagggaagggaagaggaagaggctatgaatacacttataatagtgcttttaaaaaaaaatcagttacatatatatttactataattaagctgatggtgtaatgcagtcttagattatttttatttaaatatcatattttgcgcctttttccatgtctttttaaacttcttgagtgtagatatttttgatattatattataatccaataaatgtttataaaacaattcctaatattgtgagatatttgaattttttccatttttgctattatgtagtaaatccacgctaaatataatccttttctcctctacatcccagcctggaacaacagacctccttcttttcttcctgaatccccttttttccctgggttccatgacattgcatgattcccaaacctgcaaaataagtattcttcaaggtcctgaactagaatcttgatatagtttgactgtgtccccacccaaatctcatcttgaattcccacgtgttacgggagggacctggtgggaggtagtctatctgcacaagctctttctttgcctgctgccacccaaatgagatgtgactttctcctccttgccttctgctatcattgtgaggctttcctagccacgtggaactgtaagtccaattaaacctttttcctttataaattactccttctcgggaatgtctttatcagcagcataaaaatggactaacacaactctcacctcccccttgtcatcatctcccctctgagagaaggggaagtacttactctctctcttcccctcctcttccttactgtctttcttatcctcctcttttcttctccttctcttcaccccaaccttccccttcccctctgtattgttctgctagagctatcataacaaaaagatactgggtggcttaagcaaaagagatttactttctaacagttctggattccaagattgaggtatcggcagggttgctttcttctgaggcctctctcattgacttgtatcttctccttggctcctcacatcatcttccctctgtgtctatagccaaatttcctcttcttataaggacaacaatcatatcagattagggtccactctagtaacctcatttaagtttaattattcctgtaaagactccatctccaaatatagtcacattctgaaatacagggggttaggagttcaacatatgaatttggaggaggaacacaatctagcccataattctctccttctgcttctttttccctctaaatatctactaaggattcccaatcttttggattctctttgccttagagatgaagggatagttgttgataagaaataatcaagtgggacaaactaacaggaggaactccttgagcaatagaggattttcctagctcactacactgaatcaggtgccaagtccatagaatggtgatgcctgagtatacataagagttaccaggggacttgttgaaaatgtagattcctcagtcttgctccccagagatcccagttcagtaggtctgaggtggtactcaggagtctccccagatgactcccatgcaggttggtgctggactgcactttatgaaattctgctgtagagtgtgctttcaggatctctctggttccttttttccttttcctacctccacctggttcagacctcatttcttcttacctagactatgttaatgaccttctacctgattcctatgtcttcccctccctatcccacaccgtgctgccagaatcagcgtgctaaattatcatctcaaaaatctttaaatctaaccatcacccgccccctccactgcccagccaatccagtgcaggcttccagataagagatcaagagctctgattcactatcacagcctttcagactctccactcacttccatgtcccctacctatcagtcacactagaaccatcgtcattttatctacctgggatttcctgttcttccatcacaaatactcacccatctaaatctcactcatgatttatgattcattttaaataatactttcttcattatgccctttcaatatttctcagagtatttaaggttctatgtctctatcatcttcatctgatctgcagtatccagtacatgccttcttccaaatagaatcgcaagtatttgttgaatttactccctgatagttcagatcctatcattctataaataaattagattgcatttctctaaatgcattcagtggtgtgtgccaacattacagtgcacattcccctgctcagcccttttggacagcttgctagctctttttacatttcatctccatcaacttacatttcacttcttgcaaagatattggagctgtctgcaaaccagatgatttcattgcttatatctcttattttccatatataagaatgttaaataggccctgtgccaggacttattcctgagagaacatttctatttacatttctcttccaaagttatttgcactgatccacttccttgtttttctatcatgaggttttcacatttccaggatcttctgtaatggattacctgagggaagagacaatgtcatgttcacctccagcatctagcataaaatctggcacacagagaggttcaataaatactgtttgaaataattaatataaggggattagacaagaaacattaaccctgaaggacctaagcagggttagtgtcccaggaatcagactggccagggtgattcagcactggaggaacagtaaacaaaggtcaatttggaagaccaggtacaagaccattaaaaggagggaaagcttgggtttaggagccaaggagatcaggaataatttgggaaacaggtcaagacaggctaagatcaaagggctcagggtgtaggttagtaagagggtctgagaaagtgttggcatcagttcttagtagagaaaatttaactgttctaaaccatcagttttttcacttctaaaatagagatgataataataatcatagggagcctcagagagttgttgtgagaattaaatgtcatccaacaaatatttattgagtgactattatgttctatacttcgtgctaggtgctaggtaatggatttaaagctcttagctttacattcaaggacaaggtcaaatgagaatccaagttttcatccttgatggctcatcttcatttgtagcctcatgaaagacttttgttatgttttgttttgttttttgagtacaggctggagtacagtgttgtgatatcagctcactgcaatctcctcctcttgggttcaagcgattctcctgcctcagcctcccaagtagctgggattacaggtgcccaccaccatgcccggctaatttttgtatttttagtagagacatggtttcaccatgttggccaggctggtctcgaactcctcatctcaggtgatctggccgcctcggcctcccaaagtgctgggattacaggcgtgaaccacctcgcttggcctgaaagacttttagaaatctaaattacagtgacttggatcctcattatctatattcttgcctatcacctcaaagaactccaacggatcaaccaaagcctgatttctctccacataattcatgctacctttttttcctcaaacttccaaagtttctgaagaattcaagtgagccactgttttattttaatccttcctatctttcttagtctggactgaaactcaccaccacaaattaccctggatctctctgctaacaactatttatacattgtattagtccattcttgcactgctataaagaaattcctgagactgggtaacttacaaagaaaggaggctcatagttccacagggtgtacaggaagcatagtggcttctgcttctgggaggggcctcaggatgcttccaatcatggtggaaggcaaagggggagcaaggtatctcagatggcagggagcaggagcaagagagagaggaaggaggtgctacacgcttttaaagaccagatctcatgagaactcactgtcatgagaacagcaccaagaaggtaatgctaagccattcgtgagaaatccacccccattatgcaaccaccccccccctcttgctcctgctcccatcatatgagatgctcccatcatatctttgccttctgccatgattgaaaactttctgagcctctccagaagcagaagctgctatgtttcctgtgcagcctgcagaactgtgagccaatcaaacctcttttctttataaattactcaatcttaggtctttgtttatagcagtgcaagaacgaactaacaaagaaaattggtaccaaggagtgggacattgctataaagataacctgaaaatgtggaagtgactttggaactggataactggcagaggttggaagagtgtggagggctcagaagacaggaagatgagggatagtttcaaacttcctagagacttgttaaattgttgtgacaaaaatgccaatagtgacatgaacaataaagtccaggctgaggagatctcaaatgaaaatgaggaacttactgggaactagatcaaaggtcaaacttgttatgccttagcaaagaacttgactgcattgtgctcctgccctagggatctgtggaactctgaacttgagaatgatgatttaaggtgtctggtacaagaaatttctaagcagcaaagcattcaacatgtgaccaggctgcttctaaccgcctatgcccacatgcatgagcaaataaatgacctgaagttggaacttaaatttaaaaataagtttagatttaaacctatatttaaattttaacttgtatttaaagggaagtagagtgtaaaagttaggaaattttgcagcctggccatgtggtagaaaagaaaagcccattttcaggagaagaattcaaacaggctgcagaaatttgcataaataaaaaggagccaaatgctgatagccaagacaatgtgggaaaggcctcaaaggcatttcacagacctttggggcagttcatcccatcacaggcccagaggcctaggagggaagaatgattttgtgggccaggcccagggccttgctaccctgcacagcctcaggacactgttttctgcatcccagctgctccagctcctcctgtggctcaaagggatccaagcaccgcttcaaagggtgcaagccataagccttggtagcttccatgtggtgttaagactgcaggtgcacaggatacaagagttaaggcctgggagcccccacctagattttagaggatgtatagaaaacttaaatgttcaggcagaagccagctgcaggggcggagtgctcacagagaacctctactagggcagtatggaggggaaatgtggggttggagctcccacacagagtccccgctggggcattgcctagtggagctatgagaagagggctaccattctctagactccagaaaggtagatccatccacagattgcaccgtgcacctgaaaaagccacaggcactcaatggcagcccatgagagcagccgcaggtgctgaatcctgcaaagccacctgagtggggctgaccaagaccttggtagcccacccctcacaccagtgtaccctggatgtgggacattaggtcaaaggagatttttttggagctttaaaatttaatgacttccctgctgtgtttcagacatgcatggggcctatagaccctttgttctggccaatttctcccttttgaaatggaagtatttacctaatgtctatacccccattgtatcttggaagtaactaacttattttatattttacaggctcataggtggaagggacttaacttgtctcagatgagactttggacatttgagttaatactagaatgagttaagacttttgggcactgctgggaaggcatggttatattttgacatgtgagaaggacaggagatttggaaggagccaagggcagaataatatggtttggatctgtgtccctacccaaatttcatatcaaattataatccctaatgttggaggtggggcctggcaggaggtgattggatcttggggacagtttctcatgaatggtttagcaccatccctgttggtactgtcctcatgatagtgagtgagttctcatgagatctggtcattgaaaagtgtgtggcacctcccacctctctctctctctttctttctctctctctttctctctctctctctctcactcctgttcctgcaatgtaagccatgccttctcctgcttcaccttctgtcatgattgtacatttcttgacgcctcctcagaaactgagcagatgccagcatcatgcttcctgtacagtctgaagaactgtgagccagttaaacctcttttctttataaattacccagtatcaggtaattctttatagcaatgtgagaacagactaatatgtacactatgatgactatttcaccgagaaattacttcaaaattcttggataggtggtactgacttctaatgatatgtctgtctatcctcagccagtgttgttgagagtactcaagtcatccaatctagttgagtccatgggaaatttggagggaatctcagtaaattaaagaatttcagttttgaaagggatacttggatcatctagttcaactcccagtattctaactggaaatatttaggccaattatctaatattttcttttcatctctgagcatgaattttgaatcttgataatcaaatgttgataccaattctgtcttcctcctttggtaatcttaagtaatttttaattctaactttggacacccttaaagatgctttcaaattatttttgaccacctcatttctagcaagtaaaagtttatcttccaatagaactcatagaatacagttgtaaaatatgtgaagcaataatacaactaaaaggataaatagacaaatccacaattttagttggagacttcaacacccctctctcaacagttgatagaacaactgaacagaaagtcagaaaagatacagaagtgatctacagaaggagcaggattggaaaaaaagttttttaaaaaagaaaggatatggaagtgacgattttacacgtgtgaagaactgacattttacctttggacttttagaaatatttgattttctagacatcgcctgaatgttattttgacttccaaaagatctcacggtccaggcacagtggctcatgcctgtaatcccagcactttgggagggcgaggcaagtggatcacctgaggtcagaagttcgagaccagcctggccaacatggtgaaacctcatctctactaaaaatacaaaaactacccgggcatgggggcatgcacctgcagtcccagctactcaggaggctgaggcagtagaatcgcttgaacccaggaggtggaggttgcagtgagccaatatcgcgccactgcactccagcctgggtaacagagcgcgactccaaccccccccccaaaaaaaagatctcaaaaatttactttattcttgttcttagcaatgttgttagtgccttagatttattcatctattcagtcattcaacaaatattaatgcctactatagtcaagccattgcattgggcattacaattgattttattatttttgaaatgtttaataagtaaattctatagagaagaagctatttaacaatagcgtatagtataaataaaataaactatttttaaaagttgtaggactatattagtctgatcaagctgccataacaaaataccacagactgggtagtttaaacaacagaaatgtatcttcttacagttctgaaaactgagagtccaagtccgaggtgttagcagggttgatgtcttgtgaggctcctctttggtttaaagacagtccttcttactgtatcctcacatagcctatcctctgagtgcaagcagagagagagatctcttcttcttataaggccatcaatcctatcagattagggccccacatttatgatctcttttaactttaaaacccatctctaaacatagtcacattgaaggttagggcttcaacacacaaatttggaagaggacacaatttagtgcatatcaaggactaaatcagtcagcaagcatcctttacttctttcagagtttctcctctggagagaattatggaattatagttctcaccagcacccgttgttatatgtaagaaaaaaacaaaatttgggagagaaaatggctttcctgaagatcacagagtaaacgggaacagagacagtagcaaaaaccaagtcttcagtgcactctccttttggtctggccttggctcagagagttactgctccacagcatacaataaagctgcagctggctttagtagatgtttgtaccatgcactccatggactcttcctattaatcctctgctcaaatctccctcctcacacttatcaaaatatcacatcagcgctcctgaccaaaatctctgctttctcttgtgagtactgagtttatcagaaccaccttggggattttcttatccttcatgatacaggcccagtatgatctgaatatagactctgtataatcttctgccatcagggccaacagataaatgactcctctccctatactatctctgtcatttggtggggatcattttttgcattagagaaggttcgtcaaggtcgttgcttcttccagattgtgggccctattgaaggtatgttctcttcactatgaaatgtagttgcattttcttccaccacctcaggctctctgttctcatgacttgagggctaatgtgctacagaagaccttgaaaaatgaccagctgacctggtcaacccatcagtctctctggctcaaccttttccactcaaagaagacaaaccccttctctgagggccaggactttattaccactcacagcaaggtttttgtttgtttgtttgttttgttgttgttgtttttgttgttttttgttttttagacagagtctcactctgtcgcccaagctggagtgcaatggtgaggtcttggctcactgcaacctccacctcccaggttcagaagattcttctgcctcagcttcctgagtagctgggactacaggtgcatgccaccacacccagctaatttttgtatttttagtagagatggggtttcactatgttggccaggcttgtctcgaactcctgacctcatgatccacccaccttggcctccaaaggtgctggaattacaggcgtgagccaccgcccctggccttaccacaggtattttaacatcaggcagatgtacaaagatattgtcccagtacaacaaaccaggcagaaaatcccctgctactgggatttctccctctctctcttctttctttccccttgctctttcttcttttttcttgatcacttttttccttagatttgtaaatccttagacttgtactaattaatcactcctgctatttagtaactggcattgtcactgccacgtatggcccaagatgccagaatttagttgattgatcagttggtgggttggttggtttgttgactggatggacttttctgagtatgatgcttggttcatcaatacaagaatcacagaacctctggattgggttcttaaaccctagctgcacattagaagaacttttataaaataccgatgtctgggccctaccttcacagattctgatttaatttggtcttggtctcaaaggctctccatgtgattctcatgagtggccaggattgagaatctctggatagagctaaaagattacgcaggcaaccattgatctgatacttaaatcccttctactgggaaatccagaaagatgactctttctggattttctttccgaaactaagattctaggtagtattgtcttcctaacaatcttcctgggtataaatactctgctctgttactatagaaggaagcagcaggtaatgtttagtggtagaccagaacttcccctaaaaaatccagcagtgcttagctgtggcacttcctgatgttagggaaatatcctcccaggtcagtggttctcaactgggagaaaatttcccccaagtgatgtttggcaatttctggagacatttttggttgttacagcttggtggaatgtcactggaacctggtggaggcaggccatggatgatgctaagcatcccacaatgcacagaacacctccccacaacaaagaattatttcgtgtaaactgtcaatagtgccaagattgagaaaccatttcctagatccttgccctcaggtccccctattatacccctaagagataccatccttaatgaaattagtcctaaagcatttccttctttctgaagcatgatttcagcactgtttcccaaatcaacattttacatcctttttaagtatcttttaatgtgaccatcctgctttgcttttaagaaatgaaggctgctgcctgactgtgtgtgtcagagaggcagaataatcccaaggctgccttttccacttgctgcttcctttcccatctggctgcctccctgaaatacagaatgagctgagccctatgacctgatggaggccctgccaagcccaccttgaccaggtgctgcagccagtggagctagtcttcagggtgcgggtcgctccatgaaacgtggcagctgggcttatcagctgccagcctggataagtcaggcctgctgccaagttgattaataagcgctgggctgacacttcaagaagggcctaaacctgctgattttcctcccctcttccttagatcatttcattattaaattaaagattgttgtgatttaaactgaactgtcaggcagcctagggacaaacgtggggtttggtgaagcagctgaacctggtactgcatttaccaaatcagatctcagctgggtgctctttctttctcttaaaaaaacaatttagaactctaagggcttgaagtagaagtagaaccttcccctgcagtgtcaggagcccacacagggaggctggcatgccaggaaagggacctgattataaatagcatgaaaagcagcatcagtcaaaactcactgatgtgcctgggcaaaatgttaaaagaaacaaatagcttctaaaaatggaagcaatggttttatttttataatctaaagtgctaaggaacaaaagcagtttatattcacatagttttaaacacacaaacatgtgtgtgcacgtgcacaaataacacacactaacagagtccctttaaggaaatgatggataatcattttaatataacaaaatcacaagtagagcctcacagagggggtagctgtcctttcttttctatgtaattgatgctatttatttagaaggtctatggtttacccttgtgaagtaatttttctgtatgtgtattttttttccagcttagatggaaaccatttgagattccaaaagcatctcagaagaaagtagactttgtgagtgtaagtcagtcccatccacacccttcctactgctctcctctcttctgtggtgagtgagccaaccatttgcagcctgaatgccaagcagaagcagccctatcaggaggcagcagagacaaaaccacctgcgtatgctttgggggctggcggagggatgtcttacttacagaaaccatatggcccctgacaccagagggtattcatgaactatttatatctcagaaaggccaatgacaattgaacattttcttacttaagttcctttcttttggctagaacgggggcttttaacctttttctcactttgatgtctgatgtctgatgatgtctttgtttataaatatataaaataaattatataaaattacaaagaagctaatgatattgaaatataacgataaaaatactattaaaaacaaatttgatttggtttatagtcattcatgtgctttcttgttaatgtgctaaatcataatatctatggaaaacatctaataattctggtatgagcataaatatactttgaggtatctataacaactataatgtgatatccatgatttttatcattgataaagttacaggcacctctaatactgctgtggttttttgcctacattcatattagttgaaagaaatgataaatttcactcagagattagcaaaagtaaatataaaatatttcccatccaagttcataaatctccctgaagtagatgcttgggctagaatggcgtcaattcaacatggcaactctagttagtacaatgctgattggaagctctgtttggtagttataggtcccaggagtactggaataactgcacagagcaaggagtatctgggggagaggagaaaggagctctaaggaagtggggctcaaagagaccagtggagggttctgcagaccagcctcagctcatggcttacgtagggacactccaagtgccgagccataggataaattgttggaaacatcttgaagttctcatctttattaagtgctccaaactctttgtagactcacttaaatataccctaaacttgcaaattgagttaaaatacaaaatgatatccccatctcctttcttgtgtgaattgtagatatctggaggcgcagagctctctccttttggctctccatctgcaggtttggggctgagggctattttgagaagacccatgtgttaaggtttcttgcactatggatcatctggtcacacagcagagagaattacagtccatctgaatacagtcctctgccctgttccagagagattaggctgaccctatccataagcagagggctgcccatagtggagtgtacttgagaggcattaactggtccctgatgctgcaaccttcctccccaagcctcctagatgcctgatggtacctccaacagaatctcttcttccagttgatgtcaagcatcaaattgataaaataccaagtaatgaactgatactctgtaagttcttctgatatagccactaagacaacccagatttaggccatggctggagactagggtaaaccacaaactaccaaacatgagtcagtaaattcaggctccttagaggctgcctggattccaaacgtcccaccggtcccaaagggaagaccctagtagaaatgtgcctcatgaccctcagggaccagtggaagggctgcctcttgggcaccgttcacattaacctttccctcttctgtgggtctctcccagggcctgcataccttgtgtggagctggagacataaagtctaacaatgggcttgctatccacattttcctctgcaatacctccatggagaacaggtaagtggctcagttctagggaaggacatgcccatcttctaagggcttttggccagaagtcaaactccaggtttcactcttgtgaagtcacatatgcacatacatagttgtttttgttattggttttctcctcaaggcaatattcatatatatttattgacaatgataatgaatgagacaaaaggcatttatcttgactgaacatcagtgatataaacaagcacatcacataacaatgtaaacagaaaagggaggatggagccctggaatgcaggagtagatcgaaaggcattttgactttaagtctgagtccaaatatgcttttgttgttgtttgatatttcaaggatttttctgagccaaatatgagtgaccaatggcctgcgacacagccatcaggagatcctgagaacatgtgcccaaggtgattgggctacagcttggttttatacattttagggaggcataagacatcagtcaacacatataaggtgtacattagatccaaactgtggtttttatctcagtagaaaagtaacagcagatttaaagcaggcagaaaagaaaacagagaaatagagaacttagaaactctgtagttgcaggttgacctttgggctctgaatgatacaattttcccattggtttaaaatgtgcacaacagactgtaatatgtaaccagctggagtactagaaactctggcatacccttgaacttttccattttacacaaacacttgcaagtagaggcacctttctccttgtctttcctcattcttagattatttgtttcccacgttttttttcttaaaaggaggaactgagctgtgacctaggggttttgtgggtggtggattggtgtactgaatgtaggcaggactccacagtgtttcaccaccgagtcgtttccaccctcttacctgtctcagtttctctctccagagatctagcacctctgagaggcctcaaaatgccaagtgatcagctcttatatgtatttccgggacaaaactatttttgggggggttccctgtagcgccactgcacatcacaggggatgaatccctcagacactgcaactcagcccctagtcacccagggtgcctttcagttgggaagaacaaaatgccctttctcttcagagctgaggagctcagtctctcatttatgcacaaaaatgacagtcacacgaatgcgcaggcaagccaactgagctaaatttggggagaaaaaacaatggagtagaccatttagaatacacctccaaactggaaaccaaacagggtacccaaaagggagtcattcttgttgtctttagaaaaagacaacggaggccgggcacagtggatcacgcctgtaatcccagtactttgagaggccgaggtgggcggatcacgaggtcaggagctcgagaccagcctggccaacatagtgaaaccccatctctactaaaaaatacaaaaaattagccgggcgtggtggtgggcgcctgtaatcccagctactcaggaggctgaaaaaggagaattgcttgaacccgggaggcggaggttgcagtgaaccgagatcatgccattgcactccagcccggacaaccgtgtgagactccatctcaaaaaaaaaaaaaaaaaaagaaaaagaagaaaaagacaatggagaaatcctttagaatggacctgtgaactagaattaggaacctaaacaagagcttcctaggagggaaaaatcaagaactgtcaaccaaacagggctcaggaggacttaacagttccatcagaggagaagcccaaagttgaaggcactttcaataggtccctgctgataccttagctctgagttcaggcaactccttcagggttctgagtcttctctgaggcccaatgtgtccaggtgccaaattattgttgacaaaaatagtcaaactattaatatgtaaaatatttgaattgatgtattctgagccaaatatgagtgaccagtgacccatgacccagccctcaggagatcctgagaacatgtgcctttgaatatccttaatttctaaggttccccagggctgttcttgagtcccaggtcacagtgtgtgagtttccattaggaccacccattagtagcaggctacccgactttggcttcagctaacagctctgtgtaagcttaaaattcttaagtagaggagcttatatactggctttgcaaaacaaagtatgcaaatggcattcctgccttattatacactacctctggaactggaccatttgtgtccaaagcccaactctacatttcctggctgagcgaccttgtgagccatgaatcagggacaagatcacagccctatgacaaggctctggaggcctctctttgggtcaaatctcatatcaggccacctcccctctctccacttgagccgcattggccttcattcacttctttcaagctgccgcgtgccctccttctaagcacttgcacttgctgttccttctgcctggaacattctttcctttctccaaaccctcacctagataacaccttcagatatcaggtcaaatgtgtcccttctttgaagaagcctttgctgattcttcaaactaaccaagtcgctattctttcattccctcaaacttgattttcacagggtcattacagtctgcaaagatattgttctgtaattatttgattgctctctgactccccactagactctaagttccacaagggcagagcctgggtcattttgctccccattttatacccagctctgagcttgctacataggcactaaacaatgatttgtgttatgacgtaatttgtctagacaatgttaaaactgaaaatcacaagaattactctatatgtttcagatgcttttacaattcagatggggacttcttgattggtgagttctgaagacttcagaccccctcactgttaattgacccctaaccgcaagctgctttctaattttatacacattattttccttcattctccaatctgtcttatttcatttagtgcaatccagagactgaggtctagaggccacaggtggtctggaaaagatttctagtgtacctcaaagcccctactctatttccttgtctctctgtctttgcccatctcttctggacctttctgatgtgggagacctgggcagctgaaaagaaatgaagactaatactaatgggattaacttattacggtaactgtatttgccttgaaactctctcagtaaaagcccatttatcattagtaactgcaatttaaattcaaattttcatgagaccatctaaaatgtaaagtctatcagagattgttctggtctgcctattatacttgatggttttttagtatcaatattttggaatcaacattttcgtgtatatgtcacacaagcaaatgtcagcctttcactggaactatcagaaatgggtgattttccatcctatttctgctacccctttttgaccatgtcacaaaattgtgcatatacaagttccttgcctggtgaccaaaaaagcagagtcattgttttattcacattcttctagataggaaaatagctaatctaagttgtcagaatttatctttttccccaagagactcaataaagctctttgcatttggaatggaaaagcaaatgcagccttaagcctttcctgttcatgaaatggttatcacaccaaaagaattgctcaccactgccctgtctttttttgtcagttccgcagaaagggaaccttctcatttacaccgagtttggcaagatgcttgtacagcccaatgagatctgcgtcattcaggttggtgatgtgtccccttctcttccctgcctctcactaatttgggagcagtcagatgtttcagctgctgctatttccaactctaaaatttctctgtcatgtctgggcaacgaggagggaatctgagttatgcagaaggttccatgtgctgaagagtaagcaagcttgggtgcctgctttcttttaatatagcacataattctaaaggaaagaccacttgtcattgcactttcctaaatatttacatatactctggataaggccctgttcccactaatggcagtagaggcagtgaaggtggactttttttttttttagtgtggctaaatcaggcttaccattatctctggacccaatgagagggtagactagaattggcttgggtcacatgtgtgattaggaattcagtttttctttttaaactgaattttaaaaatttctttttaaaaaaattcagtttttcatgtttgctctggtcacctcccaagcagctcaacaaacaagagctttacttttgcatgtgggatgggctatggctctgggcagcttctttataactacagctgtgatttcagagggcacaccagtgtctgctttccattccagagaggaatgcggttcagcatagatgtctttgaggagaccaggggctacatcttggaggtctatggtgtccactttgagttacctgaccttggaccaattggtaaatcttcattacaagcctctaagcctcgcttgagatgtaggactcagataattgcatgaaagttaaacatccttctcccttcgctgtctcactcaaacttccacttttctctctagacaaattcttctctagaccaagtgtcttcccagaaaatatatgcaaaacagaaagcaacccaaaccaatccattataaatctctctagaatagtatacagacattggagataaagacggcatgtaatagatttctggttgcatagtgtgtacaggaaagaatatagaagtttgggttactgtgggcttgggtcaccagaaacagctccacagaagagatgagaatttgactaattctttatgaaaagttgaggagagtaaagaggaaagggaacagctttgcaaaagcatataagtgagaataagctttgtgattaggaggaagatatttttgttaagtcagtgagatttataatggattggtttggattgctttttgttttgcatattgtataaaatgggaaggccataaaaatgccctgggctgtattcctatggaaaggagggatggactgggtgacacatagtctatgaacctctgtgtacaccccaccaaatccacacacttagcagtcaaaaaaacacatcactcagtgctatgagagatctagaaaccacaccccaggaggcagattaaaacattccaaagtgaaccaaggtctccacagcccccattcttctggcaagctggaggaagtgaaaatgttaggaggggttgttctcaaactgtctcttggattgaaagaaatggctgggaaaattggcccttggtttactctttggtcacatctcccaattcttcccttccttgtcaacagctttttagagcaaacagggacaggccagtgtgtgccttctggtcagctcctctgaggaatccaaatatgcagaggaaggtgggaggcagcaagaggcagctggagccgtggtgggccgtctgtcatcctgttcacctcccactcttcccactctgctctggcttcctgctgctctatagtcagcatagcctccaggttccgtggaacatgtaccctctggaaaatatctataatttgctaaccagccggggacttatttttttaagtccaggagctggaaatgataaaacactcctcagctcgctcctctcagagttaaactgtttttgcacttaagtttttcatgtttggtcttttgatttatttcctttctctggaggaaacactcactcctaagcaaaggtaagcaggcaggtcctaaatacttcttcctgagtggcagacagggtttttcaggctggagaaccgttttcagactggaatctgagttctgtctagggagcagaggcatgccttaggcaacagcgtgtaaccctttctatctgagatcaaggactgtcaatgacttctagaatattcaagggttccttcaaaagaaaaagttctggagttctatcagatcttcccttttcctcttttcagttctctttctctcttcccttcccctcacctgtagtgataagataatgcatataagattgttttgttaaccatagtcactccacaaccttagaaagtaatgctggtttttgtgaatttttttctgaccagattccttgggtcttcctaaaaggtaccagactggaaatgcagtgaatctttgagcaatgaaagcaatttgtggagtagctcttgacatgaaagaaagcctttctcttcatgcaaccatgggcatctttcctatgttttggaagtttctaaaagacttttgggttactgttttctaggggccaatggcttggccaatcctcgtgatttcttgatacccattgcctggtatgaggatcgccaagtaccaggtggttacacggtcattaataaataccagggcaagctgtttgctgccaaacaggtaaagtaaaagggttggcaggcaagggaggaaatgaagagtgattgagcacttactgattgccaaggcgagtgttacaaactttacatatatcctttcgttgttatcataccactacggcactacaaataaagcaaatagttctagtagtcaattatactttcatagtcatggaaaaggccagtaatgataaataatttaccaatttcacagtaagtggcagaaccagaatttgaacccatatctgtctgactccaaaggttgtgccctttctactcaccaagcaatgaaaatattagcaatatgtaggtttctataagtggtatggaaaacataatatatgggcagcataatatgttctgaaaagtaaatgagttaacagatcagccaagatttatagtctccaataccaccctatttcaaatacaagcaattctacaaaacaagtagaattcagttaattagcttggcttggtttgtaccaccaggctggcaattcaggacacaagcaaaggcacagatattaataaataataataacaacaatgtaatatggactctataacataatatattactaaatgtactgaatatatattagaataaaataatcatataataagaagaacccaaagatctcttctgtttagcattatttgtttgcttcattttgtctatttgacttattccttatattttccaaggtatgttattcttcttaggcagcatctagagataatgccaaccagccgaggccaaccagtttggcacttaaaattaacccctgaagcagacatattgttattctcttattctctgggtcaaggtctctcaaaattcgggggctatttgcatcagaaatcctcaaggaggcttgtttaaaattcagatcctaggctgggcatggtggctcatgcctgtaatcccagcagtttgggaggccaaggcaggcggatcacctgaggtcaggaattcaacaccagcctggccaacatggcaaaaccccgtctctacccaaaatacaaaaattagccagatgtggtggtgcacacctgtaatcctagctacttgggaggctgaggcaggagaatcgcttgaacccaggaggtggaggttgcagcgagccaagatcatgccattgcactccagcccgggcgacagagcaagactccctctcaaaaaaaatgcagatccttagatactactctagccttgcaaaaaatgataagctttggagatgggacatggaaacctacattcattttaagcatgttccccagatcattgtttacatacaattgttaaagaaccacaattgtagaagcagccagtagctcctccgaaaggtttgcactttccaagtggaccctgtgctggttattttctgtgtgagtccccactgatccattctccctctttgccatgatctgtgccctggaaggttgactgtatcacccgggctccctagccagctggtttctgttgggttcaacccacaggaaactacaaggcaggaggaaagacaaattgggatatttcttcccctgcttcctcgctgtttaggactgtgtttctgacagtagctgcatcccccatatgacctcagttcctgttgggtagccctagtggtgggctggagctgattcatagtgacttgcaaaagctgatatgcacgcttctgtccaactgtgtatttgttgatgtcatactggtagctagaaaatcatcatggtgagactgtatacaccttagaaatcagtaaacactatatgtcaatgctttatgtatttttttcagagtgctagttgtgaaatatttaccagcacaccactgggtaacacccttctttataattctagctcttgctaaagtcctataacaatatttccctcctcattccacatgcccaggaatagcagtgtcttcccgctattgctaggctcagatacctcaacatttctagtcattccagttaaccctaaccacgcctctatgagtagcgccttcattaaaatctttagcactttcggacccatagatacagaagggaccaccttcctatagcaggacactgatcctcttctaccccaggacaggaccaggaagtattatgttaggattgctctgaaatctcaagtccttggagttggaacttttagaggccttctcccctctcctggactcaccaacccaggcactgtgtctattgcaagctcctctaggctgaaattacctggagaagcatcacagcaggtactctctgttccaggaaacagaaggtagcccagattgtttgagaactgctgacatccacagatcctcacagttaggttaaaaattgttgaaaaggcactacttggagaatgtgctgtgtttctgctgcatgtgtgatcagaaggcagctgcagcttatgaaccagaaaaatagggttagtggctaagtagagggtgtgtggagcaaccacaaaatgattcagggttatacttctcccaaaggacggtaaaattaaatcgagaacaaaatcaaatcaaaagaagagagaggtatactcagtacatattgtgggatcacagctacaaaagcattagatggtaaaattatcctttcctgctttttgtgtttaggatgtctccccgttcaatgttgtggcctggcacgggaattatacaccctacaagtacaacctgaagaatttcatggttatcaactcagtggcctttgaccatgcagtaagtctgaaccctgtaggggccttgggatgaggcaacgcttgggtgggaggggtccacagtagacccctgacatttacagatctaacatttccaatgtcaccgttggaagccctagatatagtcatttgtcctttggtgagggagtaaataacacaactagtagggaagcaaagccagatactcaacattcccctgtgaacatagcttcattctctacagagcattggtgatactctgacttgtatttgccaaactaagtggataaacacttagtttctttgtggaaaatttatcccccaaaacaaccaagtgttaatgtcggtggtagaatgaggagaaaggaactttatgaatttggagaagtccctgaccccacaactctcaagagcctcctctatgatctctgacttctcaccccagtgccttcattcctggctgtatttggcagtgacagagtgaacagcccacttctaaagttactcataactttcagtgcttgagtttaaaccaaagaaattctagagcatgaacttggtcatatttttcactcagttcgcaggccacaaatggtctctggtctacagtgcaggctcccaagaccctacattcttaataaagtggtggttctgagaccccggggggaagttcattttgcagctcacttcataagagatgaacctaacccacaagctggaaggataattagagcagaagtcagagactcagaggcaaaaggattattgtgagccagttcagtttatctctggggggacaaacctacctctccaaacagcagcaactcttaataaaagcaaaggggaaaagaaaagtgagacatcagaccccaaacaaacagcacgaaaaaggatcctgagacactgataaagctttatttgtgattcactacctttgctttaatagtttcagatcatgtcccatgacagttgaagaaatgtcaattctcacagcaataagggttgggtttatttttatttgaatttacacagatgcgatcttctctgtattgctgcaatagttatttttccaaaattcagttctgatcatgccaccactgtcttcattagaaagcctttgcaggcttcccatggcttaggattaagtctgcactctgaagcatggtgtttgatgctcttcaccatctgtccctggactcattttccagtatcacctcttgcccctctcccttctgtcaatgcactggggttttagccttctctcctcttaacaaaatctctgtgcactttgatgtgttttcagtgattaaaatgtcatttcccttccttcccacttccttagtcctccctccctccctccctccctttttcccccatccccgccacgtccttcctttctttttttttttttaacttttattttaggttcaagggtacatatgctccttccttccttccttctttccttccttccttcctttctctctctctttttctttctttctgttcattcttgaagacctacctcaaatgtcacctcctctttgaagccttccttgaccctttcaggtagaattagctgcccaacccccaccccacaattaatgctaaagaagcagggaatcgatccccatgatctttgaatctccagactcttacatggcatctgaaagggaacatgattgttgatttcaattaaattgaatctcaaccttctcactaaagaattctgaagagttttaaaaagtataatttcgtccctcaacctatcctatctctacactaccactatgaagactacggatgtaaatgctgtgttttagacctgaaagtcaaacaaaggtaggaaagcaatgaaccacttctcagacttttctgccaatggatacaatctggaatctccgtattctcccaaagaggagcacatctacaccaaaacttggattttgctttatttctatttctactttgctctgagcatcccttctgctgcacatctcagctctagtcaacttgatctgaggttgagaagcaggcaccgttggttctcagacccacggggtaataagttgcatgtaatgtgggctcagcagggtgaaaaagcagttcagaatccttttagctggtgttaattcattttgcctcaagcacagcaagaggaaaaagtcatatgagtgattattgcaccttgatgacaagcccagacttctgttgtttgatcagaaattaggctgtccgtttgcagcaacatggatgcagctggaagccataatcctaagcaaattaatgcaggaatagaaaaccaacttctgcatcttttcacttataagtgggagctaaacattgagcacccatggacataaacatgagaaaaatagacactggagactactagaagggggagggtgaaaaaactacctattggatactatgctcgctacctgggtgatgggatcctgtattagtccattttcatactgctgtgaagaaatacccgagactgggtactttataaagaaaaaggggtttaacatatccacagttccacatggctggggaggcctcacaatcatggtggaaggcgaaggaggagcaaaagcatgtcttacatggaggcaatcaagagagcatgtgttggggaactgccctttataaaaccatcagatcttgtgagacttattcactatcatgagaacagcatgggaaaaacctgcccccatgattcagttacctcccaccgggtccttctcacaacatgtggggattatggaagctacaattcaggatgagatttgggtggggacacaaccaaaccatatcagatccctaccccaaacctcagtatcacacaatatacccatgtaacaaaactgcatatgtatccctctatctaaattaaaagttgaataaaaataaataaaaaaattagaatgtcacttgcaaacaccttcatgtatgcatgaaatgtgtgtcattgtccagtcacttcccttgcatcatgcgttcagtctctccttgtgtgttcacaggacccatccattttcacagtattgactgctaagtctgtccgccctggagtggccattgctgattttgtcatcttcccacctcgatggggggttgctgataagaccttcaggcctccttattaccatagtaagtctctcttttaccaagccacatttgcaagccaaagagacaacaaagcagtgagcgctacacattgggaataatgcctgggttatttctggacacccaccatggcatgaattcaggatcctgctgcacaaggcctagtgctgatccccaagctttaatctctttaagggatggtagttgtgttagtccattcttcgttgctataaaggaatacctgaggctacttaatttataatgaaaagaggttcatttggctcgtggttatgcaggctgtacaagcagcatggtgctggcatctgtttctaatgaagcctcaggaaatacaatcatggtggcaggcaagagggaagctggcatatcacatgatgagagcaagcaagagaaaggaggaagtcccagcttcttttgaacagccaaaccccatgtgaactcatagagtgagaactcactcataaccgtcatgatggcaccaagccatttatgagggatctgcctccattacccaaacacctcaaaccaggccccacctccaacactggggatcacatttcaacatgagagttggagggaacatacatccaaactacatcaacagtgatgcattgattctgagcctagttcccagtttctctgtccctgtaagaggcagaaaggctggtaaagtttagaagccttgttagaaaggcttctaaacaagtttcctcacattttagatgtttccttttggggaatactggggaggttgttagttagtctgttgttttgggaaagttcatcacctaagtctggttcagagaaccagagaaataagaagagagagacagagagagacagagagagagacagagagacagaaatgtgccttctccaattattttggcagggcaaagcagactgcagcctgcattaaggaatgaactctattctggaaagagtttctgcagaacatttgttgcctagtacaagacctaacaaatctactatttttattttattaatattattattcttagcacctaataattattgtccaatttctatggctctgttacaagttttttaaaaaactaactcatgaagtgtttataatacttgtaagagacaggtagtattattgtcccccccgctttttttttttttttttcagaaaattaaactgacacaagagggattaagtaactctctcaaggactcacagcaagttaagtgtagagtcaggatttaattgcaggctgtctgataccagagcaaacactcatgaccactaactggtatggctagcatagtgcctgatatatagcatgcttttaataaatatttatttaataagtgaatgcatcaacaagaataaataaagtacttcacggctgtacttaatgaggttgacatttttaattgtgcaatagctagctgaaaatccaatcaaaggtcaatgtgcaattctacttcctggagtgtgcatttttttgtgcatagagttctggaaagactctaagaggcattccacctggaacattctagaaaacaaattcctttctttagtaaactccagggccttctgtttataataggtccctctctatatataccagttcccaggtgtcagggctcaacagaacacaacagtgcactgaatggccaatttagctattttatagcatcaggaatgaaggcccttaggatggacgtaggccactccatggtcaaatgccagcatcccccttttcagatggcaccatcatggtagagaaaagaaaacaatcagttaccatggcaaagacagcagctattttgtgaatagcatcataagtcgtttctaaaaactgtgaagcctactaaagactctaacttttctcctcctggaagttagtgacctagaggacctgttgtcaaggagagaaaattgccctggcttatagtctgtacttcgcatgttactccttaataattcaccatttcactcttgttcttgtattgaggttactctgtgtgcctgtagtggttcttacattttaccatgtgtcacagtcagctggaaggtttattaaaacacagattactgggctccatcctcagaatttctgcttcagtaggtctgggataggacctaagaatttgcatttttaacaagttcccacaagtgatgctgaatctgccttttttttttttttgagacagggtctcactctgtcacccaggctggagtgcaggtggcacaatctcagctcactgcaacctccaccccccaggctcaagtgatcctccccgctcagtctcctgagtagcttggaccacaggtgtgcaccaccacacctggctttttttttttttttttgtattgttagtacagacggggtcttgccatgttgcccaggctggtcttgaactcctaaactcaagcaatccacctgccttgacttcccaaagtgctgggattacaggcatgagccaccatggctggccagaatctacatttttcactggcaagtcaggggattctgatgaaggaggtttacagactgcttgttgagaaatactggcctagggtgtgtccccatccctaggtggaggaataatagagtcatctgatttagacaagtttgctactgtgctatagggtctcaacccattccttaatttttatttgtagttcagacttgctgacacaaataatcttgagagatgcctcctatagttttttaatgactctcaaagtaaatttggccccagggtagatcttataaaggtatgggtaccctgagttcgttgggaaaaaaccacagaaccccaggttagaaatgagttttccagagatattaaaaatattgccttggcaatactcaaaatctttgctgctttgatgtgactttattataagagaaaatggagaattatttctatagaaatattgcctccagtcatcttaatgtgccttagtcaactagattcagctttttttttttttttttttttttgagacggaatctcactctgtctcccaggctggagtgcagtggcgccatcttggctcactgcaagctctgcctcccgggttcatgctgttctcctgcctcagcctcctgagtagctgggactacaggcgcccgctaccacgcccggctaattttttgtatttttagtagagacgaggtttcaccatgttggccaggatggtctcgatctcttgacctcgtgatccacccgcctcggcctcccaaagtgctgggattacaggcgtgagccactgagcccggcctagattcagctttaatcagaaaggcaaggtctatcctcccactgtcctttgaaatatagaaaatgatatagaaatgtcatcaccaagctcactgctatctaaattcatattcagatcaaagctgaattctgttttgctctcttcttaaaattaagccatgaaggtgaccctgaggacacatactagagcaaggagcttgacaccaaatttaagtcatgagctgaactgtttttaaaacatagacaatttatgcttacatttgcttctttttctgtatttccacttcatagagaaacaagtagaactatgatctgggtctcacctcttcagcaggagctcacacactctcactcactttgtaggggcctgcagtagctttctgtttctgagcagggtgggtgtggctgcttagtcaattataaaagcatttggcacttggttatacttcacatgtaagcaagaagggcaggcatgtatcatgtccagtgtttgattttgtaagggttgccactgccacatctctctattctgtccttggtttgccctctcagtactctcacaggacagactatgagtagctttaaaggctatgttgttgttgttgttgttaattatttcttttttaagtagctttaaaagctatttcttattcatctctgtctcatgttagccagcacatatctaattatatgtgctggctaactggatgggcagatgggtgaagtgggaaaaagacagatgaatgaatgggtaagtagatgtgtggtttgagatgcaaaggcacttaaatttgcccaggtgttatatttctttaattcctgctctatggtattgctactctaataaagagctttatttcaatagaagcataagattggaagagtggaagcatggtgatttttgttaaattttgtgtgactctagaaagcacaactaggaccaatgaatttaactcatataaaagcaaatttccatttaatataagaactttcttacacacagagctcttcaataatatgatatgctttgtagagtggagagcttccattcacatccaggcagagcccgggaggtaatcagtcaggaaagatatagaaatttcttctacattgagtagaagtaaggataccttccaatttcaagatttaggactctatgaatagggtatcaatggaactagaaaaaataaaaacaaatccaaaagacattctgaagaacagaaaaacaagaggataacagattcatctatagaagataatatttgttataataaatagcatttatggtctgttttatacacataccaagattctttcacacagattatcatttgataatggactttaagtctggggttcttttcattacattatcatctatcatccatcaaaaccacacaccctcaatctaagccttctagattgggaattagaaatatgctgttgctgtgtcctacagtggagctacttgggaaagggttatgatctgggagataagataactttgatacagggctcgtaagcttagatgatagagtacattcgctctctattatgactagcattttaattattattatcttctctgggccctgattttctttagatctagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaaccttcccagggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggtaagtatgttaactgccacattccagcggcctctgaactccccacccttactgagaggggtggccgtttttcatttctccaaagtcacagaggaagagtcaaaagagggagagttaatgactgcataagtatgtttacatgtatatatactcacatccttgtgtatatactagacttctgttgtggtggtgtagaaagatcgttggacttggagtcagacctgggttctgagtttaagtcccatctcttagttcctacaggatcttgaacaactcacttagcttctctgtgcttcattttccccatctataaaatgggtatagtatccaacccagcagatggctatgagttaacctaacagactgtccaacactattcaaatgtaagggaacattattaatactatgtgaagcctcttcctgtatccttatgcagccctgggcatatgctatgtctcagagtcttctgcgttttgaagtaatcctccagggccacagtagtagcggaggcaggatctcaccttcagcacgtgtttcaagccaaggagggtcaaaaagcccttgcctcactatagtcagggcttgtgagaagcaattctcagctgttttttgcattttcctttgctctgctttggcatggatgcaactgatgggatttaaaacctgttttgtattcttcctgtgtcaggctgtaaacattgaggctgaacacaattgcagctggctgcggtgcttgattttattttatttttgcattcttcgaggtagagtttatggtccacagggagtaattttatgctaaatcacatgcaaatttgctttacttttgaaaataaatgccttcaatgctacctggtttaaaatctatagcagagacctgcctgcttcatgcttgcaaactacctaaacagtgagcattatctgtccgtctgtccactgcagtttgctttcagtcccaaccctggagccagagttggtggagctcctttgcaaaaggagggtgttcagagtcccatttgcttgctttggctctatttcccctttcaagggcctctatggagtttctgtagaacccctacatctcaaagagatgcagtctggcagtctcagttaagctattacctctgaagtctcctggaggtgcagtcctggaggctattctagagttgccactcaataacctttggtcccccaatttggctttgggtagtcaatgttatgagggagctgtgttttacaacagtgaggcgtaggacagggctgtttctatgaggagcaatactttgaattactagtgagaaagagctctcctattaggatgggagaccctgggtatcaaggagccagaatacctgatggcggagggtccaacatcttacctagacctaactttcagtcgtcctcaccatttcccattatataattcagacccaggtctatctacatgccttatccttattcttgtttggagtgattaacttggtacaatagcatcttcaaagtcagctgggatggggcttttgttaatccagccaaatggagaggcttttaagaagcagtcagcaaagagacaatagcaatggccataatgatccttgtatgtgaatagtgctttttaaaaatctttattacttattatttattatttttatggatacataataagtatgtatatttatggggtacatgagatatgatgatacaggcatatgatacgtaataatcacatcaagataaatggggtatccattacctcaagcatttatcctttgtgttacaaacaatccaattatattctttcagttattttaaaatgtgcaattaaatttttattgactatggtcaccctgttatgctatcaaatgctaggtcttattcattttttttcttttatttctttatttatttttaacttttatttgaggttcaggggtacatgtgaagatttgttatataggtaaactgatgtcacaggggtttattgtacagattatttcatcactcgggtactaaacagtacccaatagttattttttctgattctctccctcctcccaccctctattctcaagtaggcatcagtgtctgttgctcccctctttgtgtccacaagttctcatcatttagctcccatttagaagtgagaacatacaatatttggttttctgttcctcttagtttgccaaggataatggcctccagctccgtcgtgttcctgagaaacacatgatcttgttcttttttatggctgcatagtattccattatctgtgtgtgtgtgtgtgtgtgtgtgtgtgtgtgtgtatgtgtgtgtgtatgtgtatatatatatatatatatatatatataaagctcttaagtttaattagatccatttgtcaatttttcttttgttgccaattgcttttgatgtttttgtcatgaaatctttgcccatgctgatgtcctgaatggtattgcctaggtcatcttccagagtttttatagttttgggcttaacatttaagtccttaatccatcatgagttggtttttctatatggtgtatggaagcggtccagtttaaatcttctgcttatgactagccagttgtcccagcatgatttattgaatagatagtcctttccccattgcttgtttttgtcagcttcattgaaaatcggatggttataggtgtgcggccttgtttctgggctctctattctgttccattggtctatgtgcctgtttctgtatcattaccacactgttttggttactgtagccttgtagtatactttgaagttgggtagcatgatgcctcctgctttgttctttttgcttaggatagccttgggtatttgggctcttttttggttccatatgaattttaaaatagtctttcctagttctgtgaagaatgtcgttggtattttgatatgaacagcgttgaatctttacattgctttggatagtatcgtcatcttaatgatgttgattcttcctacccatgagcatggaaagtttttccatttgtttgtgtcttctctgatttctttgagcagtgttttgtaattctcattatagagacctttcacctctctggttaggggtattcctaggtattttattctttttgtggcagttgtgaatgggattgcattcctgatttggctttcagcttgactgttgttggtgtataggaatgctagtgatttttgtacattgattttgtatcatgaactttgctgaaagttgtttattggttgaaggagcttttgggctgagactatggtgttttctagatatagaatcaggtcatctgcaaacagggataggttgacttcttctcttctggatgcactttatttctttctattgcctgattactctttgccacgacttctaagactatgttgaataggagtggtgagagagagcatccttgtcttatgctggttttcaaagggaatgcttccagcttttccccattcagtatgatgttggctgtgggtttgtcataggtggctcttattattctgtgatgtgttccttcaatgcctagtttattgagagtttttaacttgaagatatactgaattttattgaaagccttttctgcatcttgaatagcactgtataacttgcatagcacttccatatgatctcatccagtcttcccatcaagcctgtcacaggaaatcaggcagcgatactcatatccattgttttagacaaaaataatttaatgtatattagagcccaaacattaatgtgggtgctttgggttgtagcacaagataattctattattttccttttgcctgtctgtattatacaaatttccaaatgtgagcatataagaattgtagggtttggtttttgggttttgttttgtttttaaagccacagtggataagaaaagtcagcaattgatgaagctgtaatgtctaagatgcacagagtatttacatattctttctgttgtggacaaaaacctcctgacagtgcaacatccaccattcagacacttctgagatatgacttttaaaagtgctacagccattcctgccatttccttcacctccctctcctccccactccctttttcccttttcccagcccatctcttggtcagagtcctgaaaagacaggctcaaatcccagttctgcgatgacttgtcgccttaagcaagtcgtttcccagctctcagccttaattcctcctctgcaaaatgggaagtatgactttcctcacaaggacatagccacagtaagtgaaggccctcagaagatggatattcccaggattctcccatgtctgcccttggatctagcagacttagttccgtaataccatgaagataatttgaagcttaagggctgaattttattttacagaatgaaacttgaggccctgagaagttaagggtcttgtaccaggtctcaccagcttacaaatggtaggaccagagccacaactcagggcttgagcctgctctcctcaccactctagcacacaaatctttgatttgttattggaagatttcacctacccataccttctgttgacatctaatcaaatgtgtttattatctatctcacctcttttttctcatccccatcgtcacttcctccaggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgtagtgattggtcataatcaagtcttgatgagacaaacctggcaggtcaggtcagtcttgctaagattgaaccaaggcccagggccctttgccttgtggttggcctgaatgccttcattctaggagcacaagtccaggcatatactaggtatcacaagaccaggccataaggccaaacgttaagaccatgagctgagactggaggtatggcaaagctcttaggagccaatccagacatggggaaatttaggggatcatgagtgctccaaatatccagctttcaatcgatgaggaaccgggccaataggctgtctaatcttggtagtcacgtagcagccaatatgatgatactggagaagaacaccagccaccaagaagtaagaatcactccttttcttggggtgaccaactgtcccagtttgtgcaggactatatcaattttttcactgaaagacccacatcccaggaaacccctcagtcctggtcaaaccaggacagttagttaccctacccttcactcatttatcaatccattcggtaaccacatgttgagtccttactaccagctacagttgaagatgctgggaatgaagggttgaataaaaagaagcaggctgtccccttaaggagctcacagtctggagagataagggccaaagaaaatcaaggcccgagtataaggccatgataaaaatttccactgtgtgaaaagctgtacctaccagttcccttcctatggtcagcatccctcccagagcgctgggctgcccaagactttagatgtgagttgattagagtctcctggtgtgaaaagacaggcaaatctgaacagaaatatgatggaaaatgatatttttcactacttcagttctgtactttgcacatttccccagctttgttgccatagtagcaattttgatatgctgctaccaaattttcattcagtaagatgtagtgagagtcagctatgtgtcagggcctaaggattaggattgccagataaaatatatgaggcccagttaaatttaaatttcagacaaaccacaaatagtttttagtgtaagtatgtcctatgcaatacttggacattcttatgttaaaaaattattaatcgattacctgaaattctaatttaagtgggcatcctgtatttttatttgctaaatttggcaatcctactaggggtaagtggtcaaggagataggcatggtcctgcccttaccaaggttacattacagagagggagatgacatgacttccccctggagagatagcaaataaaataaataaataaataaataaataaataaataaataaataaatagagggagttcgagtgccgtggctcacacctataatcccagcactttgagaggccaaagcgggcaaactgcctgaggccaagagttcaagaccaacctgcccaacatggcgaaaccccatctctactaaaaacacaaaaattagcctggcatggtggcacatgtctgtaatcccagttacttgggggctgaggtatgagaaatgcttgaaccctggtggcagatgtcgcagtgagccaagattgcaccactgcactccagcctggttgacagagcaagactctgtgtcaaaaaaagataataataaaataaagagagggagacaacaaaataaacaaaaatattacaaactgtggaacgtgctgagaagaaatcaaacggggattgatatggaataacaagtggtatgagctaggagagctctttcttcagaggaaggaaggtcttcagtgaagatgtgactttaaccagacctaaaggataggaaggagcaagtcattggaagagcggggatggggagaggtgggaaggggagaagcattttaagaaaaagcctcatgggattcaagtgcctgaaagaggagtgaatgtggggtgcccaagaggaagctattgcgatagtccaagcaaaaataaaccttgtcctgaactaatgaggtagcagcagagacagaagt

SEQ ID NO: 13384 - DNA, 38559 bp, Human
  misc_feature (1)...(38559): n = A,T,C or G
agtcaactttctgtccagtgggatttgtaatccaatgcctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcgctcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaaaaaggcagcggctccttggtaaagctactccttgatcgatcctttgcaccggattgttcaaagtggaccccaggggagaagtcggagcaaagaacttaccaccaagcaggtatggtttttctttctttctcttttgctgggggctgaccgcccttcagctccagccaaaagatgtgtgtgaacacaaatataccttctgtttgaggtcagcatcatagtgggtcgtgaatcatgttggccttgctgctgtctcctcatttctagggtggaaaaaaaaaagcatgaaaacaatcacttaatgttgagccccattactgatgctctctggtcctgcactagcctcctagaaaaatcaccacaggagaagccttaactactgcatgagttaccacaagtcacacatacaaccagctccctgttacagggctggagtccctggacccaggaaataccacctccaaggactgtgggagctggggactatgggaactgggatcaactcagtcctgattccttttggcctgctgggttagtgctggcagccccctgaggccaaggacagcagcatgacagtcaccaggactcaccacttcaaggaggggtccctcagagcacctgccatacccctgcacagtgctgcggctgagttggcttcaaaccagtgagttttctacctctactattgaaagggcaccttgtcccacagaaccgagtcttgcctgcatgtggtcagtgccaccaagtccttcttctctccacattacagcccagctcggctgaagctatggccagaggcactgctttaaggccactccatatctaggacaggtcaacagacacctctgaggccactgagtcttgactcaatgaatcagctatagcaggcactattcctctcccacatggcctctaatgatatggccagagttgaaaggatgctaagggaggcctcagaggcttatttaatcagttggttaatgggaaaaagtattttgtggtacacaaatacgctttaaaaatattttagttatgtcataaaagtctaaacctggggttgacaaactatggctcacaggctaactctggcccaccagctgtttttataaatgaagctttattggaacacagccatgcccattcgttatgtattgtatatggctgtttttgccctacaacatcctttcaactctggccatatcattagaggccatgtgggagaggaatagtgcctgctatagctgattcattgagtcagcaaaattgaccaattgcgaaagagacagtatggcccacaaagcctaaaatattaactatctggcctttaacagaaaaagtttgccaactcctgatctaaaagctgtcaacttgttccaaaattattatggaataaacccaagacaaccacaaaactgactagactaggttttttaggtaataactttttaaattataaagtaatacatgatttcatgctccttgaaaatgagaaagcagtatagataaacctaaattcacctttggccattctgtcaatcctaatctccagtttccccaaaagtacttagtgtgatatatttactgccagaccattgtgtctgtgtgtgtgttcatctatgcatagatggactattaaacctatctgttgccatgttgttctaattctgtttttccactcaatagcaagacttggagactttccatatctgtatagagctctacttcatttattttaactgctacgtcatatttcacagtgtacacttcttttatttagccgttttcttttcgatagatatttaagcttttccaatttttcagtcttaccaatgaacctcactgtgtttgtctgcttctagacatgtgcacgtattgcactagaggaactactaagacgttgaattgccacatcacaggatatatgtggttcaatttttggctgccaaacagccctccacagtacccgaactgactgtactcccaccagcagagaaggatagttactgttcttccacactccaaacaatgcttgctgtttattcagtattttattattttttccattgaattagtgcaaatgacaacccattatttcaatattttaatttccctgattattaatgaagttgagcattctttttataggacccctcttggccattgtatttctcttcttaaattacctattcatatccttagcttattttatgtcggattttttttcttctttgtaggagttttttatttattctcaatgcaaattatttgatatgtgtgtaatattctctctaagctttgtttaaatcatactttttagccaacagaaatttttactattattgttgttgttattttgatgtagttgaatctgttagtttccctctttctggattttactctttgaggctgatttttaaaagatttctcaacttccaaaattatgaagctactttggtgcaccttcctgtaatacttttatttaaaaagttagtctttattcacctggcacttattgcaatacattatttcaatactatttattgaaaagtccatctttttcctatttgtttgaaatatcacctctatcatgtactaaattcccacttacacatgtccatttctgtgtccttttgtatttatttcctattcctgagccaatttccactataatgtttaccttttctacttgattttttcccccaataaatagaaaatctattttgtgttttgatattttgcctagttaccttatggaattctcttaatagttataaaagcttatcagttgattcctttggaatttctagttagacaaacatatcatctatatatagtaagagttttgctccttcctttccaatctttacaaaccttaattttttgtgtcttattggtttttctttgccattcagcataatgctgagtagtagccatggaagtagatagtctcagaagtgatgcatacagttgtgtgggttctatactgcacaattctaggagatactctttacaaacacttagatgtcctaggaattcttgtcatgttcctgatttccatttttattttgtactatgaactcatttggaaacttctctttgggactcgttgagattgaaattgttttcctctagaggatttatttttgcttttgccaggaacctgaggacagaactaactgggaccaccataagcttggggtctactggccacacaaatagtgagaatcctgacccaaacttacttgattgcaggcctgttgttaagaatttcaaaggagacttttctttttgctctacccagagccaaggctgagaaggcctgggatagacctgtctccctccatggtttctactgaggatgtcacccttaggggatcttgagtttatagtctatgatctggttaggctccaggctttgtctcctattctaccattaaaatccaggcctcaggcctacaggagtccagaaaactccaggatgatcatgacttccctttctcatgcctctggcttagcataatcttataaattttggcctcttgagacttcctttactttcctaccagctcaatcctgcatgaaaaatgacattcttaaaaatttagtatttctaggtgctgcataccaggaggattttctgtaaccaacttctccatcatagtgccagcaataaaatctttattttttattttaatgagattgattctaatgcttctccaataagatacctagtaaaagtgtttagtaactattccatatcaagttagtgaagctctcttctattcctcttggttaaccaagaattttaaatcatgaatgaatattgagttttattaaatgctattaagcattgattaatttccttatcatatctccatagttaattatatagctcatcccaagggtgatagaagcagagatgatccaatagccactaggacccttggaatgcagacccatgatttttccattaaaaagaacaataaattcagggaacgtggacaacattaattcaaattcttagtgtggttgccacgttctgtttgttgagccatcagactcttgccctcacacttcagatattggtgtcctgggcacaacctggggaggacaggaggaatgtgtagggaacctctcttgcatacaggggctttttaggtggcacaatttgaagggggctgggaaaagttccctgcaacacctcctgaacctctttgaaacatcgatataacaaactgaatatccaactggaaattgacataaagagacatatccaaatccgtcatgtaatgtttgaaataattttcctggatctgtgtaagttccaaagagtcaaactataaaaccacaggcaacactggcactacacatgcattgataagacataggcagttaactcagaggccactgtgtcctgttaaatattggaagagggtactgtgtgtacttatgacctgggctggtgccagctctcaaccctgatctgtgtctagtaaccttctgacctcttggatctgatgaccaagtcccaggaagcataaaggccaattttcatttatggccccctgaagagagcagctgacttctctttcttgaattcataaaccgtgactttggctatctgagtttcctctggaggcctgccccatgccagggccaatgaggaggcttttgttaataatacttgatttgtttcataaagaatttaaaacatatagcctcattttgcccccatgaattctgtgaaaaaacaacttgcatcatgtatctatttacatgacaggaagaatcagaataagggaaaagaaaagatgttctggccaggcatggtggatcatgcctgtaatcccagcaccttgggaggccgaggcaggtggatcacttgaggtcaggagtttaagaccagcctggccaaaatggcgaaaacccgtctctactaaaaatacaaaaataatccaggtgtggtggcacacacctgtaattccagctacttgggaggctgaggcacgagaatcatttgaacccagaaggtggaggttgcagtgagcagagatcataccatggcacttcaacctaggggacagagtgagactgcctccaaaaaaaaaaaaaaagttccgtcattaattgacttcatgaactggaacacaccccagagccccagtttcctcatttgcaaaagggataataagaactgccctgcccccgactcccttattcaacttgggataagccctgccctgccttcctcacaggcaccttgacatgaagttgtaattttgaaatcattttgtaaacagcaaaacttgtgcaaatgtgagttaaattcaccaaacgtctcccttcactgaacaacgtcaatggttttataggcatcacttgcctgcatcttagaaattcagtattcttatattacattccccttacttgcttttttctctttatcctctggccagttctgctattaatatgtgtgtgtgtgtgtgtgtgtgtgtgtgtgtgtgtgtgtgtgtgtgtgtggtgtgtatgtgtatcttggagatagtaggattatatatatatttaattatgcgtgtgtgtatatatatgtgtgtatacacacataattaaatatatgtaatcgtgtgtatgtatatgtatgtatacacacacacataattaaatataatcctgctatctccaagagtttctatcccaaagattatggtttttgtttttttatccatttacccccttttacttagactctgttgcttcaaattcaagttgcccactcttctcttcccataatctcagtgacctggttccaaagcttgtgctttgactcatttgaagactaaatgtatctgtatgtcctccccacatccttttcctgggaaggaactatctcaccctcaaagtacattgactttttaaaaaattattattattattactttaagagacagggtcttgctgtgtcacctaggctggagagcagtggtatgatcatggctcactgcagtctcgaactcctgggctcaagtgatcctcccgcctcagccccccagagagctgggactacaggtgtgtgccaccatgcccagacacttttaaaatttatttttggtagagacaaagtctcatgttgttgcccaggttcatctgaaattcctggcctcaagtgatcctcctgcctcagcccccctaagcattgggattacaggtgtgagccaccatccctggccatcattatacaaatttatttatttattttcatttgattgagacaaggtgtcattctcttgcccaggctgcagtgcagtgggacaatcatggctcactgtagccttgacctcctgggctcaagtgttcttcctgcctcagcctcccaagtagctgggactacaggcacatgtcaccacacttggctaattttttatttttttgtagagatggcatctcactgtattgcccagacttgtctcgaactcctggcctcaaatgatcctcctgtttcagcttccctaagtgctgggattacaggtgtgagacactgtgcccggcctgtatattgactttaaacaacaatttataatgtgagtcatttcacatatctctttgattatttattttatttcctagcaccataaagttgtttttattgacaagatcatcttctccatgccagtctgtttgtgtactgccaattttctgtctggttagttggatttccctgctactactgcaagtgtggactgcagacccatagcatcagctcacctgggagcttgtgagatgctgaagctcagacccaccacagacctactgaatgggaatttgcattttcataagctcctgggtgatctgtatgtacttgaaagctggagcatcactctcttagattgtaagcacaggctccaggttaccttaaacgggggcacttctgaagcaggcatgggagagaaggaaggcaaaaatctcaattgccagggccctgacctcctagagattaaaatgtagttcagaactcaggttgggatcaaatgcagtttaattgacatggttatctttttcttcctgattgtagtgcttttaactactgtattagtccatgttcacattgctgataaagacatacctgagactgggtaaattacaaagaaaaaaggttcaatggactcacagttccatgtggctggggaggcctcacaaacatggtggaaggcaaacggcatgtcttacatggtggcaggcaagagagagaatgagaaccaagcgaaaggggtttccccttataaaaccatcagatctcatgagacttattcactgccatgagaacagtattgggggaaccgcccccatgattcaattaccttccaccaggtccctcccacatatgtagcattatgcaagctacaattccagatgagattttggtggggacacagccaaaccatatcaactattgatgttactttcctttgtttcctttctttctgctgcttctcctcctcacaacttctgtttcctcggggcccttcctgcttcacagcttccctgtcctgccttctctctgagtgcactgtggctgccatgcacagggcaggactgaggcaccccaaccagtctactattttggcttccttttcaatttaaattcaatttaaatattatttaaatatttgatcaacatttatttggtgatgttctttttttaatttgtaaaatatacagaaggagcaggattgaaaaattaattagttctggtaaaattcaaataacaaattttaccatcttaagcatttctaagtgtatagctcaataatgtgaagtatgttttcatcgttgtgcagccaatctccagaggtttttcatcttttaagatggaaactctacccattaaacaactcccattcccctcaccccacagcccctggcaaccaccattctactttctgcttccatgagcttgactactatacctcatatttgtctttctgtgactggcttatttcacttagcataatgtcctcaaggttcatccgtattgtagcatgtgttagaatttccttttttttaaggctgactcatattctattgtagtatgtcccatgttttgtttatccattcatcagttgatgaaatttgggttgcttctacattttgtctattgcgaatagtgctgctgtgaacatcagtgtacaaatatctcttcaagaccccgatttcagttctttttggatatacatccagaaatggttgctgaattatatgataattctatttcaattttctgagaaattgccatattgttatctataatggctacaccatttttacattcctaccacctgagtccaaggttcccatttgtctacagccttgccaacacttgttattttctgtttatgtgatagcggccatcctgaatataaagtgatgtttcattatggtttccctttgcatttgccttatgattaacgatgttgagtactttttcatgtgcttgttggcaagtgatgttcttttaaatgtgtactatgttctttatggtcaaaataaataatttattctgtgtaattttccaaaccacacaacttcttggaaggcatgtttaagtgttcacataataaaacagtacatttcttccttgcaaacagccctacaccacatatttttccatttctggctctgtctgccaacttcaatgggctgtcctcagggttgggttggctggagtggccctgtgtgacaggcatgtgagtgtccctgagcaccgtacagatactagtctgcattgtcaaggagtgttttaagtctccacctcagggtgatgactgctttggtaggaaaggaggcaatctaaaattcacctgatttctgattcattccaataatgttttggtgtctttgaatatggcagccccctgggcagcagtccagccagcagaccttataacttagctctgtctgtatgtctgacatccagactcactagaagaggatctaaatgggccagggaattacttgtccctgggacagagcaattacaccatccctcataggccccagaaggcctatggacctttgcttgggcaccaggagcttctctgagagcaggtttggggtgggcttggcctccagagtggcctcctcctgcaatgtcaggctagattaacatctatgagagtctcctgtacaaggagaggtgggaggctgtgaacactcctatgtaacaccatttgtccccttgtgtgattgcttcaccaatgttgacagctcatgtgacacacctgtcttcttctgatggaggaaggaagtaataccattttctatcaaaagcattctttgatcatccctgtcctaaaaaaaagttacttgatgggtctcttgtcaaaatcagtgatatggtttggatgttttatcccttccaaatctcatgttgaaatatgacctctaggccgggctcagtggctcacaactgtaatcccagcactttgggaggctgaggcgggcggatcacttgaggtcaggagtttgagaccagcctggccaacatggtgaaaccccatctctactaaaaatacaaaaattagatgtggagttcagagtggaaacaggtgtgagagggttcaacagaagaaaacatagctgccaagtgtttgagtccatcggcaagtttggactggccttagctgttgcagaaggcatggtgaactctgccttatataacatggatgctgggcacagaactgtcatctttgaccgattctgtggagtacaggacattgtggtagggtaagggactcactttctcataccatgggtacagaaaccaattatctttgaccaccgttctcaaccacataatgtgccagtcatcactggtagcaaagatttacagaatgtcaatatcattccgtgcatcctctttgggcctgtcactagccagcttcctcgcatcttcaccaggatcggagaagactatgatgagcgtgtgctgccatccatcactactgagatcctcaagtcagtggtggctcgctttgatgctggagaactaatcacccagagagaactggtctccaggcaggtgagcgacgaccttatggagcgagcagccacctttgggctcatcctggatgatgtgtctttgacacatctgaccttcaggaaggagttcacagaagcagtggaagccaaacaggtggctcagcaggatgcagagagggccagaactcactggccactgcaggggacggcctgatggagctgtgcaagctggaagctgcagaggacatcacgtaccagctctctcgctcttggaacatcaccaatctgccggcagggcagtccgtgctcctccagctgccccagtgagggcccaccctgcctgcacctccatgggccaactaggccacagccccagtgattcttaacactgccttccttctgcctccactccagaaatcactgtgaaatttcatgattggcttaaagtgaaggaaatacagataaaatcacttcagatctcaaaaaagaaaaaaaaaatttagctggacgtggtggcatgtacctgtaatcccagctactcgggaagctgaggtaggagaatcacttgaacccaggaggcagaggatatagtgagctgagatcgcgccactgccctccagagtgggtgacagaggaagactccgtctcaaaaacaaaaaacaaacaaaaaaaaagaaacgtggcctccaatgttggaggtaggcctagtgggaggtgtttggtcatgggggtggatccctcatgactggtttggtaccctcggtaatgagtgattctcactcttagttcatagaagagctggttgtttaaagagcccggcacctcctctctctcttgctccctcttgctgtgtgacatgccggctcgcacttcaccttccaccatgcttggaagcttcctgagacctcaccagaagcagatgctggtgccaagcttgtacagccttcagaagcacgagccaaacaaacctcttttcttcataaattacccagcctcagattcctttgtagcaatacaaaatggactaacacaatcagatctcactgtaactctggaaacttgctgcccacccattctcttctagccaaagtccactttttcccctccagagttaccacaaggaaaatgaacagcctcaatccttaccactcaggcaagattaaagagttacagtgcagcagagaggcaggacaggaccaccgtgggccaagcgatcccaactctgcccaatcagtggaggctgccttctggaggctgtaggggaggatcagtttcctcacctcttccagcttctagatgccgtggcaatccttggctcacagccccttcttccatcttcaaagccagcaacttagcatctgaccctttttccacattacgtctctttctctgatcaaacccaggaaagcttttctaattttaagattcatgtgattagactaggcctgcctggataattcagcacactccccatctccaggttctgtaccctcatcacatctgcagagacccttttgccatataaggaaacatattcacatgttctggggataagggtgcagacatctttgagggcctttattctatctaccataaggacacgatcaaaaacattatagaggcatgccaggcaattaattaatgaaagtgttatgacatttttctgaattctgtgatgttgttacttgtcctttttaatgtctgtcatttgttgtgatttcttttctcattctttcttacaaatattctcttcggtacataattttgtatttgtaattgcgtgttttttaaaattattttttagacagggtctcactctgtcacccaggctggaatgcagtggcacaatcctagctcaccacagccttgaattcctgggctcaggcaatcctcccacctcagcctcccaagtagctaggactacaggcatgcaccaacatgcctggctgagtttttttgtttgtttgtttttttggggtgtttttttttgagatagagtctcactctgttgcccagactggagttgtgtgaacatggctcactgcagcctcgacctcctgggctcacgtaatcttttcatctcagcctcctgagtagctgggaccacaggtacgtgccaccacacttggctaatttttaaacttttttgtagagacaggatctcaccatgtcacccaggcatgtctcgaactcctgggctcaagtgatcctcccactttggcctcccaaagtgctgagattataggtgtgagccactcacccagccttttttttttttttttttaagagatagggtcttgctatattgtccaggctggtctcatactcctcacaattgatccttccacctcagcctcccaaagtgctgacattagaggcatgagcccccacacctggcctatattcttttttcttaaataggactgcccaggccaagcgccatggttcatgcctgtaatcccagcattttggttggccaaggcagatggatcacctgaggtcaggagttcaagattagcctggccaacatggtgaaaaacctgtctctactgaaaatacaaaattaatctggtgtagtggcccatgccttgcggtcccagctacttgggaggctgagccaggagaattgcttgaacccaggaggcacaggttgcagtgtgccaagatcgtgcctttgcactccagcctgagtgacaagattgaaactctgtctcaaaataagtaaattaaattaaataatgtaaaataaaataaaataggactgcccaaattgtgtaagcctcagaacccacgtaagctgactaaagggcacctctacttgcccattgactaacctgaacaccagatgaaattgctcttccaaacaccactagctggggagttggctcttggctggggttggtcagtgcacaggccagtaagggagctgggcaagtgcagaagtggagactagctgtgtcccagacagcgactctccggctgtgaccctggagagtcctttagcagggcaaagtgcaacataggcagaccttaagggatgactcagtaacagataagctttgtgtgcctgcagggggatgggaagagggtggggcaggagagggacataaaagggctctgaggcattgtactgtgaattccttcagtctcctgctctgctcagccagtcagccctgcctcccttgtttaggaccacacagcactgctgggtgtctgcctttccttgtgactcttctctagcctctgcatggccagcagccctcttcttttctcctattctcttaagaaacatgcccatcacctgcagtttctctgggctccccgttaatctgccttcctcatctcctaatgctgcctcctccctcccattgccggtgcctggaaatagtcaaggctgggttctgttcttttgcttgaatttctttcacttggcttcttgactctttctaaactacaatccccccattctcactgccttagttttccctctctctgtgtttctcaaactatatcccaccacgccctgacaagggcttctctcctgtagatcatcccttttctagtattttgctagaaatatatagtgggattttctcctttgccctacatcatcactaaacttcccaacctaataggcagtgtcttgcaccttctactgatcatttcattctttcttgcactaaagatgaccacttcccatgtctgtacccaattcctgtttggcccaaatgtatctgcagcactcacccgtgttctcacactgagtctctaaatatttgactccaaaggtcactagtggatcacctccctgcctctcactttcccccaaggcacaaagtcttctcccagcacttctctttagtcctcctcttcctcatgtttcttctgtagggggaggaccatgttcaactttgtgatttttttctagtttgtagttgtgatctaccctgtaccactgagtcatctcaaatcacttaaacactcacaccaagtgtaccgcacttcacggcttaatcccctgttgatcagaaaaccccaggtccctggaattgaagcagggtctcattcagcctgacatgacctgaaatttctccctgactcctttcccagccccaagacaggggacttgcaagagtcccattgttgagcctccttggaacccactgtcttccattggtcatgttccacccagcaggttctatctagttctaatcctcaatgctgcttcgcatcccttccttgctccattgtccagccctgagctcactcaagccttgtactgctctccccttttcccttccctcccaaccctattcctctcctctctacatactcctgggagccttgctccttctgtagcagaaacttcacacacattttctttcaaattctcctccattgctatctccagttgcaccgctcttcttcatttctttccctccacattcaaacttgtcttctctggagggcatgctctcctgggggctccccctggcccagcctcagcatggcatctgcctttctggttccttcccaccttctctctcctcacttcttgccctgccagatctgtctatggcaacagcccctgcagcagtgcactctcctcttcctcttcatgcccaaagccatgtcagcctctctcagcagcttccattttattgtagagacactaagcatagagaagttagtgagtaaagtgagttagttcaacatcagtggcaagggctaggacatggcctcctgactatgacaacaagacaatgcccactatatctccagccgccaggagcaaaaaacaaagtcctctgacctccaggaggctgccggctagctgggtcctgtttggtcacaatcagtcattcccatgtttatgtgtgtgtcattcatggaagacctcccttctccctttaataggggatttggggcctcttagcaaatgaagtaactgcacaaagatatgtgtgtgtgtgtgtgtgtgtgtgtgtgtgtgtgtgtgtgtgtccccttctcattcttatgaagtcctaatgctcctccattacccccaaacaaacacaggggatcttatactgaaaatcagcattcacagaaaggaaatggcctcatgaggaagcagcaggaacaatctgtttatgggagagctcagtgggccaggcaggaggtgtcatggcccttcctctgcgtctaccatacctccttcttcaagctgtttaggtggtgctctggggtgtcagcctccaggcattcagctatcggactcttactctaaagaggaaagggaaaactgaggaaatacagacaattatagaggagaaaatgaaaataattccaaccccaaattcatcactatttcaattctatatatatacatatctacacacacagatacatacatacatatctctaaaagatagcatatacaggacattattattattgtagttttaaaccttcaatattgttttatatgcacccacatatttaccctttttagttctccatattccctcctgaagttccatgctccccactggcttttgccaggataactttctttggtattacttgtaatgcaagtatctgctggcaacaaattcttcagtctttgtctgaaaatgtctttattttgcctttacaatagaaggataattaaactattggtcaaattcttggatagcaataaagatattaaccattgtcttttctgttttacaatttcaactgaaaagtcaaccattaatcttaattttatttctttgtggttaattttttttttctgggtatttgtaagattagttttcttgtcatcgattcccagcaattttacgatgtgtgggtaggtatgtgtgtttttaatcctttcattggtttcaaaaacttcttggcaagtgtgctttcccagattgcttctgtccgattcttgtgtccgtaacatatgttaggctatttcactgagtctcgtgtgtctcttacgccctgttcttttcttaatgctcttttttgtttgtttctgtgcttcggtttatatattttctgttgacctaattttgaactcactatcactgtctgttgctgattcaatctgttgttaaaacatccaatgagttgtcagtttcagatattgtactattaatttctggaatgtccagaaatgtccagttgattatttttaaaaatagcattattgagagataccttatgtatcataaagtctaatcatttaagtgaacaattgaataactgttagtatatttagagttgtgcagctatcatcaaaatctaattccaggacatttctatgctccaaaaagtactcgggaggctgaggcaggagaatggcgtgaacccggggggcggagcttgcagtgagccaagatcgcgccactgcactccagcctgggcgacaaagagagactccgtctcaaaaaaaaaaaaaaaaagaaaaagaaagaaagaaaaagaaacctcatgttcatttgcagccactctctattccactctcagccacaggcaaccacgaatctactttctctatggatttgcctttcctggacatttaatataagcggaactatacaaaatgcggtctttgggtatacttctttcacttagaatgttttcaaggttcatctgtgctgtagcatctatccttcattcttttaaaccgctgaatagaatttcattgtatattagtattccaggtgcattccacattttattgatccacgaaccggttgatgaatatgtgggtcgggttttgggctattatgaataatgctgctatgaacatttgtgtgcagtttttgtgtgtgggcataggttttcatttctcttgggtggatatgtagaagtggaattgctgagttatggtgaatgtgtttaacattttaggtaactgagcaattgttttcttaagtggctgcaccattttacactcctgctagcagtgcataagggctcagtttctccacattattgccgattcttacctctttttgatttgtagccattcttgtgtattgtaagatgtatttctttgtggtttcaatttgccttgctctaataatcaatattcttgagtatattttcacatgtttattggtcattcatagcttctttggtgaaatatctattttaatcttttgttcatttttaaattgggttatttgtatttatattattgagttgtaagagttcttcatatattctggatacaagtcccttatgggatatgtgatttttaaaatattttctgtctgtgtcttatctttctactttcttaatagtgtagaaagcacaaacattttcaatttcaatgaagttcaatttatcaacttttttgtgccatattttttttgattaaaaaacaaacaaacacaaacaaaaaaaaacttttaaaagacaggaatagaataagtcttccgaatgtaatatgacaatctgtcttaccaaccaccagtaatatgctttataaggaaaactaggctgggtgtggtggttcatgcctctaattccagcattttgggaggctgaggggcatggatcacctaaggtcaggaatttgagaccagcctggccaacatggtgaaaccccgtctctactaaaaatacaaaaattagctgggcgtggtggcaggcacctgtaatcccagctactcaggagactgaggcaggagaatcgcttgaacctgggaggcagaggttgtgcaccactgcactccagcctgcgtgatgagactttgtctcaaaaaacaaacaaacaaacaaacaaacacacacacacacacacacacacaaagacatataatacccgaagccttcacgcttttggtgtcatatctaagaaatctttccctaaccataagaacttattcctgttttcttctcagagttttatagttatagctcttacatttaggtctatgattttgtgatccattttgagtaaatttttgtgtatggcacgagataagagctttaattcatcttgcatgtgaatatccaattttccaagcacctttttttagcaaagctggcctttcctccattgaattgccttgcatttttaccagagatcaattaatgataatagtaagggtttatttcttgaatctcaattatgacccatcaatctctatatctgtctttatactaatgccacattatcttggttattttagctttgttgtaagttttgaaatcaaaaagtgtaagtcctccaactttgttattctcttccaacattattttggctattatgggtcttttacttttccatagatcacagttctcctttgaagcttttcttgccttcatccctttgtctatattatcttccatttatttttcattaatcatagggtgttttttggtcgtttttttcccctttttgtggagaatgcggtcttgctgtattacccaggcaggtcttgaactcctgggctcaagcccttcagagcgtataggacaagatgcctctggatgtggtcagagtggcagtaaggttcctcggtccattcttctatagctggaattgaaatggcaagaaaaggagtgagggtcttagggaatcacttcctgcctgggaacagagagctacattaaaggagtcccatggcatggagggaccctgtctggggtgaaccacctaggaaaaagtttgcaggcaatcatggaaatgaagaaagtttaataaacggtttacccactcaaagacaaaccttgtgaaggatgcagcatagcactgaattaagaacacaggttttggagtcagactgacatgggttgagattctggctccacctcctcccagctaaataatgtcaatgaatcactcacctgaagaggagaggggctgtgtgtgctcagtgcagcctgacagtgccttcagcaaactgacaattttagtcacgtagaaagactaaattcattgatttattcactcatttattaaataaatgaattatattcttcctttctgagaacgtagtccttagctttaatacttaccctgcataccggattttacaattaattatctttgcaaagccctctctgaagaagcgtttactttcactcagtacaggagatgatcctttcaaccctcttctgatgagatttcaccgattactaagcaccgtgagaagcaggtggagccctcagaagcaaacacagttgtattcagttaaaagtacacatctaattggtctccctaaatttgcatgaaagagagatgtagctggcacacctcagacacccagtcactgtcattttcctgcccagagggcaacattctgtaaaggaacagtgatggaagagtggcatgggagcaggactgcagctgctgggctggctcccccatcaccacagttcagatctatttctaacccaactccaggggttccacttccattatttcttgccgtgtaacaaatctcccctaaactcactggattaaacccaccactgtttcattttctgacatgattttctgtgtcggctgggctcagctggggagttcttctgcatcacaggaccttggccgaggctgcagtcacctggaggcataattgggctggggagtccaagagggctcactcacacatctgctgtttggtgagggcggccgggaggctggggtggctggtcctgtctcatcggtgcgatctcaggcctctccctcttcacatggcctctccgcatggtctctttgggtggtcactgagcagggtagccagactttgttgcatggtggcttagggctctccaaagacaaaagcagaagctaccaggcttcttatagcgtagacccagaattgtctcttccccacattctattaactaagcaagtcacagaccatcctagactcattatgggagggggctgcacaagggtgtgaatctttcggggcatggctcctgggggccaccttggataacagctgtaatgggttctctagcgggggcttcataagcatatgagagaaggaactatagaatgtgccagagtcggcttgcttaacacttgggcaaaacaaaatgaaagttatacaaatactgcggaatgagattctagcattaattctactatctcctcattaagaaattggggaaagtgtaaattagacatgatttaagtaaatgtcttttttctggtcctttggtgacatttcttttatcttcttggtccatgtcacctgtgggcttctcctgtgattcatgtagtcatgttgtacttgtcacttccattatggggaagagcatttatatttattgcgagaaagcagcatctcaccatcttcaattgtccaaagttcacaattgatgtgcagaatctttgccaactgtctccattgccccaggtgctgctatccctcatggctcctgaatgatgctgaaaatgtaagggaggttggtctcttctaatgtacactctgaaatactatcctgctaataacattttctctgcctgcctgtgatgctctttgattttggaacactctttgtgtctgtgaacagttagagggttatgtaaagtccctgggtttttgtcataagagtgacttccaagttatttggaatacataacagaatatatctggtgtgtagtagatgctcaacacatgtctgttgagcaatatgataaatgctatgatgattgttatgaggaataaatgagtgccatgttctgaatgtttatgtttcccccaaattcgtatgttaaaatcctcatccccagtgtgatggctttagaagatggggactttggggggtgattgggtcatgagggtagaaccctcatgattgagttagtgtcctcatgaatgagaccccagaggccgggtgtggtggctcatgcctgtaatcccagcactttgggagtctgaggcaggtgatcacttgagcccagaagttgcagacaagcctgggcaatatggggaaaccctgcctctactaaaaatgaaaaaaaaaaagtagctgggtatggtggcatgcacctgtagtcccaggaggctgagttggaggatcgcttgagtccaggagatagaggctgcaatgagctgagatcacaccactgaactccagcctgggtggcagagttttttcttttctttcttttttttttctgtctcaaaagagagagagagagagcgagagagatagagaggtcccagagacccaaagagctagctggctagcccctttcactatatgaggacagagggagaaagtgccatagatgacaggaagcaggctcttaccagacattgaatctaccagtgccttaatcttggacttctcagcctccagaaccatgagagataaatttctgttgtttataagccactcagtttccgatattttgttatggcaacctgaatgcactaagacaatgagtgaccttttacaaaggacctgaataatcattattttccattttggtatctgttccatcccatattctctaatacaaaatctgtcccaaaacactaatcctgaacctaagattgctgcagctacctgctgaaaccatctttctcagtgtacttttttttttttttgagacagagtctcactgtgttgcccaggctagagtgcagtagcgtaatcttgtctccctgcaacctctgcctcccaggttcaagcgattctcatgcctcagcctcccaagtagctgggattacaggcacgcgccaccacacccagctaactttttgtatttttggtagaggtgaggttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctgtctctactaaaaaaaatacaaaaaaattagccaggcgtggtggcaggcacctgtagtcccagctactcgggaggctgaggcaggagaatggcgtcaacctgggaggtggagcttgcagtgagccaagatcatgccactgcactccagcctgggtgacagagcgagactccgtctcaaaaaatatatatatacatatatatttacatttaatatatttacatttaactaccaacatagttggtatttttttttttttttttttgagacgaagttttgttcttatcgtccaggctggagtgcagtggcgcgatttcggctcactgcagcctccgcctcctgggttcgagcgattctcctggctcagtctctcaagtagctgggattataggcacccgccaccacttccggctaactttttgtatctttagtagaggtgaggttttaccatgttggccaggctggtctctaactcctaacctcaggtgatctgcctgcctcggcctcccaaagtgctgggattacaggtatgagccaccgcacccagccccatatttggtatttctaccatacatctgtgttttctattcgtctcaccctttcagtttcttaactctctaattgccttcttttgaacttttttccttccattttttcctttctattagcttccaagttatgcattctatttttggacttttagtgataaccctagacatttcaacaagcacactttactaatcaaaatctaagatttaccatctttttttcccttcaacaatacagaaccttagttactgcatccatccatattttagttgtattttgcttttcctaactcccaagatattattattattggtttatgaagtcattgtttattccgatttttacagtaaatttttattcattttcaaatctgcttggtcaattttatggtcgtttattctttgtttatgtcttcaacctctcgtactgtttatttaaacatttctgtgtttgataactcagggcattttctcatgtctaattctagaagtttttttggtttgttttgttttgttttgttttgctgactcttgctcatcatgctgtgccagtcttttcattcatgacttctgagtatttgctcatatttctttgaaattatatgtgattatttgtgcctaggtataaagtggaaagtgagttcccccaaaaaggaggatttctggccagacgcggtggctcacgcctgtaatcccagcactttgggaggctgaggcggaggctgaggcgggcagatcacttgaggtcagcagtttgagaacagcctgaccaacatggtgaaaccccatctctactgaaaatacaaaaattagctgggcatggtcgtgggtgcctgtagtcccagctactcaagaggcagaggcaggagaatcgcttgagcccgggaggcagaggttgcagtgaacttagatggagccactgcgctccagcctgggtgacagagcaagacttggtccccccctcccccccaccaaaaaaaaaaagaaaagaaaagaaaaaaaaggaggatttctgttgggtgtctgggagaattaccaacccaaatgcactttaaatcttaaatcaactttttggcttgaggtttttgtgaacacctaaagtatacattttgtctgcaagcctacataaagtcaggattatgatttgaaaaatcagggattttcccctgtgcctgttcagttcaggtttccagtcaatgtattttattcacagtgtaatggagggccagggtcagagacagattaattccttatttactcttacaggtgaaactgtcagatgtcacctgtcatgatgttggaaacagaaatttatgtgttagaattttactaaagtttcgattttggcattagaaaaagcatcgtcatctgtggtggtgtctgcccttgtcagtcagtgcctagagagaattttggggatggtagtaacaggacaatcccccatttctactgaacatcctcagtgtctgttccaagtagaattcaagttatgctctcaaggtggaagttgcctggggaggacatccttgagtacagctcaattttttttctttcttttagagatgaggtctcactttatcacccaggctagagtgctctggcatgattctagctcactgcagcctcaaaccctcaggctcaagagatcctccccgctcagcttcccaagtagctgggactataggctcacaccatcgatcttggctgtttttttttattttttgtaaagatgagatctcactttgttgcccaggctggtctcagattcctgggctcaagcgatcctcttgcctcagcctcccaaagccccgggattacaggcatcagccaccatgcttagctacagctctattaataggcacaagttcttcaatattcactgagaccccagctctgctgggaccacaggccatttttcttcccatgttgtgatcttgcccaccatgcctccactttttccccatctgcctggctacttagttgaaaactctttctgctcagcctttctagctccctgtgggagcttgggccacaccccacctgaaagactatcctccctcaatgtccccagtcccagaaatcatcttgaacaagtaatctgtccatgagctgctccccattcagacctctggccaggttgtggcctcctaacctcagtccactcagctgtggcctccatgatccgacccagacagcctgctctcttttcttctcatttcttcctccctcttacccttatctttcccatgctcctgttcacatgttctactccagggctctatttttgtgtacaaaatgtcatgattacagctctctttataacaattccaacccccattccccgctttttttccccatgagaggtcagctcccgagttcacaggcccaaatgtgagtgatgcatagaagggacagagtgtttcctctgaggcctctacacatccctgtccagtcttttcattctctgtggttttctcatttctagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggtagagttacccatcagccttcacccacgtgccaccactgacccactgggtaacgtctcagggcctcagcttgacctgtcccccaggttcagagtgtgggctggtggcccacccaaaggccttgtaattagtctcaagggagccatttatatcccagaggaatccttcatcttcagtcttcctgttctacccaggaaaggtctccttccattaagatatcccttggtttctccatgtgctcttgaataaaatggaaaatgactcagtgaaagataaggaatttgaaaatcccaaatccaagtgttcacatccgccttctggggtggttgttacataaagaatggcataaaataaatgctcagaccatgggaagagaaacagaccgaagggaggggaagggtggggaggggagaaagccatgtgtgaggaagcactccaggtgcaccctccggagggcacagggtatgcaaggagcagctcccatctcgggagccacatgtgggaccctcatgcattcccaagacagccagcctgacagccctttgcagagttcttcgtggtggctgggcattcaaatggaaaagggcaggttccagggagaaatgaacattcgtgttgcatgagttataacaggggtgagacacatcagcagtgtcagactgggttcagctacaagtcacaggacacttgtcgccaattggtttggcaataaggaaaatgtgttacctctcctaacaggaagtctgaaggcctccaggttagtgagttcagcagctcatttctttccatttttctcttcagccatcccacctgagagctctgattgcagtctggctccccttgtgggggcacagtgctggggccccaggcaggaatcattatgttcagcagaagcgcacaaaggcccatctttgagagtaaggaaatctttcccaggagtcccctcacattggctagagccgggcccagcctatgcctgaactagtcactagcaaagagcagcaggtatgtccctgagctgggcacacgccacttgactgtgtggaagagggtggatgtctgcaccagctccagatgctgctggcacagaagaggctgcccaagcagtgttcgtgcatcctgcctcagcatgcaggaatcttctgctctcccttcctcatttgggtactattcctgggactctcagaaaaaggcaacatgttgtagtgggcaaaagctaaatccagtatcaggcagacctggattcaaatttcagcttgtcatgtacctggaggacagctggggatccatcgtctccaagcctcagtctccctcatctgtgctaggcagatgagattatgagtttcacagggttttagaactaaatttacaaaactgcaaaatacctagcctagcatctgatacatagcatacctttaaataatgtgagccccggtttcatcttttacccattctcagtggacttcgatgtagcatcagagctttcttacccaggccagttgggaaggcaaaaggcagggatggcatctgtgaagaacatgcccctgggctggtcactggtccgaggcccgaggcctccaagctcaaacctgccaggtcactgcgggcttggctcagcttcccaggcctgccctcggggacctctgcagccctacctggctgttccatgctcctgggccagccttccctcagtttccactctggaccagaatcagaggccagagccaagggagagattgtttctttccatccagctgtggagatggggaaagtaaaggtagggctgcactgaccgtgtcttttgtgggacaggcaggacttccgggctgggaggaggagatcttgtaccagagtctccaaaaggcatctgccccattgcctctctgcgcaccgcagagaggggtgtgcgggcccgtgggtcccgcctgcacgctctgctgttccaggcgctcgacctctttgccccctaggtcaacgaggggaatccactctgccatgggggaagtcgctgccccgtatggtataagaacttccccatagttcaccccttcctcccttggcgcccagtctggtaggggagctggagaaggcggcggggggttgggggtaggcgggggggaaggcgggggggttgggcgggcttctctggtnnnnnnnnnnnnnnnnnnnngtgagtggggtaggggggggtaaacgcctgtatggtggggcgggcttctctggtttcttaccctcctggggtcaggtttcctcagctccctcccttaaggaggggaaatcgaggaagaggcccatctccatggaaactttctggtaacaaggctgtgaaagagaaggggacaggtgtttcaggaagaagggaaggcgctgaggatgggcctggagaggaagtgtccctgaaagtggttttggggctgcccgcgccagcgaaaagcacgtgtcccatttcctgccggaatggccagaaaaggtctcctccccggctctgccccctctagctgagtcctggacctctagggactcccacctacacccttcccataaagcctgacccagctgggacgcaaaggctagtgtccccctccccgagtcggtaggggctggggagggaggtggtatggcccggagccccaggccgagggcccgggcacccgtgcatccccccttctgctccccattctctcacaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagagtgagcagtgggcgcgcgggcgggccggcgccggggtgcacggctctgagtaaggacgtgccgtgggtgtgtgcatgcttgtgtggagatgcgcgccgagtgtgcgcgtgaacacacgtgcacatgtgagctggtgtccgtgtgcaacaggcagccacctgggggagcgcttgcagtcggccctctgggagatggagggagtcggtaatctctgccctgggatgtgtgctgggcagccctggacagggcgtgccctctgtctcccctcagttgctcctgcatcattctttttgtccccttcataattgttgtaatggtttgaaaccacatttgcgggtaggagtgtgaatctgggggagggaagcaggagccacatgggtgataggacccggggccttctaggtgctagccccatcagctgccccagacctggatctttataggggaactgtttgcagacaggtgacatgaggtgttctcattctacctatttaactttgatatatttgtgctcctaggtcactatgagattaaggctcatgcggaaaaggctaggtgtttctggtgcatatttgtctccatggaacacaaagggacccaaagctgcttctttcaaggacaagttctctaggctgctggcaggcatttttgatctctccccaccaaggacctcatagctttgttctacacacatgagtgggctccagaaatccacagaagaccctaaggctctgggctatataagaagtctctggagttgctatttcttgctaagctgtagcccagctctctagggtcttggagacccagacacctctgaagagtcttggtatataattcaccagaaaatgataattgtagatgccatttactgaacatctcttatgtaccaggaactatattaggcaccctacatgcaaggtctcatttaacagcggtgcgaggtaaacacggtttctccggatcacaaaggagaaacctggagacaggagaggttaaggaggttgcttggggtcacaggtagtaagtggcaaagctttcatgcaaacccagcgcctttggattctgaagcccgtgctcttgccagggccccacagtgtcctcacaaactccactgcagagggcaaaacaccagcctcacctcatctctgtcctcacccaagtgtttctccagaagagcccacaggcctcttgagtccagacaggggagaattgcttgtcaccattactttctcttttgcctaacggcttctgctgccttgagagggttacacagtggctctccagggggctggaggctcaccaggggcacgtgtgcctgagccagcctcactgtccctgcagtgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccgggtaggaggaactgcacagtgacccgaggtgtcactgccatcttcattctcacatagaaactgaggttccccaaggataagaaacttatacaaggtcacagctaatcagtggtggagggtagatttggagagctggtcctgcatctgtgctagctcctcaaagccttagtctcattcccaaaggttctgaaagtgtggtccctgggtcagcagcatcagcatgcagattttcaggtcacctcagatctcctgaatctgaagctccagggaggggcaggaccccccagtgattctgttgcaggttcaggtttgaaaaatcactgctctctcctttaaggcaggtaggaactgggtctaagcaataagtggagggaaagctaggcagttccccagtgttgctggcattcggggctttatgaggacaggatcaggacctgttgggggtgtgacttttgtgaactggtgtttcttgatcccagcacattaactatgtctgtgctctaagtgccctccttcccctttgcactgatagatatctcaagtggcccttcacagcccaaataactggattagcccagtgacctcagatctgctcttcccatccatagcaccctaaaccttctgagtctcctgagcccaacatctggaatgcttgggatgacacaccatggttgcagtcccccttaccctccattttaaccaagcagggatgtgtgtgaccattaattcatagatccccaaagcaccttcatctgatagagaacaccagagagaagaaacaaatgctgtgtgtgtatatgtgtgaggacacacgcatgcatgtgggtgtgaatgcctgcatttgtgcatcctctcgagctgcaactgtggctgtgcatgtttggctggggcctgagttgggacctgtctatgaaagcacatgctgtctctcctctgtccacctcctggcatgtgtcctagctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcaggtaggacatggagactgggtggttgggtgtggaaaagaactggaagtggccaggaggttcaaagggcctggggtagatcctgaatttgggggatattggtgtcagaagaccctccttttcctgtgccctttccccgggcagccagtgctgctggggagtagagcccttgctgtatggctggttagttttgtggctgtgggcctgccagtgtctctgcctcttcacctgctcaatggaagctaaaaatgcctcccctgcagggctgttctgtgaaataagaacacatccgaagaacacccagcacagagtgggcattcagatagtcttttgtactctcccttaaaggggcaggaatcacatgttgacagttccagagcaaggaatgagaggaatagaaaagataaggctgtgaaggccatggggagggcgggtggtcctcagagcccaagggtcaggtctccccagagctagatgtggaggcaacaaccatcgggcaactggggttagtgggagacatgggaacttcctggggtggcaggaaccacagccccagaatatgtgtgcagtcgtaggattagggatggtgccaggtgtatctgtccttgggtaggccaccttgccttgccaagcctggtcaagtggggctgaaacacacctgccacaagctcctggtttcttcagcaggttgagggtaggttatactctaggagcccagaggttcttctctggccctgtaggagtcatgcgtgacttatttaatggggtgatgctgacagcaggtttggaatggggttcagatggtagcaaataagcttaaaggggcagggagagaagaatacttataaatgtggacattgggagatctttggtgaaatccagtgactgacaatttaacaccagggcttcccacttgctatttctcaaggccaccaatgtcgagcacagtgacctgaggtgtcactgccatcttcattctcagatagaaactgaagttccccaaggataagaaacttgtacaaggtcacagctaatcagtggtggaggctagatttggaagtaccaaagccagctcgatgccaggtcctaagctgggcaatggggaggcacagaagaataagatcaattacatggcatttgtagctcagtgttagggatctaaaagaaggatgggcgccagtagcacagggtctgaattcccaaggccaagaggtagtgtttcctcaaaacccagagtaagcagcctccctctcaggctgtgaagcttcctccttgtaaggaatgcctccttactggggaggtgggggcccctcccaggttgggagggagtgatccctgcaggaccggaagggtatccatgtaaccataatctcagaggcttgttaagccgcctccatggttaggcctgtgcttcagcgctaggagtggggcttcaggcatctgggctgcagggaaacagtagaaatacatgtgtgcacattaaacccaacaccgacagcaggaagcaaacatccccactactggaactcaggccaaaagggcggcactttcactctggaaaggggagactgcactctggaaagacttctgagaggggcaaagacatagcatggcctgaggggctagcaggatatactaaaggggaagtcattccaagggggaaactgaggcagaaaggaggaggccagggaccagaagccaaagcactagctgtaggtcaggatttgtataggagctgaaggagatggggccagcctgtaagggacctggatgccaagctcagtgggtggagttcccggaggttggaggggaggagaggatgctgcggggcagagctgtctgctgggttgtgaggggagagatgagaggcagccagacagcagccacagtcatcctcagggaaaggagccatcctccctcttcctctcacccccaacttctggattatgggatggctgctggtgccggcctgtgggctgcctcccagggagctgtcctcccctccccatccttgctgccagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtgcccgagagagcctgcctgccctggcagagggagggaaacactgcagttatgggaggaagggagctacgccaggatatgcaggttctgggatggcagggcaggaagatggaatggtggaaaacaagatattggtgagggatgattagatcttggtcagcttgctgagaagctgcccctccatcctgttaccatccacaggtggcttccagcaacttctactggagcccatgctgaaattccactacatgctgaagaagctgcagctgcatgaggaggagtatgtgctgatgcaggccatctccctcttctccccaggtgaggatctcccctaggctgcctgacatcccccccagccttatctgccctccccagggaaggtcccagtctatggccttgctcctcattcactgcgcagccaggatgggggctctcgctggtttctcctggggtcagtgggtgatgcccagccctggtcttccttcacttccctgcctgggtgactccagctctggagggtggttggcgagcaatgccctgactctgggctggactgagcttgtctttgccccatgatcttgcaccacacctccctcccctccagaccgcccaggtgtgctgcagcaccgcgtggtggaccagctgcaggagcaattcgccattactctgaagtcctacattgaatgcaatcggccccagcctgctcataggtgagcacagcagggggtgaggacccgtgagggtgatgtgagggagccgaggttcagggaaattgcccaagacttcatggccagagggtggcatctggaggtagccccagccagaccaggtccaaagctcacacttttgagcactacctaaccacttcccaggaaaaacacaagcaaacagggggacgtggcccagaaaggggcttctataccttcactggtcctcagtagctcctgtgacctactgcccagactgatgcccacagacccagagacaaacttggattttacggagcccaaggccatgaagggttaaggccaacactgagtattatagtgtgaacctataaactgaaatccttatttggcctgcacagctttctttttggcttggtgtcctgggatgctgggagtggccatgtctttatttgctcaacccttccttgtatggaggcaggaggctggaagtgccaactttcttttccatcatggggatactgaggcatatggtacatctcagacactagatccaaagctagttccaggaagggattccagcctgcagcccctaacctccacaacgactctgctcagtcctggcccctggacattaacgaaggcagtgacagccccacacccccaaactggtagctgcaatatctacattttcccacggaagtctctgtgtacaaagatgcaactcccgcagctgggtgtcgtggctcacacctataatcccagcactttgagaggtcaagacaggaggatcccttggggccaggagttcaaaaccagcctaggcaacatagccagaccccaactctagaaaaattttaaaaaattagccaggtatggtggcatgtgctctagtcctagctacccaggaggctgaggctggaggtctcttgagtccaggagtttgacactgcagtgagtccatgatcgtgccatcatgctctagcctgggtgacagaacgagatcctgtccctttaaagaaaaaaaaaaaaaaaagacacagctcccatgaatgggatgggagtggggagagtattgggcaggctgttctgcctttctcatctacagggtaaaagagaagcttacggaattcagccaagccttgtctcttggctgacctgaaatgtccagagattatgcttgtgcagcctcagagcagccctgaggcttgtgggtcagggcgggctgcacccacaatcttttctctggctggcatgcaggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggataggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggtgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacaatttggatcaaaaggagaaatgataagtgacaaaagcagcacaaggaatttccctgtgtggatgctgagctgtgatggcgggcactgggtacccaagtgaaggttcccgaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggctagaggggtaaacttttttggcctttttctggggaaaataatgtgggggtgtggaaatagaaacatacgcaagcatacatatttttactacttattttattattatcctgtataaatctgaagactccggcgtaagaacataaaaatgaattatttaacttggcttacttataaaatgattgttctgtataaaagtttaacatatgtgcataccataattaaaatgtagtccgggcgaggtggctcaggcctgtaatcccagcactttgggaggccaaggctggcggatcacaaggtcagaagatcgagaccatcctggctaacacagtgaaaccccgtctctactaaaaatacaaaaaattagccaggtgtggtgctgggcacgtgtagtctcagctacttgggaggccgtggcgggagaatcacttgaaccaggcaggcggaggttgcagtgagctgagatcgtgccactgcactccagcctgggggaaagagcgagactctgtctcaaaaaaaaaaaaaagtaggaattaattttaaatgtctaatatttcattcaaatgaaacttcacagtaactgaattttaaagaacagataattacttagcttttgacattttacaagaagcaggccaaactttgagaacatggtaaatcatcagtaatataaatcaaagcaagtaaacatattctgtcatccctctgactttaccagatttttctgcatta

SEQ ID NO: 13385 - DNA, 38559 bp, Human; identical to SEQ ID NO: 13384
  misc_feature (1)...(38559): n = A,T,C or G

SEQ ID NO: 13386 - DNA, 38559 bp, Human; identical to SEQ ID NO: 13384
  misc_feature (1)...(38559): n = A,T,C or G

SEQ ID NO: 13387 - DNA, 8158 bp, Human
ggggtggggaaggggtggtttgagtttctgcacatcaggacacgaggcgcggtccatgcaaatgaaatgcaaatcccatgcaaataaatctctgggtggtgcaaggctggaggtacaaggtgcacgcatttggggggcgcctgggaaccccatgaatcgagcccaggcccggaggtgctgacccgcatccagcccggctttcagtgctcggtgtaaatgtttacacctggccggccgccaggctccacgccgccccacactaggcagccaggagggggaatgtaaactcgggctgggggccgcgggacgctcgggaggagcccagacggagtcgagtgtggtgggtgtgtacacgtgagttattaaacaccgactgtatgcagtgaggaggatgccaccaggcactcacagcaccaagtaactggtgcccgaatgggtaaagctcagggcattcctgggggcccactagcgcccctgcaccagccagaggttgaagtgaatagggtaggcagccatggaaggctccctggaggaggcaccctccaaggtgagattgcaaggggagtgagagctaggtacagtgactcacgcctgtaatcccagctctttgggaggccaaagtggaaggatagcttgagcccaggagtttgagaccagcctgggcaacgttgtgagattcccctctctattaaacaaaaacaaaaacaaaaaaaattaaaaattagccaggcatggtggctcatgcctgtagtcagtcctagctacttgggaggctgaggtgggaggatcgcttgagcctaggaggtggaggctgcagtgagctgtgatcacaccactgcactccagcctgggtgacagagcaagaccctgtctcaaaaaaaaagaaagagagagagaaagaaagaaaggaaagaaaggaagagaaaagaaagagagaagaaaaaggaaagaaagagagagagagagaggaggctgggtgcggtggctcatgcctgtaatcccagcactttgggaggccaaggtgggcggatcacttgagttcaggagcttgagaccagcatagctaacagggagaaaccctgtctctattaaaaatacaaaaattagccagtcatgctggcaggtgcctgtaatcccagctactcagggggctgaggccggagaatcgcttgaacccgggaggcagaggttgcagtgagctgagattgcgccactgcactccagcctgagggacaagagtgagactccatctccaaaagaaaaaaagaaaaagagaaagaaaggggagtgggagtggggagggagggaagaagtgttctccatgcaaggacctatctgtgcaaaagcccagagctgggactccatgtccagggcagctctggtccattgctgcccacttctgggcctgcttatccatctggatgggaaacaggctcagagaggggcagagtcaatggaggacaccagcatgtagggaacagtgtcagccccagattcctgcctccagactgtcctaaacaccaccctccccgcgcctttgtcccacactgccacctgccgggaatgacctctcctcctttcactcttccccctggctcctcagctgcagccgctccggcctccttgctgttcctgggatacgccacactcagtctggcctcggggcctttgcactggctgtgtcccctgcctgtgatgccattctcctctgcctggccaactcctacgtttattcaagtctggaccttgtcatcggctcctcaggaaggcactccgggacccccagatgggggcggttccctgtgactcctggcacggaggccaaccccttccttgttcaatggttccttgagggaccattcccatgtgattatcgaccattcggcaggcgttcaaagtcaaaggccccacactgagtcctggcccagcgccctgtgcccgttggctgctggagggacagacggggcgtgcggctgaccatcccgtgcccgcaggctgaggatgcagcgctggaaggcggcggccttggcctcagtgctctgcagctccgtgctgtccatctggatgtgtcgagagggcctgcttctcagccaccgcctcggacctgcgctggtccccctgcaccgcctgcctcgaaccctggacgcccggattgcccgcctggcccagtgtaagctcctcctctgtgtggggtcagatacccccaacgtaaggggtagaatttcaggcagtggagtgggaggtggggggggtgtcataggttttttaaagatagggccagccagcccccttgcagggaggcagggacagacatcctaaaagattattcagggcaaggcatggtggcgcctgcctataatcccagcactttgggaggctgagacaggaggatctcttgagcccaggagttcatgaccagccagggcaatgtagcgagaccgccatctctacaaaaaacttcagaaattagccaggtgtagtggcgcacgcctgtagttccagctacttgggaggctgaggtgggaggatcacttgagcccaagagttcaaggctgcattgagctatgattgcaccactatactccagcctgagcaacagagcaagattctgtctcaaaacattataataataaatacattttctaaaaaaagatggggtggagggaggttgcaaattcccccaatggcctggtggagctagggtgacttctgggaactggggtctttcggctcagctgtcacaaggaattaggctctgccctgaggtcccgtgggggccagatggagattagacctgggcattcgcctggttggcccccgcggcgcagcagggggggcggtgggaggagagagaggctggatctgaggtcccagtgacctgccccaggggacagggaccaaggggaggcgggagatggagcaggagctaaaaaccggaagaaaggcccagagattcgaaggggtgaggaggggtggagagaggagagacggggctgggggcacagacacgggcaaaagtgctgctatagggacacagaaatgcccaccctgagggcaagaccctcgcccaactccccaccaatccctaatgcctgccccaccgcaggtgctgtggggtgagggtggtgcgtgggccctgacccctgtgcccacgcacatgtccatgcgtgcgcctgcgcgggcatctgaggcgtggatgccggcagggtgcgtgtgcagcgcctttgggtgtgggccacgagtacgcccatgtgcgcgtctgcgcccgcccctgccagcccacacaatcctcttttcttgtccttacaatgcacaagggtggcctccagcacgagctccacttctgtcctcccaccacttccctctctgcaagcggcgtgaagtccttcctaggactctgggacagagacccgggcgggacccccaaaatccagtgctccaggacttggggtgcggggggcaaagcacgaatggaggaatttcaggcactgcggagggtcagggcccatgggcgggtgcctgtctgccctactgcaaaaagcgagtggccactgactccccaagtccccatgttctaggctcctggtggaatttcaggctggggaccttgtgttctagcccctgtgcaagcagccagccccgttgcagggaggcagggacagacatcctaaaagatgattcattgttgccaggtgcggtggctcacgcctgtgatcccagcactttgggaggccgaggtgggcggatcacgaggtcaggagatggagaccattctggctaacactgtgaaaccctgtctctactaaaattacaaaaaaattagccgggcgtggtggcgggcgcctgtagtcccagctactcgggaggctgaggcgggagaatggcgtgaacccgggaggcggagcttgcagtgagccgagatcgcgccactgcactccagcctgggcgacagagcgagactccgtctcaaaaaaaaaaaaaagattattcattgtttatatggaattcagatttagccgggcacctgtactgtatcgggcaagcccacaaatgtctgcttcgatgcacccctctggggttgggtgtgccccctaaccccccagcacagtcctggccactccagtcctgctccggggcttaaagaacacggactaggttgctcagtcatcgcccaccccccgcaccgatttcccaccctctcagccccggccaagacagagatcatggaagcttcatgggacagacagggaaactgaggcctgaggttgcaagtggcgaaagtggcagagtcatgctctgaggctgggtttgtctcgtttctgagaccccctgtgggaacagacatctcctcccccaccaaaccccaggagacagacagcccctccttccccagggccacccagaggctcattcttttgacagccaggtgcaccagcccggggggcaggtggggactaaagatttcctctcccaaccacaagcgtgactgccacctgctctggggctgggagtcccctgcctgcaggtccgccagcagcgctgcctgtcattccagcgtctgcagttctctcccggggcttccgagtttgggggtggagccaccgcttgggtaataaatttaggctgccaggccctgggaatcggtgacttgggcacctcctggcgagtgtgggagaaagcggctggacctgggccaaacttgggtgaacgatgaaggcaggaagaatgacctttaagcccgcctctgtcgctctctctcggccacctgctaatgatgtgaccttgggatggtccgttttgtcacctgtcacatgggggtggccttgacagtagctgctgccactccatggagtggggtccccacacaggcttcggatgcagtaggctgcggtacctgctgctcctctgcattctgagaaacccaaacaccccgattcatttcttggatagggaaactgaggctccactgcacagcggggcagtggggatggagggagtctgaaaagcccggggcctcagagcagacgtcggggcctgaagagggggctctagagacctatgacaacctcactaaagagggatagggcatgggaagcagccccccagtgctgcccagagaggatgcaccagtgtcctggggcagcccagcataggggcggggtccagatagatttgcgatggaggacgaggagaatggagcagcaatggggtgagagaggggcccagaggaggtgagttagagaccccggtcagctcagctcaaggtgagacgggctggaaagcggcccagaaaggatggaccaggttctgggcagccaatataggctcagggttcagaaaggggttttggaccagcgtaggggtgtgagtgtgtacgtgccccccagtgccgcccagagagggtgcatgagcagctcagcaagagggtggggaaatttgggacctgggagtgagacgagaagccgtctaggcctggcgtcccagcaagggtcttcgtttgcaggggtacagagagggtagggggctccctcccaccccctgcacccactgaccccccctcctttctcttcctcccctcgcagaccgtgcactcctgcagggggccccggatgcgatggagctgcgcgagctgacgccctgggctgggcggcccccaggtccgcgccgtcgggcggggccccggcggcggcgcgcgcgtgcgcggttgggggcgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactgagataaagtgtggcaactcgagctggctggtgattcatcctcggcgaggggctcgcgtgtgggccacgtcgccgtctccaccgggaaagcggggaccagtggggggggcccagctgcagggtagtgggaggatgctgtttgctttgggggaagggtagatgcaaagtgggtccagtttatggcggacaaaaaggaaaatggggtgaatggggctatgttggcagggaccgtccttcctgcctccctacgggtccctctgcccgtcccgagcgtgttccggtccgcacctcttcgctgtgtgggcttctggggaggggaaagggaagctacgctcggatgaagagaccgaggtctaggtggaccccgtttccccagcttgttcccttccgcacctctccgcggtgcgggcttctgggatgaagacactgaagtctaggtgggcccagtttccccagattgtcgctgactgcacctctcgcttctgggatgaagagactgaggtctaggtggacccagtttccccagcttgttcctgactgcacctctctgctgtgtggacttctggagagggggaaagggggagacactgtgggtgaggagcctgagatccaggtggaatcagttccccgctatgtgggtttctaggaagggggagccactctgggggtgaggagagtgaggtccaggtggacctgggcctcccttatccgacggcctcctcgggccggtcttcgcccaccagggtgagctgaaagccactatctccttccaccagctactaaaaatacccgcacgctgcccacctcccggcggggagaggcctggggcgggcgccagccccatccagcccgaagccggcgcctgctggtgtagagctgggtccccagagacctgggtcctcggcccataaaagccctggccgggcctccacgggggggatttacgacgagcccctgcggagtatggaaaaagcccggctcggtgtttagatttccccacggtgtcaccttgatgcttggcaggcctcgggtgttgggttgccagagcgcgggaggggtcggcgggtcccacggtcggtctgaggggcggggaaggggcgggcactgcgagcccagagcaggcaccggcgaggcgagactcctcccctcctgcccctcagactgggggttcccaaggctacaacccttctccttagctgggccccctcccctccttcccacacgtctgcccttaggaccaccctctaaccacagtgtcccttcccaggctcagcccgcatccccccaccccccgcaaagctggagggcgcagatcggaaaccgcccccagggagaatcacccagccatgaaggaacatccctagcccctggctcccggggacccacagctacagctggagacactcaaggcggctaatcagcaggacttccagggagccctgagagcagggcttggcggccaggcgggtgatctgcttgggaagcagtttcagggctgccgctggctggggtccccgcctacccccgcagtcttctgactctgaggtttaaggtggtggattcctccaccctttgggccgactcagcccggcctccgcagagaggccggagttcccagacgctgcggaagcccaagtgacgcttactccgagcctcagtttccccatcctagatggcctggcctcagagaggagtgttgttcagcccaggacacacagcgagaaagctgaccatcaggggtctgccgcccccccgaagctcccctgccacagtgtgcatgtgtgtgtgagtgttgcccaccctccggggcctcccggacctcggccttcctgtctcccacccagatccagcgtcccaaccacagggcgcgggcccagcccaccagggaattggaacataaataaaccgagaagcccctgcagttccctggggctgcggttgtcatcagcgcatcggcacaccggatgagggtctctctcacacacacacacaagcacactcacaagacacagagatcaccac

SEQ ID NO: 13388 - DNA, 636591 bp, Human; identical to SEQ ID NO: 11808
  misc_feature (1)...(636591): n = A,T,C or G

SEQ ID NO: 13389 - DNA, 18417 bp, Human
aacaacagatatcgcagggcgccaagcgctgggctgacagcttccgggttattttttccccgacccctgacagcagccacaatggagctccccattttacagacatggaggcggaggctcaggccgaacaacccgtccgagctcacaggctttgcaggccacgatccgggaaccgcctggcctctccctcacaacccggctggcttaaaacaaccaagattgatttccctcgcagttctggaggccagaagtctgagatgaaggtgcaggctgggccacgttccctctgaaggccccaagggaggctccgtcctgcctcttccagctgctgggggccagcgagcctcacctctcttcgtgtggccacatggcctcagcctctgcctccgtcttcacgcggccgtctccgtgcggccatgttcaatccctgcattagggccaccacagcgacctcatctccacttgtttccatctgcaaagacacagacaaggtcccgtgctcaggtcccaggtggacgtgactagcccagaacttggctgctccagcggcgggggcgggggcggctgcttctccacgcagcttgttacatctgaatgtttagagtcaccatcgccagccttcgggggaaatggaggcacagtgaggccaagccttcctgagctggcgcctcaaggcagccggccagcctgccccgggggaagctcacgtcggggcttcctgctcagagccgtgaaggtcactgtggccgaggcccctccaagttggcccaggcacccaggaaacctgtgtgaaaggtcttgtactaaaaaaagacctgtccatagactacagctccagattccagaacagcctctcctgatgtcaccatctggcaccctttagagctttggcaggaaactgcagggaccacagacatgagcagaagcagctgtcaagtcctgggaatgaggaacaagacagggtatccgaggggggaccaggcggatgtccgagggggaaccaggagggtttctgagagggaaccaggagggtgtccgagggggcatccaggagggtatccgggggggaaccaggcgggtgtccgaggggggcacaggcgggtgtccgaggggggcacaggcgggtgtccgaggggggaaccaggcgggtgtccgaggggggaactaggcgggtgtccgaggggggaaccaggcgggtgtccggtgggggaaccaggctggtgtccgctgggggaaccaggagggtgtccggtgggggaaccaggctggtgtccgctgggggaaccaggagggtgtccgctgggggaaccaggagggtgtcaggtgggggaaccaggcgggtgtccgaggggggcacaggagggtgtccgagggggaactagaggggggtctgaggtggaatgaggtaggtaggcctcccagggggaacaagacgggtccccaagaagtccctggggggagtcctctgcaagtcctgtgaaacagtgataccagggcaggcacacctggccccgttgggtacctaagaaatgcttgctgacatgccacaaaagaggtaaattgaggaaaggggcagtggctctggctgaggacaaggtctctccctctcagcactgtggacattggggctggatcgttctctggagtggagctgtcctgggcactgcagggtgctgggcagcatccctggcccccacccacctcatgccagaagcaggggcggaggggacctccgtggcgcctcagtaccaccctgggagtgctcaggaggccctgggagcacgcgggttctctagggcaggccctgcttgcctgctggcctcacactttctggctgtgtgcatagccggattggtgagctctgggcctcaggtcatcatctgtgaaatgggcgtattaaggcctttctacctgggctgtcctggagctgagatcagccagcacccttaaagtgaggcccagctagttaggggcaggcctggggtgcctggagtggggagtgtgagggggcctgatgggggtttttcctgcacccccaggtatcacctcttctgggctcaagatggacaacaagaagcgcctggcctacgccatcatccagttcctgcatgaccagctccggcacgggggcctctcgtccgatgctcaggagagcttggaaggtaggtgggtgcctgccacttccccctctccccgggcagcggccagcacagtcgcctcgtgtagacacctggtgtgtagatgcctggtcccccgcctggctttttgggggtggaagctaagcccagagagggcaggggtctgcccagggccacacagcccccggccgtgggagccagggccgagctgagccctcccgcctgccactgcgtggcgccaccactgcttgatgccttcaggctgagctgccttccagtggcttttttccatctccccatcttccaccaaggtgtgttctggaatgttctcaccacccagtgtgtgtgtgtcaccatcggtcacggggaaaaagctctcctagtgctggccccgccccagagtcccagactcgttggcatcctgcatggcctgtccgctccccaggtgccttggtctcctggctggtcttgcttgcgcttctgcgacacctggatccggggctcggagggaaaggagggctcggggaggcaccctcgtgtggctgcaggttctgctctaggtcctccttccccacctatgcctcgctcacctgtgtcctgggcctgccaggcctctgtagcatggacacccagtgacagctgtagggatgtgcccggggtccttgacacagtgctgggcaggaagtggctgacccccacttctgacctgggttaggaccctgggtccacacgaggaggcggccagggctagtgttgtctggctcggtgggagggccccctgggtgctgagtctgtcaggtgggccagcagagagaggggccctgtggctgtttcttgtcctgctctcaatggtcctgccctggtacagacccagtcatacaggccttctactgggggctggcttcaagctccttactcaggccaggcgcccttggaggtgcaacagcatccggggcacctcacccctgacgtggccctccaggtggggccaagcccccaccacgccgcagccgggcagccccagcattgggaccccacagaggcctgaggtcaccacctgggctccactctgcccacggcctctgctgctctcaggggcacggggcgtctctgtctggcttttcttttcgggaaggaagagggtccactgtcccagcccagagcacaggcggcggcccctgcgttctggggtccttgggaatgaacacacctggggaagcatgagcaccaaccccgccctctagacccaaaaacgtaacctcggggctgcgtgcaatgaatgggaccgcctctgtccccgcttcagtcgccatccagtgcctggagactgcgtttggggtgacggtagaagacagtgaccttgcgctccctcagactctgccggagatatttgaagcggctgccacgggcaaggtgagcctcgatgcttccccagccactgcccccaaaataagaacagcaacagcaggcagccctggggaccccaggagccccgctctcatcgtcccccagcactctgcctgcatcctctcctgggctggggacgtggctgcaggagcacttggccctcctccccctatcggcgggtcctgagacacatagcgctgtggtcactcgcccagggccacatgatggggggccaggagtcccctgcagagcccccgggtccttcggaacttggtggccctctctggcgtcccgagggaagctaaggccggagggtgccaggttgggaggagaggacagcgggccgcctttgcctccgggtccaggagatgccgcaggacctgaggagccccgcgcgaaccccgccttccgaggaggactcagcagaggcagagcgcctcaaaaccgaaggtaagggaggacctccatccccacagacacctcgccctacctggactccggggctgtgggaccctcgcagaggccagctggtccctggggcccagggagctgagggaattgccctgatgaccagcacgctggcttgtggggacggggacggaagggggactggcgaggggactggcgaggtgcagagaaacttgaccttcaggcacagcacggctggtggggttgtcgggagcggcccctgtggaagactggctggtggcccccaaaagttgcacagcttccatgagacccgccggttccaccctgatactagatatgtgcccaagagagacacatgtccaccaaaacccagacacatgttcacagcagctgtattcacaagagtcaaaaagcaagaagaggccgggcgcggtggctcacacctgcagtcccagctctttgggaggccgaggcgggcagattgcctgaggtcaggagttcaagcctagcctgggccaacatggtgaaaccccgtctctactaaaaatgcaaaaaaattagccaggtgcagtggtgggcacctgtaatcccaactactcaggaggctgaggcaggagagttgcttgaacctgggaggcggaggttgcagtgagtccagatcgcgccactgcactccagcctgggcgataagagtgaaactccgtctcaaaaaaaaataaaaaataaaaaataaaacaataaaaagaagcaaaaacagcttaaatgcctgtccacgctaaatggtcagcacagcatggcccatctacacggtggaatgtggatgggtgaggctctgacccaggccccagcgcagatgcaccgtgaagacatcacactcagggagagaggccagacacaaaaggacgcacagcatgtgatcccatttcttttttttcttttttgagatggagtctcgctctgtcgcccaggctggagtgcagtggcgtgatctcggctcactgcaacctctgactccctggttcaagcaattctcctgcctcagccttctgagtagctgggactacagaagcctaccaccacgcccggctaatttttgtatttctagtagagacaggtttcactgtgttggccaggatggtcttggtctcctgatcttgcgatccgcctgcgtcggcctcccaaagtgctgggattataagcatgagccaccgcgcccgggcttatatttttaaagcgtaagctttgtggcatgtaaattatatctcaataaaactgtttagggaaacacacgctgatacccatcttccccccacgccctcctgaattgggatctcgggggcgggagtgggtttctgtcttcagggctctcagttctaggatagcagctggggtttttaccgtcctaccagctgggacccatgcctcagatagaagccccattgcctatgaaatgagaaggtatcacatgagtattccaaaatacaggcctccacttgggctctttccaaaagcaatagcgaaagggacagtttccgtccccgggccggtgagctgtattaactgttctgctcccggggtcgccatccaggcagtgacagccaccgtcgccaggcacaggccaggccaggccctgccgcccccacctccatcccccttagtggatgtagatatgattgtttgcgactagcgaaccccctatagatgcagatgcctcctgagccggcatctgtgttgagtcctggctgcccagaagagccaagtgtgacgccccctcgggtctgtgtggacaccaggccggtgttttcctctctccctgacaccccctccggtctgtgtggacaccgggccggtgttttcctctctccctgtaggaaacgagcagatgaaagtggaaaactttgaagctgccgtgcatttctacggaaaagccatcgagctcaacccagccaacgccgtctatttctgcaacaggtaccagctcagggcctgcccagggcaggggcggccgggtgcgggggcgtcctccgggatgcttagcagggacctgagatgggagaggcctctgcgctgtagatgagggatccattcaccggtggtctcagaccaggagcgagcatcaggtgaccagcaacggggtcggggagagtcgatgctgatttaaaatcaggtagcacgcccagcactctgggaggccatgggggaaagatcacttgaggctaggagttcgggactagcctgggcaacatatcaagacccccgtctctacagaaaatgtaaaaattagtctgggggccaggcgcggtggctcacgtctgtaattccagcactttgggaggctgaggcgggggggatcacttgaggttgagagttcaagaccagcctggctaacatggtgaaaccccgtctttactaaaaatacaaaattagccgggtgtagtggtgggcaccaccagttactcaagaggctgaggtatgaggatggtttgaacctgggaggcagaggttgcagtgagccaagattgcgccactgccctccatcttgggtgacagggagactctgtctcaaaaaaaccccgaaaaaaaccacaaaaattagctggatgtggtggtgggtgcctgtagtcccagctacctgggaggctgaggcaggaaaatcacttgaacccgggaggcagaggttgcagtgagctgagatcgtgtcactgcactccagcctgggcagcagagcaaaaccctgtttcaaaaataataaatacataaatacatacatagaaaatcaggtatcatggcattccacgtggatgtcaagccaagaaaataatccagtatgtggagggttgtgttttttgaatgtgtggtcttggatctgcttcaggcttacaggacagttgcagaggcagtgcagggttcctggccgcctgtcatggggtagtttagtctccactcactcttctctgtactttgaaaaaattgtaaagagaaacactaaacacgaaaatggtgaagacgattcagacgctgtaagccaagagctttgagctttgacattggtctgagttctttttttactgatatgtaaataatttgtgaatgaaacttgggtataagttccctaccctcattgctcttgtacagccatggatcggaacattttttgcaaataaaattcagagtcgcagtcctgagtggctgctggtgctttgagcccacatttgtctaagagcatctcagtggccacacctctcagctttccccatcagccccattttacagatggggaaaactgaggccgttcctccaggaagttggagaggaacgcagctctcaggctcccctcaagggctgcccgctgggctcagagccgccagtgagggacctgccctgccttttcttccccagagccgcagcctacagcaaactcggcaactacgcaggcgcggtgcaggactgtgagcgggccatctgcattgacccggcctacagcaaggcctacggcaggatggggtgagtgcctgtccacggccgcgcctttccagtctctcgggacccctcctctcctgctcctgcttcctctcttgtgtggcttttttcccacccacaacgaattctcccaccccggttcagttcaactctgacactagctgttcggagccaacgtagtccctacaggtcacaggctcagccccacagacgccccgcatcaggtgccacccggagatccctgggccccttgcttctccctgactggctgtcacctggggttcccatggctcctactcaggctccattgtttgctggggcggctcacagagctcagggaagcacctggtttatgatgaaggacacaggacaggtccgagagtgaggccaggagggtccccggggcaggagcctgcgccccgtgcagccggtgccgccctcccagcataagcgtgcattcgcctgcttctctgaatgcccttgctcagagtttgtgggattgggtctccccagaggctggggaggggccctgttcaactgcccagtctccccaggacccgcctcctcctgggctctgtaggggccctgagtcacctcacgagtgaagactcactcaggtgggggtcaggggctgcttgtggatgacgggagacatgtctgtcgctcagaggttccgagggtccttggtgccctgtgccgggaagcggggccaagacaacatccacgcatttcctgtgaccctgagctggcccgctccctcctctcagcccgctctgggctttgaggccctgtgtgtggccccatggggactccagttcttgtgtggcaggggtgttctcatgtctgtctccctcagtcctgcccctgggcccctcgaaagccaggtttgtctccactgagctgacagcgggcagggggtggcaccatccgaggtggtttgggggttgccaggaccgccggggacgagggctttggcggggcctcctggagctgggcagatgggaacagtccatccccggtgctctcctccagcctggcgctctccagcctcaacaagcacgtggaggccgtggcttactacaagaaggctctggagctggaccccgacaacgagacatacaagtccaacctcaagatagcggagctgaagctgcgggaggcccccagccccgtgagtgcagcgggggcgagtggctccagaacgccgagctgactgtgtgggtgggggacaggtcctcgggcgcaccagtggctctaggcttaacctgggtgtcgtgagggtccggggtttgtttcagttggtggtgagatgcacaggcgtggaagtgagtgtcgtgagaaggttcatgcccccagacccctggaagcaggaggccggccgcagggctgcccgcggaggctgagggaggggcacagaaaggaccctcgatgtgggttttgtggcgaggccgggtgaggaggcttcgggttggctggttggagccatttcattagacccaggcctgggggctgcccctggttgcctggtccctggcctgggggtgagtggggcaggtggactgtggccctggggtgatgggggaggtgctgagggtgtgggttctgggttagtttgtttgtatttcaaaggtgcgtttctgggtgagtcatttgctttctctgggaattggctactccaggagggggcggctctgccaggccagcaaggccccaaggtgtcaaagcggcagaatacaggaaatcaacacgggatgatagactgtgccgtccccgggcggtcgcgctgtacggggaataaacacgggatgatagactgtgccgtccccgggcggtcgcgctgtgcggggaataaacacgggatgatagactgtgccgtccccgggcggtcgcgctgtgcggggaataaacacgggatgatagactgtgccgtccccgggcggtcgcgctgtgcggggaataaacacgggatgacagactgtgccgtccccgggcggttgcgatgtgcttcgtgctgcctgcctcaaagcaccctctggccgcagggttgatagaatgtctgagccccgtggggggccgttgtttctgagttccagggggttattcaccgtggcctctggtccaggccccactaaccagggctgttctcatcctcagacgggaggcgtgggcagcttcgacatcgccggcctgctgaacaaccctggcttcatgagcatggtaacggcccgcccctcctccctgtccatggtgtctgcgccaccccccaggcccgcatctgctgtgtccgctactggccagggcttccttgccttggcactgctggcttctggaaccagatgggtcttgtctgtggggtcgtcctgggcaccgcagggcgctggcagcacccctggcctcacccgccccatgtcaggagcacccccaccctctgcttcgacaatcaaaagtgtccccaatgttgatgtcccaagcaagacccatcagtagtgagcaccaaaagctggctctcctggctgagcccagggaggtcacacccccaccccaccctggcgtgggctcctcctcgcagtgcagagacactgatcacaacacagcagcgtctgcctcctaaggttcaggcaagggaagcagagcgccgggtgcgccgggcgcaggtggacctcccgatgcccgggcactcatgcttccaaagggacggcctttggcagggagttccttgactgggatcctcggagagccatcccccacacacacatgttcatttcctgggaggtctgtgtgccctgggaccactcttcaggctcccacagcctcagggtacagggactcgcctaaggctgtcggggagaaaagccctcagtctcactgtcagtcagaaaaatgagccagctgggccaggagccctgcccgggtcgtgccattcagcagaggccacacctcttactgtagccctcgtccgctggccaagctgccaggggaatatgttctccctcaccatgggatggagggtgactgggccccagtctttcaaggggcctctcagcttggccatgtcacagacgccttttcccttcagacatctggggttggcagaataaggcccgccgctgggttttgttaataaagttttttttggtttttttttttttttttttttttgagatggagtctcgctctgtcgcccaggttggagtgcagtggtgtgatctcagctcactgcaacctccgcctcccaggttcaagcgattctcctgcgtcagcctcccgagtagctgggattacaggtgcccaccaccatgcctggctaattttggtattttttaatagaaatggggtttcaccatgtttgccaggctggtctcgaactcctgaccttgtgatccacccgcctcggccccccaaagtgctgggattacaggtgtgagccactacacctgaccaataaagttttattggcacacagccatgcccattcatacacctagtgtcactggtggctttcatgatacggcggcagagctgagtagttgcgtcaggcacccgtgtctgaaaaggctgagagtatttacacactggccctttacacagagagtttgccacacctctgagccacctcctttcaacaggtccaaaggaataatcccaagtggaaagttaacatgagaaagtgcccagtatagtgctatttatttatttatttatttttacttcttttttgagacagagtctcactctgtcacccaggctggagtgcagcggtgtgatctcggctcactgcaacctccccctcccaggttcaggcgattcttgtgcctcagtttcccaagtagctgggactacaggcatgcaccaccacacctggctaatttcatatttttagtagagacggggtttcaccatgttggttaggctggtctcgaactcctgacctcaagcgatctgcctgcctcggcctcctaaagtgctgggattccaggcgtgaaccaccgcgcccagccacagtgctatttattgatagagcaaaactggaaccaaatatgctaaatgaaatatgctaaagcagacagcagctaaaataaagaaccaaaacgcctccacacagcaaaaccgcagcagccagtgagagagcgctgtggcgctgcgagatcgctcctgaagcaggaacccaaaacaggatttaagtcacaatgtggaggtcacagctcgtgggtgggggggcgaaaatgtagggaaaagggtatgaaagaccgaatgcccggctcttactgttggttggcgtgctggagtccagaaccaaggctggttaagatggaaagtgtctgatgaaagagaatgatgcgctgggagctttgtcttcctgacaaatttgttctgttcttcaggcttcgaacctaatgaacaatccccagattcagcagctgtaagtgacaaccgggtttcttcgggtcttgttgtggttaaatttccttttattgtgggtaaattcacttaacataaaactaaccactttaaagtgtgcaacttaatggcattaaggactttcacactgtcatgcaactgtcaccactatcacactgtcatgcaactgtcaccaccatcacactgtcatgcaactgtcaccaccattgagcaccaacccatcttcatcacctccgaaagaagccccttccccctcagctgtcactccccaacccctctcctatcccctgacaaccacgcatccccttcctgtctctgtggatgggcctgtcctggacatttcgtagaaatgggatcacacactgcgtgaactttggtgtctggcgtctctcactgagcgtgacgtcctcaaggtgcatgtgtgctggggcctgggtcagggcctcgctccttttcatggctgagtaatattccagtgtggagggaccacgctgtgctgatccacacatctatccatggacatttgggctgtttctaccttttgtctgttgtgaacggtgctgcttgagcacgggtgtgcaatcgtctgtgtgaatcctgttttcgtttctcttggatataaacttctgagtgcactcgctggctcatagggtcactccccagtaagcgctgtgcgcactggggagctgctcacctgttttcatggtgaaatctttttttctttctcctttttttttttttgagacagaatcttgctctgtcacccaggctggagtgcagtggcagaatcttggctcactgcaacctctgcctcccgggatcaagtgggtcttcccaagtagctggaattacaggcatccaccaccatgcccggctgatttttgcatttttagtagagatggggtttcaccatgttggccaggctggtcttgaactcctgacctcaggtgatccacccgcctcagcctcccaaagtgcagggatgacaggtgtgagccaccgcggctggcccacggtcaaatcttaaagcatggtttcccagccacagcaccgtggccatttgagctggaccagtttctggagcagggccgtcctgggcactgcagggtgctgagcactgtctctagcctccatccactccatgccaggagcaccccctgcccctgtcttggcgtaacccaatcatggctgttgcaaatgtccgctgccattgcaggggtcctctgggggcaggatcaccccctggctgagaactacgctctttaggccaaagaaagaggggtgttctgggaaagcaggtgaaagtcacagggtgggtttgggccctggaggcccaccaggtggtgagagagaatcctctcctgcaggggaaggtgaagggctgagagggattctctcccgggccactgcgagggcctgcagtgggggtggcggtcaggctgtcccggctgcgagtcacgcgctctctcctgcagcatgtccggcatgatttcgggtggcaacaaccccttgggaactcccggcaccagcccctcgcagaacgacctggccagcctcatccaggcgtgagtggaactgcttccaagaggacggaggacgtgggcggcgggcagggctcgcaggcggaagggaaggaggagagcgaaagtgctgcgtcccctgctccgaagggcccagcgtcctccagcgaggggtcaggcctgtctttggggtggagggcccgaggggtcagctggggatggacggaggcagcaggcagcctcctggccctggctgagccccatgtgcccttccccgcaggggccagcagtttgcccagcagatgcagcagcagaacccagagttgatagagcagctcaggagccagatccggagtcggacgcccagcgccagcaacgacgaccagcaggagtgacgctgcgtgagtgcatggggccgggggctggggggtggccagcaggagtgacaccacgtgagtgcctggcagtgagggcagccagcaggagtgacgcccgggggctgtggagcctgtctggacactggacagcgagtcctgggtgcatccagctcagaagatcaccctgaaccgcccaggcaggtgggggcatctctgggcattgggcccctttccaggtggccaccaagtcctgctccccactcctttcccatctgtggatcggcgctgggtggagattaggggagagccacagctccctggaagggctggtgtctggggtcccccctgcctaaggccgcctgcagaagctctttgtttctgcagtgtcggggctgccacctcgggggtgggggcgaggtcatcgagtggtggaaaggacaagccgggtacctgcctttgactgcgcccgagcgttctgcctgcattttgtgagggattttttgtccttttctcactgtgagcaggtgttgcacttacagttgtttaaaaatacactcagtgtcccccatgggttccaggggcccgtggctggcttggtttccttccccaggggcccctgagttcagtcctgtccgtctccagcagacaccggcttcccaggggtgggaggctcccctgagttcagtcctgtctgtctccagcagacgccggctccctgggggcgggaggctccgggcctccccagaggtgtttccattctgctcccatgtggcctcttcattttgtcgttgtcccctcctcatatacactctctttcatttttaaaccataattactgtagacaaatttaaaatacaaaaatgttaaaaagcagcaagaacaatcttaatcttttttttttttttttgagaccgtcctgctctgtccccccggctggagggcagtggtgcagtcacgtctcactgcagcctcaacctcctgggctcaagcgatcctcccgcctcggcctcccaaagtgtgagccgtgcattcagcccaaccttaatcttctcacccagagccaccaacattaatattttggccgccttttcttccagtcttcccttttttttttaaataagcttttatttatttttccttttctttttttaatagttgaggtggattttttaccaccgtaacctcatacacaaagtaccaccatactgtagacccttctaggtcatggcgatgttctctgcgccaccagccacacgtggccccgagtgtgtggaacgcttctggtgcagctgtggctctgacgttcgttgaaatagccgctgtggcccctggctgtccactctgggcctctcctgctgcctggagtgtgtggtgcagccttggtccccacctgcgctctgacagccttcatgtctgtccccttccagctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctctgtctgtcttcgtgttgaccttggcgccaccgataccctccaaccccaaacctcgagaaaacccccgacgcggagtttgtggatcagctgggctgcttgtgagtgaatccccgcgacgccggagccgcacttcttgggtcacgggtcacgggtcatgggaggtttcggacagtcagcctctaccctctgctgtctcccttccctccgcctccgtccccagctgcatcccggtgtagagggtcaccccagggtggggtgagatgcctcggtcctcagcagagagtgatcgtattgtctgttgctttgctttgctttttttttttttttgagactttcaccctagatgcccaggctggagtgcaatggcgcaatctcggctcacctcaacctccacctcccgggttcaagtgattctcctgcgtcagccttccaagtagctgggattacaggcatgcaccaccacgcccagctaattttttgtatttgtagtagagacgaggtttctccatgttggtcaggctggtctcaaactcccaacctcaggtgatttgcctcagccttccaaagtgcagggattacaggcgtgagccaccgcacctggctttgtctgttgcttttctagcatactgtaactccataaattctgtattctgtaaccaaaggcacctccctttcacaacggctccagttgagagaatgggtcagtgagggagtcccaggcaagaaggagcccagaaagcttccaggcccatctcagccccaaccctagggtgctgcacagagttttgttgtgaacatagaagctgctcccttggccaggtgtggtggctcaagcctgtcatcccaggactttgggaggctgaggcgggtggatcacttgaggtcaggagttcaagaccagcctggccaacatgatgaaactccatctctactacaaatacaaaaaaagattggcgggcatggtggcaggtgcctgtaatcccagctactcaggaggcagaggcaggagaatcgctggaacccaggagacggaggttgctgtgagctgagatagcaccattgccctccagcctggggaacagagcgagactacgtctcaaaaacataaaaatgaaagaacaactccctgaaagtcctctaagctttcgtggactgtgaattcctgtttcccacaagccaaggttgggcaccggcaccctcatgctagagacagagaaaccgaggcctggctatcaggcccgaggtcaccccacccgtgagcgtctgaacctggcggagccctggcagggactctggctcaggaccctggctcaagcacccaccttctccacccctgcaatagcaggaagaaccgagatctgcaggggcgaagtttcaggttcagccactacctctgtcatctcccaaaaatgacacaccaaaaagtcacaaaattcaaagaacagccaccccagggttgctgggtctagtgctgaaggggcctggctgtgggaggcaggtgggcgcttcaggtctcaggcagagcttctcacctgggtggctcttcccccggggcacacttagctgggcagcatctggggacgtgagtggttgttgcaatggtgggggtggaggccagggttgctgcttagcacactgcagggcccaggacggccccctccagagaatgatctggccccagtgtccacagagccggggcggtagaaggggaaccctggatgcattttagactgtcctcagctcagcagcagcagcgtggcctgggggcacagtagaaacaccaagtcttgggcctcaccccaggcctaaatcagacactccaggccaggcgccctggctcacacctgcaatcccagcactttgggaggccaaggcggacggatcacctgaggtcaggagttcaagactagcctggccaacatggtgaaaccctgtctctactaaaaatacaaaaattagctgggcgtggtggcgcaagcctgtaacctcagctactcggga

SEQ ID NO: 13390 - DNA, 46626 bp, Human
tgctgtaaaaaatgaagtctattaaaaatgagttggaaaaactcattattctactttgaattctaatagtatagttttgtgccagtatatgggatatagtgaaatatgcatgatcactattctgtaattggctccttctgaagttgttttgttatgtagacataggactacagctatgatgtttatcagaacattaactaatatcagtgattgttgagaaaaggtctttttgaagaaccaactaaagtggttaagtcagcttgtatcatctgtgcttccactaagtgagtacaagagactattcctgactatagatatagatgaaacaagtttaagaatttctagtaggaccagagttaacatctttaacatttcattttaattagttttatatttctattcctattttgtattttctaaagctggtgattccaactctggttttatttgaatggtagactcccctggagccttgggacttcgtttgaaaaccttgggtctcatccactcccgccatactttatttatttatttttttgagacagagtctcactctgttgcccaggctggagtgtagtggtgcaatcctggctcactgcaagctctgcctcccgggttcacgccattctcctgcctcagcctcctgagtagctgggactacaggcacccgccaccacgcctggctaacttttttgtatttttagtagagacggggcttcaccatgttagccaggatggtctcgatctcctgaccttgtggtccgcctgctttggcctcccaaagtgctgggattacaggtgtgagccaccgcacccggccactcccgccatactttaaagaggagaacacagagcattgaggccctggtccccttctcccttgcacagctggttggtagcaggtattcactagaagataagacttttgactcctagtggacggaactttcttctctaaatctgtagctggatatttaacaaaaggtttataaaacatactcttttaaagcagtcaaatttaaaaagcagaaaaatacaagaagacaataattactccaaatttacttacccaaaggtaaccactcttaacacttgggtgactgtccttctagaaacttctctttgcatatatacatacacaattttaaataaataagaacaatctatatttttttcctttgtcatctgtttgttttgttttgttttttgagacggagtcttggtcttttgccaggctggagtgcagtggtgtggtctcaggtcactgcaacctccacctcctgagtgcaagtgattcccctgcctcagcctccggagtagctgggactacaggcacgtgccaccacacctggctgattttttatattttgtagagacggggtttcaccatattggccaggatggtctcgatctcccgaccttgtgatctgcctgctttggcctcccaaagtgctggaattaaaggcgtgagccactgcgcccagcctgtcatctgtttttaatcacccacaaatgttgtctaggtatctttccaaatcaaatatataagtctatgtaattcttttctaggtctgtgtaatttttaatgagtacacagtatactgttgtacgtattatagtttatttaactgaccatacacttctcctgcttttttctactataaacaaagataaacacctaaatttctgtgtacttatctcctattcttgaataaagtcctaggagtgaaagaggtaaccagtcaagttggaaatggttagtagctgaacttttctggccacaaatggctatttggaggtagtatttaagaactgtgaacattagtgtttctggcagctttggtcttggtctggtggtggagtggtcaatttgaagacctaactgggagtggggcagaacgtagaaggcacttctctctgtggcccacttcgaactggacgttgaattgctgggggcaggctggttttgaaatttgctctcctgttgttgcagacggcagaatgcctccaaaggtgacttcagagctgcttcggcagctgagacaagccatgaggaactctgagtatgtgaccgaaccgatccaggcctacatcatcccatcgggagatgctcatcaggtactgcatggcaatgggcctctcctttcttttcagtcttttttccccagccctaatgtgtttgtaggattctaattgtcaacccacaaccagggccacaaccaagcccttccagggcttgctatggggatctgtgtccaataggtctcactgaatgcttgtggattggccctagcttccttgattccagtgacttagccatctttcaatgaagaattagtgggcaaattaagggacagaagttctggaactttctgttgctggcatactccacatctcctctgccacactgtgttcctagcagaattgtttgccctgtctctcttttgcccaatccaggagagttggagaggcagagacctcatgtgatagggttgatgggcggtagggtaaaaggattctaggatccactgtgaagtcattgagtcagcaagtgtttgagtgcttacactgtggttatggtgctgtagggtgcaaagatgaacttaaggttgaatgtctgctctcactaggcttatggtttagtgagagatgaaataatataagagtgctattcttccacagaatcatctataagtacagtttttcccagcctttacttatgtataaggccctacccatctcaggtattagacatgatatagagatgaggattgttcctggttttaagaagcatacagcttaataatggagtttagatgtacatgcacatacctgtattgtaaggtaaaatgtggtaagtgtgatcaagaaaatctggacagaaggctgtggaagtttgagggtgagaggggaagatgatgaagagcttcatggcacaggggagacagttgaattggaccttgaaggatgggtggagtttgggtaaatagagggatggggtggaggaggaggaaagaggttctaggtaaaagtattagtggcagcaaaggcaaagaaacagggaagcttcggatgctcttcagaaacagtgggacaggtttccctggcaagagaccagggaagtaaaaagcagtggtgggaaataaagctgttgttacaggattcttcagttgcaggtaatagaaactgccttgagataccttgagcaataaaaatgctttataaggattcaagggcagagccaccatattggcacaactccagattgtgaatggtgctctcagagttatgtgtgtcagggcctcagatagggtgtcttgtggaacatgagggcaggaatgtagcaggccctcaagaagaactgggacgggagggttttcaggtcttgctgcatatcagtttctctttttcagccaactggttgggtcatataaacctgacaacacctacatttatatcttttcctctcttactttcaagataccagattgaactagaaccttaatcccccaaattcaaagtccaggatgagaacttgattggtatatgtagcaacttggttctgcatggtcctggttactctgtgtgtgtgcacgtgtgcgtgtctgtgtctgtgtgtgtgtctgtgtgatgtcagacatgagtaatgggggtccaccagtccaccatgatggagggggtggtagataagggtatttctgtaagttgagcaaagatcacaaaacatgtccattctggctggctgacttcctgcctctccccagaggtcctggtctacatggttgcgacaaggtcaggcctgtattaacctgggaacaactcaacctcaagattggatctctgcctggagacatggatttcctggccttaggagcaaatgaagggcttgaaatgaataagcaaagggatcggatatttgaggcaacagtatgaagtttaggatactttgatgtttagaacagtgttccccaaactgtgtgtgttcttcagtattcctgttgtgtcttgtaagatgctctacaaaaaatatatttgttagttgagaaaatagtgaaatgagctgaacagtgtttttttattgtggtgaaaaatgtataatatgacatttattttaaccatttaaaaatgtacaatactgtagtgttaactacatgcacatattgttgtgcaacagatctctagaactttttcgtcttgcaaaactgaaactttatatccattaaacagctcctcccagtctctctcctcccctcctatccctggcaaccaccattctactttctctctctaagattttgctgggccagtcacggtggctcacgcctgtaatcccagcactttgggaggccgaggcaggcggatcatgaggtcaggagttggagaccagcctgaccaacatggtgaaaccccatctctactaaaaatataaaaattagccaggcttggtagcacgtgcctgtaatccctctgctcaggaggctgaagcaggagaatttgcttgatcctgagaggcggaggttacagtgagccggccgagattgcagcactgtactccagcctgggtgacagagcgagattccgtctcaaaaaaaaaagtttgcctgctttagataacgcatgtaattggaatcatgcagtatttgtctttttgtgactggcttatttcacttagtatagtgtccaaggttcatccatgttgtaacatatgacaggatttctttcttttataaggctgaataatattccattttatttagagactttttttttttaacctgttcatctgtggatggtcatttcagttttttccacctcttggctattgtgagtaatgttgcaatgaacatgggtttgcaagtatctttttgagatcctgttttccattcttttggatatatgcccacaagtgagattgccagatcatatgatccttctatttttaatttttgggggaacttccatactgttttctgcagcacctgtactattttgcattcccaccaatggtacacagcattccagttcttccacttcctcaccaacacttgctattttttgttttgttgtgaggtgatggctcattgtagatttgatttgcattacctgatggttagtgatgttgagtatcttttcatatgctttttggtcccatttgtatattttctttggagaaaatgtctattcaagtcctttgccccaatgagtttcatagctgcaggacttctcagggcctttaatatgctgatgtgcactctgtacctctaaggaggggataaagtattcagcatttttcagacttaaatgtccatggaattttcccagttatttcaggggcggggtgggagactctagtgtttcatggaatacctttatatgttgttctgtgatagtacttttcatccgatgatgggtcttgcatgtagaggtggatgaagggagaggtcagagtgagaggtgtattcaggcaccagctcactggctgttcagcctggcagaatataggaaaagtagaatatcaagctggaatcggggtggtggcatgtgaggaagccatgaggctgggtgcataactgttagatctagtaggcagtgggaaggtaaggatagacttggtgaggttcgtttgtgttcattagaatagacaaataagattggtcaacttcaggctgggtgtggtggctcacgcctgtaatccgagcattttggaaggttgaggcaggtggatcacctgaggtcaggagttcgaaaccaggctggtcaacatgtgaaaccccatctctgccaaaaaatacaaaaattagctgggcgtggtggctcatggctgtagtcctgagtacttgggaggctgtggtgggagaatcgcttgaacccaggaggtggaggttgcagtgagctgagattgcgccactgcactccagcctaggcaacagagcaagaccctgtctcaaaaaaaaaaaaaaaaagattgaccaacttcatatgaagcaaaatatcatcttgaccaaggactgggtgaggaagtaggctggccactgtgatttgagcctgagttatggtatgagtcgtaggtagcagaggagctgggcactcccccatttaagaagggcagaccattgccttgtcttcaaggaattttgttttttcttttctttgggcccctctgatgagctcttccttgtttcctgtcagtcctaggcctcagcctttggatgtgggcttcatgtcacctggattctctgctggattcaccagtggcatttttaattttctgcccttcaagcattggacagttgccctaggctgatttgattgcagtcaccctgttagtgttgagcagatggtggttcccgcaactggagcacatgatgattatgtagcagttggtttgggcagttctgtaagtcccctggcacagttgtctgaaattggggccctcctccgaaagggttctcacaggtcgtcatggagcctcagctgaagactcctaatagctctactatttgtgaatctttacctccaggggaggcctcagtgtacagaaagattcgacctgctaatgttacttgaattaagagttgaaggtttctggttaagggtgtgttggaagctttgtagtgtttgtatttcagtttcagttttcttttgcctggagttaggatattatctgtgtgtttactagtaggagacaccgacatcttatagctgagtcaagtttatcttgatgttcttggtcctgggtgctgttcctttgccagctttttttgtttgtttggtcatcataaagctgatttttggacaccctgactgatacttaaaaatgttctatctttgacagtaggtgtggcctattacacccgaagcaattccttctgggagtggcagtgaggccatctaagccacaggggatgttccaggctttccctcagctctttatctcctactaatgatcctgcaatatcagaattagatggcttttccctccatgaggaaactgaggctctaatctgagacagatgtgttttgtagcaacatcctgaaaatacaaaatgtatcaagcttgcttggtgttagctgttgctcttattgcagaagtcactgtttagacttcacagacttacatttttgcactcttgctgtccttccatcttcatcacccctctccactctttcttttataatcttaactgtcatttctattgctgtagcttagctgtctgtcttacatacgtggagaaattgtgttttgtttgtttgcatgttttctgactgctgctcagggctaggtctggggcaaatgcagagggcaggtagttagcatataggtaagcgtatgagctctagagcctctctgggttcagatgccagatttgctacttactagttgcttgacatcaggcaagttacatgaaattctgaagtgtcaattaaactttctgggtctcagtttctgcattcgcaaaaaggagattgtgacagtgtggtatgtaccgcatgggctattgttaggatgaaatgggttcatactgtagatgtgaatgcttgaagcacttgaatgcttgctgcttgaatgcttgatgtcacttgaaaagtctcgtcatattagctgccgctattgttgttattactgttgtggagatgaatgagattccctttgaagagattaaataataggtaagccacagtcataaatgagaacacaaaaagaaactggtgaatgtcatgggaaaggacctcattagcactgtctaagtagaatctgtgagatacacatgtaatattcaatgttctcatagacacattaaagtaaaagagcagtgaaattaattttaacaatatattaatccaacatatccaaaatattattttagcacatcatcattataaaaattattaagaagatactttacattcctttttatgctgtggtttcaaatatgggaagtttttacatttacaaaacttcgcaatttgaatgtgaaattttcattggaaatatttgatctgtgtttagatttcataagactgacagttgaaaaggtggactcacgtacccaagttgttctaaacatacttagaagttttccagtaactgaatcttgaatatcagtttttaaatttgtatttcaatttattaaagtgaaataaaattaagtattctgtttctcagtcacaatagccacatttcaagtgcttagacacatgtggctggtggcaactgtaatgtaagtttacttaaagtgtgaactgaattcaaaggtgacagagtattttaagctggcaggatcagggaagtcttcatggagaaagtaggatttaaattggaacgtgaacaggtagaatttggatgcatggaaagagggagagaagtacaagaaataccatggaaatctttttttaaattatactttaagttctagggtacatgagcacaacgtgcaggtttgttaacatatgtatacatgtgccatgttggtgtgctgcacccattaactcatcatttacattaggtatatctcctaatgctatccctcccccctccccccaccccatgacaggccccagtgtgtgatgttccattgttcagttgccacctgtgagtgagaacatgcggtgtttggttttctgtccttgcgatagtttgctcagaatgatggtttccagcttcatccatgtccctacaaaggacataaactcatccttttttatggctgcatagaattccatggtgtatatgtgccacattttctgaatccagtctatcactgatggacatttgggttggttccaagtctttgctattgtgaatagtgccgcaataaacatatgtgtgcatgtgtctttatagcagcatgatttataatcctttgggtatatacccagtaataggatggctggatcaaatggtaagaaataccatgggtatctatggaattaggagaacatgcatgacaataagcttgaagaagggagaacagtggcctggttaagaccatccatgaattacccctgactggtcatggttgtccttgaccaccagaatcaggattttagagtgacatgatcagagggagcagtgtttagtatgggttggagaaaggagactctgggaattgagaaacctgttaggccttgcaggatctcagagttggggtaaagagggcctggacttgggtactggggttaggagcggagaggaggggtaggatttggagaagtagtacaacctggattaaatgtggaccttgcaggcaggtggtagaggggattgggaaggtttgaagcctgggagtgtttgtggtgccatcaacagaaggaaatgggttccttgttttagttcctgtggagaagagccacatagttggggcgactctgttaagtgggactctggatccttgctgtgattgtgagaacaagaaggaagggctggcttcatgtgtgacctgccatagtagcctcctcagtaatagagaggctgctgttccctgtggctcttgttcctaattgtttcatttcagggtagattctgggttgatggagtttctcctacggctggggaggggagggtgttggagaagtgaaggggaatcttgaattctgtcctttgtgtactttccaaaacacaaatatacacacccacacgctgttccctgcaagagagaaaacgtacctcaaatgcataattacgcaaggacttggcactgcagtggtctgcttctctctgtcctctgcaactctaagggtttcttctttttaaactcagagcaagggttgtggtattagggttgttgtattaatgagcttgggccctgggggacttttatagcaaggaatcgtctgttctctctggtaatctggatactttcatgtaccatcctagtcgtatattgggattcgtgggcaccacttgcctcaaagcaggagaatccttggttggagtcagagctgtgccagcactgccttttagaaatcttgattcctcatcctcctcatccgtagaccccatattatgttgttgggcttggcttagtcaaagggtgatgttttgtcagggactgactctgccaatgtgaatttttggctttgtttgtggttcctcctcctggaagacatgattcagattttcctaaactctttggaccctactccattctcctggagtcagcttcctgttttgttttgtatttcataaacaggctttctcttggggtggggttaatgatttttatcccacagtgattttatctgttgtgttagaataatgctagctgtggtaacacatctcgaagtttcagtggcctggtattgtaaagccttatttcttatttcatgtagcagtatagagtgggtgttcctggttggtgggggacttccctctaccttgagggaaagtgattcagggatctaggctcttccatcccatagtaccaccattttagctggtggaaggggacagagtatggacagggcacactcatttgttagagccccgacccaggtatcacctctcacccacatttcattggtaagaataagtcatgtgacctcacctcaatgtaatgaggcatgggaatgaaggcctggctgggcagctactttccagtgactcttctacactaaggaaggagcacaaatctttggacagctgtcagtttttcccacataccctgacttggtttcatttaggagagaaaaaaatgccaataacttatatttggaaacaaggagtccacatctccattcacagtctaacttttggtacttcctgtggaccgatggccatttattcattcagtttcaattttcttgagaaccttgtatatttgaggcacagtgccaagctcatggctgatgggagaagagggtcagggaaggggaaagatgtcacgctaatgtggactctagtaactttagtcatgcttatcttggcagtcagctgtcagctttacttggcaagttccatcggcatgtgaccagccatgttgatccctcttcttaaaacccagctctggtcatgtcaccaccctctcttcaacttttagtgtctctctagaacttgcaggataaagttcaagcctcttagtctggtgtttgaggtctttgactatttgtcttcagacggcctttacagaaatctctgcagctgctcccttgaacttcttgcccctgccattaggctaattgggtgtcgcctcatgacaggcctcttgcctcttgcttctgggccttgtcacacctttccctctggactgttttcctgctctcttcgcctatccttggtggcccagtcaaacctctgagcttggtctgatggatctaaggcacatctgagcatcctttaaactatagcaaataccacactgcatgttcagcatcgtttatatggctgtttattagtgttaatatttcatggaatatctgtctactattgccgattgtccacttcgagaagatagtttcttatgtttgctatagagtcaagctcggtgcagttcatagcaataagtgctgcagttcatcagatgttcggcatgcgctaattgctttatgtcacacctcaacccttcaaggtgggcattatgttcatccccattttacagatgaggaagttgagccccaggttcacccagctagtaagtggggaaccaggcttgaacagagttctaactgctggttgtaggagatgtctattctgtggctgatgaaagtagaggtaagtgcagcatacacctcgtattccttgttccctcagaatttataatccaattgtgagactagatgtgtacaacttctgtacaaaagtagaagaggttgcttggcagcttgcaagggtatgggctttcgaaagtcagacctgaggctgggtgcagtggctcatgtccataatcccagcactttgggaggtcgaggcaggcggatcacttgaggtcaggagttcgagaccagcctgaccaacatggcaaaaccctgtctctactaaaaataccaaaattagctgggtgtggtggtgggcgcctgtaatcccagctacttgggagactgaggcatgagaatcgcgtgaacctgggaggtggaggttgtagtgagcctagattgcgccactgcactccagcccaggcgacaaagcaagaccccatcttaaaaaaaaaaaaagtcagacctgagttcagatcttggttctgccatttactgtggtgttaccttggggaagttagttatttctctaagcttcatttttttcatctgtagattagcgagggatgataccttccagggctgctgtgaggattagaatgagaggaaatgaatacagttattgactagtaggtgttgagacaataataaacaatacagactaaataatcttagctaacattatttgtcagcattatccaaggtagggtatggataagtgccaacatggatggtcctgtaaaattcagaaatgtgggagcctctgaaagctgaagtgggtcaggaagcttcatggaaaagggagcacttgaaccagatttttgagagatgactagctttttttttttttgtagtttacagatgctttatttggctatgtattgtttatattgttggaattagatgccaacatttaaaaattgggtaatttctcatgaacccatatttctggcttcttctgaaatattgaaggttagcaacatgtggcctgcatttcagaaatcagagctgagtaggagctgctgtctttagaaaagatatcctttgtcctgtaccctgaggtatttgaatttgaaaccccatttataatcccttacgatcttttccccattagataatgtattagtttcctatcactgctataacaaattaccacagtgacttaaaacaaatttattctcttatggttctggaagtctgaagtctaaaatgggtcagcagggctatgttacttctgcaggctccagggagagtccatttccttgccttttccagtttctggaggccacctgcattccttggctcatggtcccttcgtccatcttcgtagatatggttgaggttttaactggatgtagggaaaagcttcatgtctctttctgcttgttcatttataatacaaatgtgggttgaggatctagtcacctgtgctgagtgcagggacaggacagataccctgatctcatggaacttatatgcttggggttaagatgggggttgaggaacaagacaataaacatataaaaagttcattaagaagagaaacattgcccagcatggtggctcttgcctgtaatcctagcactttgggaggctgaggcaggctgatcacttgagcccagaagttcaaggccagcctggcaacgtggtaaaaccccgtttctacaaaaaaaaaaaaaaaaaaaggtgtgtgcctgctgtagtcccagctattgagaagattgaggtgggaggattgcttgaacctgacaggtcaaggatacaatgagccataattgtgtcaccacactctagctagggtaacagaaggcgatcctgtctccaaaagaaaaaaaaaaaaaaaaagacaaatatctagagtatgtgtgtgctatacagagacttaaaagtggccaggtggctattatagctgggtagtacaggtaggcctctctgtagaggtgatatttgatctcaaatgtaatgatgagaaggacctagccataccatgatcagaaatacttttataggcacaaggaagcacatgtgccaaggccttgaggcaggaatgagctcaggatatgcaaagagcagaaaggaggtgggtgtgtctggagcatggtgaatgggagcagagctgcaagaggactggcaaagtcagatcagctggtaccttgactgggccagagtttggattttatcttaaatataataggaagccattggagggttttaaggaggttgctaacatgatcttagatatttggaaaagctcactctgagtgtatgtgcagagtggattgtaggggcggtagtccaggtagagatgatggaggcttggactgagtgctgctattagaaatggagagaagtgggtggttttgagaaaaagccagcagctgtgcttctttgtgcctttttcctagcatgctacagctttggtttattttaggccctatgctgtgttctaaggagaccgcccctgggcgttgccagcttcatgcctgggagaaggagagtgacagccctgggcccagtgcttgtctggcttctgcatagcctgtcagtgtggaggtgaggctgtggccagccttgcttagcaatgtctttctggaatgttgaccacttaggtcatgtctggacattcttaccccagaccttgtctccatcccaaactaaacatgtccatttgctgttaattccacctccctttggaggaactctttccttgcctttgctgatggagaagtctaggtaaaccctgcggatcttccatctctcccaagcttgcccagaaaggggtggggcatccctagagtactatgtccctgaatggaagagtccagccgggctcagacctgcactgcattctctgccagtctttgccagtatcttcaccctgtgtcacgggtggaagagccccaagcctgtggcgtcatgttggtggagagtgccctcactgtgtattccccattgtgcgcagtgatttttagcacaagagttatttttaacttagttttcccagccccttagatgtcttctcactgtttaggaagaagagattaataatatctcttccattgcatatgtgcagcactttcaagtttctggtgagttttgaaagacattaacttactgtttctcacaagagtcctaggagatgtgtgggccacccttccccccgttgttactttttaataaaaagtcttgcacacagtaattactcggttaataaacaagtgaggattctgcagttcctaaacgatgctggtggccatttctttctatttccttagtgctgttgaccgaatgttctttatgctttaggaataaaacgtgcttgctgttgcatttagcaatctgaaatgacctgtcttagagatgaggaaatgaggctgagagagctgccaggacttgttgcagactatgcagctgggcctgggctagtgggcaggtggcccagagctgctttatcctgccattgtggttctctatgctggcccttctagtatctccctggaggctggtttgaggctgtgattgccggtgccttggtgaaagaggcagtcctttttttttttttttttaatttttgttttaattttttgagacaaggtctcactctgttgcctaggctggaatacagtggcacaatcatgcctcactgtgcagcctcaacctcccgggctcagattatcctcccacctcagcctcctaaatagctgggactacaggcacgtgccaccatgcctggctaattattgtattttttgtagacatgaggtttcaccatgctcccaggctggtctcgagttcctgggctcaagcagtcctcccacctcagccgcccaaagtgctaggattacaggcatgagccactgtgcctggctgaaaggggtagttcttaaccatatagcaggaaaggaacatgagggccttttccccctacatcatgttgactgtcctaaaaatgccttgggtctggccagcagccccattccccaccctaaactttcttaaccttgccaggtcctttggcttgggagaatcctggtaactgcagaaggagcagcagctctgtactcaggcaggcctggctttggatcctgacctactattaacttgtaagtgggcagcttacttaaagattctctctttgaacctcagttttctcatttgctattggtcttatcctagagagtgatgagggcgagagataaagtgtcatgcattggcagcctggcatagggcttcagagtccagactctggagttgactgcttaggttcaaatcctgcctctgctacttaattagctgtgtgatttggggcaagttacttaaactctctgtgcctcactggctattaccagaagttgcacactttgacttgtaccctttgcccacgcgtaagaatttcttactttcttcactccctaaccccttccatacagaggcaaggggattatcagctgagaagaccttggttttggacatgacattttattttgctgaagcctcctggattggatgaagcgtttccgctcactctgtagcaggaagggacagggtctgcatgggagagattggtgatgctacctcagaggaggacccaaacaggaagtttggaaacaagtcagtatctacagaaacttaagttagggaattgttggtgcttaacacagaaattcagccttacttttcagaaaaataacagatgcctaaatgtcagtggcaaggaggggagaaggctattattggtttgatttttgagtaagatctcagtgaagaaagagcagtttttatctgtttctcctgatgtgctttggttctcctaatgaggaaatagaggctaaagggaacagctctctctgcccttaattaattcaatcttctgcagtgtgtgctaatctgttgttttcagctagactgttggcttcttgagggcgggggccaaggattccccagtcttcatagtccccgctgagcctagcacaaggctaagcaggcagaacagtctgctcatgactgatcgaggcccactttgttgtcatctttgttttccagagtgagtatattgctccatgtgactgtcggcgggcttttgtctctggattcgatggctctgcgggtgagtcactactttttctctgttcttgctgcacctttgttcgcctcctaaaaataactgaaccgagtttcagcctgtgatatagaagcaaaaagaaaatgcaaaccagatgctccacattgactctctgcagaaaggtgtgggttcccagtctttccctgctccccaaggtcacctttcagtaaccctttttattcctctctgtatctttgcttcaaagttttaacaatttttatttttaaaaagtttttgaactttttattgaatataacatacatataaaagttctatcaattaaactgaatatacctgtgttactagcaccccaaataagaaatgagactttaatatagtttcagaacctcctctcttagcttattggtcccagataattctcccaagtgcttggcttttggtttctgttttcactcttggcttaaataacaaaggttaactctaagctgcattggtgttcctcaaaaccattatgcctttgagttttagggtggactccccacttcaggtttgttctctaaagcaagctggacaaggtgggagctcccctcccctcatggttagcatgctgcttcctttggcgtaagtgcttgtgttggttggcgcattaggattggctttggctgacacctctgccaaaaccccaagttctgccaggcctgtgggaacggagggcagataaaggtaggaggcataagcttcctgctagtgaccacagcaggaacactcatagggcccacttggtctttctccaggaaaggtgaaacagctcccctggggtgtctggtggagcagaggagtggctgtaattgctgagcaggaaccatccctccctgtgtcttgttgattatacgagaccactttggccataggtctacagttctccattctctgttcttgactcatactgtgcaagtggagtcctttttgtgcagggaccagtgccaggtagcttgggtctcaggactgttctttcagagcttgacacacagcttgttttcagtagtgtggtcttctcttgcccagaggtttctttggagtcaaggacccatctgccccactaggagctgatgcctcttactgctcttgcctgtctactgtcattttgtgcagcttttgagcagttgttagaaacctttcttcttcttttttttttctcccctgcttcaggcacagccatcatcacagaagagcatgcagccatgtggactgacgggcgctactttctccaggctgccaagcaaatggacagcaactggacacttatgaagatgggtgggtacaggcatggctagcccaaacttagttggcctgatctgggcagggatcctagaggtcctcaggactcctggatcttaatccttttatgcagtcatggacccttttgagaatccaaggaaaactgagaaaaaaaaaaatggcatgcctatacatacgtaccaatgtgcattcaattttggaggacgctggttcaggatacttattttactgaggggaaactgagggctagagaggacagttgatttgctgcagatcacattgctgtgcatttcactcctgtactgggggccttctactatttgctgcctcatgattcagagtgagataaaggcaaggagtcattggcaacagaagccagaaagctttcccctgaggctctctctgaggatcttggatttgcttctggaagcttagctctggagaagagcagcattcaggacaagcgaacaggtctggaacttgcttgggctagtcgcttcacttgagtgctttagtttcctcatctgtaaaatgggttaatcacagtaagtaacatataaagtggtgagaattaaagcattactatgtggaaagcatatagatcaatgtttattgaataatgtgtgtatatactctgtgttttcatttaattttctgccgtgtgtactttcctgtcattaaaatagtctttagaaacacggttttagggactgtacaaagtctttgcttcctgaattttgaacttggagaacagaagataaggaagggccaagtgagaaagagaagatgaaacaaaatacctgatgcttcttgtttgttgtaggaaataatgaggaaagaaaatagtcctcagactcacagcaggaaacagaggactagaccatgaccttgagatccaggcagccagctgactgaggggtgtgtgcactcaggtgtatgccacacaccctccacatacacacacatgtgttctttgtcttagggaggaacaaggaacatttttgtcttggcattggattaagtttctatttctcaaaaatcatttcataaatataaaaacaccaaagctacagattgttgcctgttgctgcagttgatttctctttccctttctctctctctctctctctctctctctcacacacacacacacacacacacacacacacacacacacacacacacaaaggcaggcatttgaagctggctgttataaatggacaagctagtggcctttaaatttttttgtttgtgtgcttctgttaatgggagtcaagcacccgcaacatgtatgtatgtttgtttatttgttatttatatgtgctagtgttcctctatattccaaatatcaaaaactaactttgtaatttctttataaaaaataaatacaaatagaagctctgttactttcttcttgcacccagtagatcattgtgtccccctggggagcaggcatctctctttggggcccacggattccagctcttaagtctgttagcattttgggggtcagaggcgcaaacactgcctgcctgttccttaatgtaggtatgtggcagcaagggggtggcagagggagtgagtcctcctctcctccaggctccttcctagtttcctcagtcgagtcttctgtgtagggagattctggtgggtttggttggccagtgagtgattcatccctggggttttgccgaagatctgtctgctaggaaatgacatgacttcatcctgtgaaagttatattatgtagtgtactagggcattaggagaaactgtattaataagtggcttgtttagtggtttgaaaaaaaataggaaagaatcaaatagcagaatgaaactcaatgtcagcttctaggcagttttttagaattggaattcatgagcttctttctttataaacctttgcacttcccttctatggttatgtggttgtatcagtagtcagtagagaaaatagtaaagataagtttctactgttttagaatatgtgaacttttactctaaatatatgtatattttatcaagatgttaattgtttggccaaaacctcattggttaaaaaaagtatacatttcaaagataactggctagatatggaaggtgttggcttagattaaaggaaaactggactatagaagtaattttagttctattctggaggctgatatagtgtcctatgactagcgtcttagaaacagaaagggctgtctcatcctgggagttggggaacccagaggctcatgttaaaggcaacaggatggccagcactttgggaggctgaggtgggaggatcacttgaggccaggagttcaagaccaacctggctaacatggtgaaaccccgtctttactaaaaatacagaattaactgggcatggtaattttgagcctgtaatcccagctacttgggaggctgaggcaggagaattgcttgaatccaggtggtggaggttgcagtgagctgagatggtgccaccgcactctagcctgcataacagagtgagactctgtcttcagaagtaaataaataaataaagacaaccggacaggtgcctgtgtgcctctcttaaaatcttcggaaagatctctttgctgccaagacttgtgcttagccctctattcagaggctggttatggggcagcggccttctcttggccaccctgcccttgcagatgaggggcgggcactgggagcatgttatcaccttacctggtatgtgatatgtgggagtctcccagttcccagacttcaccaaatcactgcccaaattctcatcaagtgaccagtagtggggaagtgactgaacgctgaggagacaatctttgtggtgacgccatgtgtgtacgtggcagtgatccccaagatatttttacaaggggtcaagtgaaaaatcatacttttttcccttctgtctcacccttgtcttatgtttttcatacacaaaaacttacacttctccctctctgtagccttccaggattaagggaggttcagattttctaagtcctgtcaatccactttaaagaagctgcttaataaagaccctgctatcatgatgttagagaattgtatctttctggtgggataatgagcgtgggcccactgggaattgtttcttatcatttcttccccctgtaggtctgaaggacacaccaactcaggaagactggctggtgagtgtgcttcctgaaggatccagggttggtgtggaccccttgatcattcctacaggtaagtgagcttggtccctttctgcttgggtaaggaagtggcttctagattcccctccattctcctcatttgcttgtggggtgtggagcactggggggctcagcatgactgattttatagtagaggtcagggtgaagagaagagttccactggtggtgaagatgtgcttttacagttcctcatcctgcacacccagctctgggccatggcaggaccacctttctgaaggttctggactttcaaggccctgctccctgccctgctgcaatgggcgttcggctcatggctgggccacaatgtgtctcctcagattattggaagaaaatggccaaagttctgagaagtgccggccatcacctcattcctgtcaaggagaacctcgttgacaaaatctggacagaccgtcctgagcgcccttgcaagcctctcctcacactgggcctggattacacaggtcagaatcaatggttctgcccagcagggcccctgccattgtccccccacctcttgctattgtctccaacctcgtcctccgaatccaagtcgagttggagctgacaggaggattttgccctactctgccccagtgggatatttgaagaagcaggagctttgtttgtttccactgttgccacctacttgccacttagtttggctttggttattttcgcaaagctcgtttgggtggctttttgggtgctgctgaaaagactgagttttttttatccactcagctgctaactgccactcgaacgtatttgatattggaaatagagcatagaggtttctaggttccatttcccttcttatgtcagcatttgtagatttaccttcctaggcctttgtcctccatcttgtaccttctgctttagaggctttggggtgtgggtgtgtttccttggcctgtgcgatagtgatgggtaagcagcatgttctctgaaccattgtgtggatttatgaagcagtgagggggcagagagagaggcctggaggtggggctgcaggggagggcgtcttgctgtagaaacagaggtagatgggggatggctgtggaatgtaggcagattgcccagaggggtcctgggaagaaagcgtgacagcctagattctgggccaagttttaaacagcattcccgaactgatcttcagtgcagccctgggtgtgggggcagccccagcctgctttcttgtgtgacatcctcaccagaggggtattgcggaatggggaggatgggtccagtgagtggcccagggtcagctaaatattttccatcagcgtggtttgaagtttttttcactagagcagaagctctgacttgttgcttataggagaggggagagcaaatgttgctgttcagtacacatttgggtgcctactatctgcaggatgctgtgcgaggtgctgagtgaataagacagatgcccaccctgctcacaggtggctgttccctgagttatgaatgctgccctggtagggtggttgtggtggcaatggggtgagctcctctagcaccacgatttcatcttgcagagcaacagagaggccttggcagtgtctgaaagggcaagtgtgatttggaagtggtaatcacagtgagtcagactacagggaattcctaggtcttagcactgaaaggcaagtcttgcagcccccaggaacatcaagtggtgggtgctgttcccctgacccctgagactgggtgagttccctttgctgggtagtgtgttgatataggtccctgtgtgtcccctgttgcatcagtatttacagtagtgtgttaattgctggtttaattatctgtcttcccttctatattgtaagccccatgaagacagggactgggtctggctcagatctgtaaccacagtgaccagcagagtgcctggcacgtatctatgcctggcagatctagatgttacacaggcatttgtgggatgcgtaaatgaatgaattttactggtgaggcaatcaaggctcacgacagtcaagtggcttggacacttcttgtatagggcttgaatccaggcctcctgcctgtttaagtagcgtgctcctgtaagaaatggtgctgattaaagatgtttagggtaggttctttcactgggttcctaccgctttctgggaccagggctggagttaaagcacatttgtttcttgcaggcatctcctggaaggacaaggttgcagaccttcggttgaaaatggctgagaggaacgtcatgtggtttgtggtcactgccttggatgagattgcgtgtgagtgctctggtttcgctgtttgggcatgttacccgatctctcctttgggtctctgggtatctgtgtgttcatgccattcaactttctgagtggccagggaataagaagaagactacgtcaccaaatgggtataggagatgccaactaggatgaaggagaaagaattacagggagctggggaggggagtgaggcttgtccagagcagtattacagctgggtgatgcccacctctggccagtccctcaggaccatggcacctctgaggaagggcatttcctacaaatattttatgtctgtcagcctctgtaggtgtagaagtgggctcataggagaggccttctttctttacacttgtcctgtggtttcctaaggtctttatagtgagaatgttctgggagcatttctacctcagaaaactaggaactaaaagttcctccccaagccctttgatgtaatagtagtttctcagtctttggaccttaacccaccttcatgcagttgttcagcaccttctttcatctaaaacctgacggaatctggttgaaccttcctgtcctgtcttctggtttctgagtggatttgacccagggcaactgagaagaggcactgctttatctttttgccttctcactagagaatgagaccctactgcagtgtcctctctcttcagtccctgcatcttccatccacaaaacattgtcaagtgtgtcagtgacttacatccctaattaacttaatgatctcaacgtcagagaaaaacacctgtaaaacttttctctctccctgattgtaacaaaaacacaatcccatgatagaaaacttggaaaatgcagaggaagtaaaaagaagaaaaaaaaaatcacgtataaattctgttacttagagataatcagtgtcaatattctatgcatatatcattttatagcctgattttttcactgtatcagtacactataagcatatacaagcataattttaagtgagtattaaatactccatcatgtggttataccataatttatttaactgtttccctaaggatgacctttgggttatttgcagtaatcctgtaatttattatgatgctaccatcaaaatcttggttcatgaatccatgtcttagtgtttgataattttcttcctatttctggttggcttttagggcttttgactcatcttgccctttgtctgccagaaagtttgcacctttgtatttgaatttgtctgtcttgccacacctgaacaccaggtactgtcatttttaaagaagtgctagtatgataggtaaaaaatggtgcctcatcactttaagaagccattattttaaaatagaggttatacttttaatgcccaggcgtttttttgctctgatcctcatgagaacaagtgacggaagctggaagtcctgggaccagaactgtgctctctcctggtctgtctagttctcagacgttcagcaacatcactgttactggctgtccgcaggtcccccacccagtcgtggtgccagagcagacccatgggtgggctgcaggctctgatttcattggtgagctgcagccttgctgactcactgcttttctttccacctctgacaggaagctccgtctccatggggctcactgacccttacagaggaggcttgcctggcttcccttgtgggagggtctcagtttttctaccctaggtcatctgcctcagaagggagagagtgctcgtctccttcctttttatttgggagcgccagaggtttgtcggcttcaaggccaggcctggcaggtcaccactaggcggatcatttcaactccttgtgggggcagttctcaggatttcaactaatagcttttattcccttctccgggcagtgatgtggaagcctgagaaacagctctggtgccatcacgtggtggacatgagcaattgcagctcagaggtggaaccagacgggagtcaggcttccagcctttctgtgcgattccactgaatccttgcgcagcagctggactccaagctgaagctcttccctcccgctacaagcgaccccttaacatcttaagtcagacaggtgacagggattttgatttcttttctagggctatttaatctccgaggatcagatgtggagcacaatccagtatttttctcctacgcaatcataggactagagacgatcatgtgagtgtttgccctgcatctggaactcccttccagagctcctcagagccctagtgtgccctttctggtcctggcccacccatcactgcctgatatttcactgatgtgcttcttttttcttgcccttttaacattttcccttcttgttttccttagcagtaggtgtttatttatatcctgcctctctttgagcccccaaaatggtttgaaacgcatgaaagtgtctatagttcgggccacccatttgatgtcaagttttctagcagccagtgttaaggggtatatatgctcaattatacaattctgggtccacaatgcaaataaacccagtcattttgaaggtcaaaaataatatgggaaaacccctccaactacgctttgttgaattgtcagtttattttttcaaagcatttcgtgtggccttcttttcattactgttctatttcaatagctttttgcattaagacaacacatttattaagtgctggtgatgtgctaagggtctctgttaggtgctagggtgactgaaacaggacggggtccttggctggagttggggagatgagcatgtcctctttctaaagtatttgggcacataagtgggcaccagtctgcttgtgggacagatacaggtgttacgagaggggcctgacctagacttggagatcagagcagactcttggggaaagtaatattttgaagcagagagtaaggataaatgtgggtgagttaggtgaatggcagggtgaggaggggcggggaaccatgatccaagcagagggaacagcattttcagagactctggacagtagagagcacagtgcatgtggaggacctgaagtggttcagtgaggtcagaacatagtgaggccagaatgtgagcaggggccacagaaaagagaggccttgtgggccacattcaggagcttgggttctttttctgaacaagaatagtgggaagctattgaacgaatttttcagagggaaccacatgttagatgtacaagttgtaaagaatattatgactgaaacatcggtagatggggaaagacttagaggctgtggcactaacccaagtgagagatggtgggacctgaacctgagtggtgactgggcgaggctgtagatgagctggacagattagatggagatttaggctgtgggtcccaaggtcttaatgaaggacgggaagagggtcatcagtgaaggaggacactgcccagatttctggcttggcagattgggtggatgggggcagggaatgcaccttggagggcaggatttgggaaaggagtggggaggagagaaaaggggcttggttttggttgccaggaaacagagcctgatgtgtatgtgtgtctgtgttgccacctctcactcatgttccctcctttttctgccacccacctctcctccatctgcaggctcttcattgatggtgaccgcatagacgcccccagtgtgaaggagcacctgcttcttgacttgggtctggaagccgaatacaggatccaggtgcatccctacaagtccatcctgagcgagctcaaggccctgtgtgctgacctctccccaagggagaaggtgtgggtcagtgacaaggccagctatgctgtgagcgagaccatccccaaggttggtgaccccactttggcccatctaaactctgccacccccttcccagttctggtattgtctttggagcacaggcagatttctgaggctgcctgttggatcagaactgtggtctccatggatgaggccttaaagctggagccatagcaagagcctgagggcccttattgcttgttgagtcttgtgttttccagagtgtggcatgagagattattttaggtggtacacattattatttaggtttacttaaatatatctgttttaacagcatttagcatataatagaaaaaacataactagcatgagttcatgatataattatttaaaataaagttgaatttaataaagctgatttaaagatggtctaaagtaaagtactaagtgaataagggtacagcagttaagaagctagggtaaaagctgtgcaggtggtataagaatgcttgaagcttgggaaatgcttctctaccccctccttctgccgcaccacattttatagctaaggacacttgaggctcagagaggattggggagttggggatttggggatttgtcaaattcaagtgatagtgatagccttgccctttactgagcccttgctgggcagtgctaagcagctgacacttgttgcctcattttcattagggtctgagatgggactggaatccaggcctctttagaggtaggcttttctactgtcctcccctgggcctctggctgccaagtggcctttggcaagcccagtgatgtcctttcttctccactgagcagtggggcatcctgggaagaatccaggcctggctctctagatctggcttgccattgtacccctgccatcatcacacacagtgtgactcctcctctctctctctcctctctctctggagagaaagagaaaaggagataagatcacaaaagcaattttagaagctttgtgcaagtgccaggtgtgctgaggcccctctgctggattctaacttgttctcaaattggaaagggtcttctccagcccttcaagatcagattattatcagtagctgagataggaccactgggcgggaagggagggagcaggagacctcactcatcaggtcatgtgcatggctagacagggagaaaaagccccctttgtacagcaagagaagggtgatttcggtcaagctttcagtgttagtgaactctaaccacaaccacagtggcttggaaagcaatgtcttgctgacggcaggcagccagcagtctcaaagagctaagggagtgagggatggaagagagacaccttgtttgatgtacttactctttttggttgagcttaagctcagggtcatcaatcaaaagggacaggtcgttggggccccaggggatagctatatgggtcgccagtgggagctcttcaaatgatttgtctaaagtaagttttgctgagcaaaaaggttgttgccttggtcttgggtgggtggagccggtttgatttcccaccctactgccctttgcctctaggaccaccgctgctgtatgccttacacccccatctgcatcgccaaagctgtgaagaattcagctgagtcagaaggcatgaggcgggctcacgtgagtagaggagctggtgcagaagatgggatgtgaggtggtcagaaggcccggctccttcacctcctctgtggcattgagcctggcacaaggttagaatctctctgagcctcagcctcctggccttccaggaggagttattgagggaatgaaataaaatacttgatggattagatctttacaaagtataatacacaatacaaaaggagatattgatgttcacagtgtagatgatggtgatgacgtgatgctgatgaagaaagattttgggcccagaggtggcttttgatagtggcctgttttttcctggcccctgtagggttcttaacctttaagttaaccttttggaggagctccctgtgctctgaggtggggcccttcctgattgtacctgaactactgaatagcagaggagcctttccctgataatgggagttgctgcacacaccagcttcccagaaatgtccacatgtaaagctctggttgctgatgatgtgtggccctgcaggtacagccttctcagtattgcattagggctaggctctgaatctggtcacgtgattttcagtgataacttaaaaaatgtctccattgtttgcacagattaaagatgctgttgctctctgtgaactctttaactggctggagaaagaggttggttcttagtctttgtttaatatgtggatatacattattcagacctacctatatgtgattctaactctagcatctcccatgctctgctgaccatgagatctgagatcttcatcaaatttttgggctctattttaataattctctctggaaatttggtgtgtgtagatttcaaaattccttaattatgaaaatagtaacaagaatgaagaaaagttccataatagagtggatgctttttgggttagggaatcataactaagtggaatttcattataaggaaaaatgagtcttataatattattataggcaagctgattgtattaggagaaaaagatctttgtgtacattttgaacttcagtttaagccttgagcctttttatattaaattgactcttggccattaatttcttgctctagttgacaagagggtggtttctctgtggtgttattaaacaatatcatgttccctttaagtattgtataaacaactctttaattgggaaaagaaaatattgtctttattcccactagtgtaactttttccctcatgtttccttctggtgattgttcatctatgtaaattattattattattttattttattttattttttgagacggagtctcactctgtcacccaggctggagtgcagtggtgtgatctcggctcactgcaacctctgctgcccaggttcaagagattctcctgccttagcctcccaagtagctgggattataggcgcctgccactgcgcctggctaattttcgtagttgtagtagagatggggtttcaccatcttggccaggctggtcttgaactcctgaccttgtgatccacccacctcggcctcccaaagtgctgggattacaggcatgagccaccatgcctggactttatgtaaattattattattacatttttattatttttttttatttttgagacagagccttgctccatcacccaggctggagtgcagtggagcgatctcggctcactgcaagctccgtctcctgggttcacgccattctcctgcctcagcctcccgactagctgggactacaggcgcccgccaccatgcttggctaattttttgtatttttagtagagacggggtttcactgtgttagccaggatggtctcgatctcctgaccttgtgatccgcccgcctcggcctcccaaagtgctgggattacaggcgtgagccaccgtgcctggccgtaaattatttttaaaaatataaattatttttacatgtctcttagtgtgcagataaattttttttctttttttttttcttattttgagatggggtctcatctgttgcacaggctggagagtagtggtgtgatcacagctcactgcagcctcagcctccccaagctcaggtgatcctcccacctcagcctcccgattagttgggactacagcccagctgattttttctgatttttttgtagagataaggttttgccatgttgcccaggctgatctgaaactcctgggctcaagcgatccacctatcttggcctcccaaagtgctaggattataggtgtgagccatcacacctggcttagatatgattttgtgttttattttattctcttagaatcatagtgtgaacattttccatgtacattgaggccttaaaaaaggatccaaatgaaaactgcatctagtggctcttctgatttactaacccagtcctcctatttttaaatgtttgggttgtttttaattttttgctgttatcagtaatcctgcaataatctctccgcatttatcttttttatttctctagaatgattttcttacgatgatttcttaggaggggatgcttttgaatttttaaacttagatatgttgttttgggaggttttaggataaaatactgaagcacaatagttgagtgaaaaattaaatgaatagaaactattggattttagatagctttggtgagagcctttgggagttctcccttgctaaagatgtgtcctgtagattggtcagttgggatgaagcaattgaggaaaaagtgagcttttaatgtacctcctctaatttgtaagaggcacacatgaatttatctcaccagatgatttataagcaattttctcataggttcccaaaggtggtgtgacagagatctcagctgctgacaaagctgaggagtttcgcaggtaaggatccatttggggggacccaggagcctcgtgctgattttcttgctagttgaatgaggctggaagggccctgaatcttagcacagtaaaaacctttaagccactctgctttctgtctttctgttacaggcaacaggcagactttgtggacctgagcttcccaacaatttccagtacgggacccaacggcgccatcattcactacgcgtaaggcatgcggaggagcatgctgcctggccttgctgcttctgcacaggagcctgagcaggggagagacattattttaccagaggcctctgtgcccaccttcatctgtctgttgagactgtaaaatgaagggaaataagacttctaagattttattttctcccaatccccaagcctctgccttttgggagcctcttcttaggctcagtatggcactggcattctctgcagggtagtcagatgggtgtccctctttcctttctgaagctgcaggaactgtatgcatagcccttgcatcttgatgactaagtttttttttttttggagacaaggtcttgctctgctgcccaggctggagcgcagtggtgccatcacaactcactgcaactttgaactcctagactcaagcaatcctcctgcctcagcctcctgagtagctgggactataggcatgtgctaccactcctggctaatttttagatttttttgtagagatgaggatcttgatgtgttgcccaggcttgtctcgaatttctggactcaagcaatcctcctgcctcagcctcctaaagtgctggaattacaggtgtgagccactgtgcttggcccatgactggaatttttgagtagttttctttcttggtaacagcagctgttttgtactagtccatacatcttgtgagctccatcagttccataccaaaaaaaaacttagtagtaggttgtgaggcaacctgttttgggtggagagataatcagtaccctctcttcctgtccccctgagcctgaagcctggcatcccagtatgtggtttttttaccacgtggtctacaagaacccatggacccacagggccgagcctcccttccttgtgagacagaggggcactgatatgtctaggactgacagatcttcctgtggagatggggggaaatgtcattaggtgtggccattgggcttcagcctcagctctgcctggttcaaaccgctttgctttgcactgggtattttgagttctgtgcatccccatctgttacatgcacagccaacaaaagaacactgtgcttgggcacacacttttttcccccttttaataattgtttttagagcttttagtcttggggcagattttgaagctgtgtgtgggagacagtcacagatgggacagtacagtttcctcacttaatgcttctgttccagcataaaaatatcagagggacttcagtttttgtttaactcaggatgaatttcctggctggatactatcctagaattttccgtataattaaaacattaaacagtttcatgccagtggaagaaatttgcctctgcgttggcatttcttcattgtgggtggttggaagcctgtttagaggcggggttctggaggtactggttgtcttttttagttgttcagcttgtgtgtggactggtgcccttattgctgaagagggggtggtacctggaaatggaggacaacctcacttcagctgcagggcagagacttggagtgctctcatccctttgggtgtttcccagtgcagtgatattgttttgaaaacggtgtggggaaagagatcactttttgaaaatacctcatgtttgtttgaagcagaagaatatcgtgatccattccttttcccagcaaaattcctttagtttttctcccaagttgagacatccactcctgcctgtctagcagtctggggagcgagtggggaggtacctgctggggtcagggctgaaggaggggcctggaggctgaggcaggggcctggggctcccagagacaagcaaggctgcagtgactccaggctgctcctgtcccagttcccaggactctagctaggtcctgttgcatctaatcgttctcatttttttagcttttagaattatctcttgaacacctattttgtttcagacacaaacagaggtagacataaagaaatgtgttacttttcctttgttgagctctttatctcagctggggagataggttgattggatctttgaaaagtagaagtttaatattagttgaaataattcattattgcataactttctattttgatataatttcaggcttatgtaagttgcaagaatagtacaaagagctcttgtgtgtcctcctcccagattcactaagtgtttacatttgtggaataattaatttttaattaactttgttaggccagtccctgagacgaataggaccttgtccctggatgaggtgtaccttattgactcgggtgctcaatacaagtaagtaaaccaggactgctgtggaacttgactatggattcgaggcagtggagaaggtggacagctgagctccagctgagagcactcagctggtcatcgccctctgtgctggccactaatggaatcgttcctgtgtcttgtcatttttttcacccctatttgaaatagcccagttgtgactctgttctcacaaaagactgtttgatagaaatgttacagtccttggctggaagttttaaaaatataagtaaacaactgtgaagtaaagcaagcttttggaaccgttgaaagttttccaccccagcccatgaaccgcctgccggttccctgtactctcagctgccccagggccttatgaagtaagggattaattttgaatgaataaatgagaaatgagggctgcccccacatttctgaatttctttctccatgttttgctgctttcacggctatcatctctggaacaaagtttctcagagaagaacccaagatttggttgggtcttgatacggaacccaaaagaaggagtaagaatagaccctgtctgcattaagagggcacgagcaaggccttttttttgagacagagtctcactctgtagcccaggcaggagtgcagtggcgtgatctcggctcactgcaagctctgcctcctgggttgcagccattctcctgcctcagcctcccaagtagctgggactacaggtgcccgccaccacgcccggctaattttttgtatttttagtggagacggggtttcaccatgttagccaggatggtctcgatctcctgacctcgtgatccgccggtctcggcctcccaaagtgctgggattacaggcgtgagccactgtgcccagccgagcaagaccttttagtgctgctccattccccactgaagttgggactatggctaagggaggacctaattattgaatgagctcagccaattacgtggcaaccatgcctggccttgggacacaggggtgttaataatatcagcctagagctaaggattgcttgataatggtgtaaacttttcttcacttctaaatttttagcaggattctagaagttatcctttctatgtcagggatatagtctagtgtgtgttaagatatgtacttggatatttttagggtctctgtccaggaaaccccctgctgttctaacaggagaagttgggttttggccctcttttgctagagatgggctcctgttttctttgccttcttctgtcttgttcataaccccagtgatagtgtctctcgtgaaacagcccttatgctgtagaccaagaatgtgtgtatcaggggctgacgtcactcccagtttatttagccatccctgcattcacactttgtttcattttttaaaataacttcattggggtaaaatttatgtaccatgtaattcacccacttaaaatatacaattaattttttttatatattcacagagttttgcagccatcagcacaatcaattttagaacattttcattaccccaaaaagaaacctcatacccaatagcggtcactacccccttttccactaccctggagaaccactactctcctttctgtatctatggatttgcctattttggacccttcatagaaatagaattgtattatgtatggctttctgtgtctggcttctgtcatttagcacaatgtcttccaggttcatccatgttgcagcatgtatcagtattccatttctttttaattactgaatggtattgcactgtgtggataatcccccattttgtttatccattcatcagttgatggacatttcagctgtttccatcttctggctattatgaataatgtggctgtgaaccttcatgtacaagtttttgtgtggatgtatgttttcagttctcttggatatataactaggagtggaattactgggtcatatggtgactatatttaaccttttaaggaactgcgaactatttgcaaagatggctgtgctattttacatgcccaccagcattgtatggggcttctcacttgtccacatgcttgcctgtgtcatatttgacttaaagcttattttgacgggaaaccaatttgtcctttttttggaaagggatggcaccacagatgtgacgcggacaatgcattttgggacccctacagcctacgagaaggtaaggtggaggtaaaaaactcaagaggtcctctctgctttcttaagaagagcattgcttttatgaaaagggattgtataaagaagtaaaaattacatgtggggtagtaaaattgctccttgctgtggagtcaggcttatctgctttacgaggttcatttaactaattattggaataagacatttggagaaatttttaaagcattctgctaaggttagggcagctcaggtgtaagtttaaatatagtagctttggccttctcttgagtcaggaaatgcctttgaggctggggatgagatagtgaaatacatgctttataagcagtgcctagatttgattttgaaggccacccccttctttttttgagattcttatttacaggcttaactctctggaaactttctgaaatgacagactctattaagtttctggtatgattggcatggaaaggggaaagagagctgtgaggcagagagatgtgtactaggggtctggagacctggcttcagagcttctgtgccatttactagctctgtgacgttgaacaaagcagtcaccatccataaaaatgaggataaaaggacccaccttcccgggtggctgtgaattcccatgagcccagcaagttcctggatcatagtcactgctcagcaaatgctgattgagcacctaagtgaatctgtttgtccaagagagctccttcaggaagattatccaaggaaaagggttttatgcaatgtagtggggcaggtttcattgtcttggtcccttgccttttccatttgtattcaccagtgccttagaagaatttggaccttgcgtctaggattcttttggtgtgactctttttgtgcttttcaaagagctcaaccaggctgaggagcatggagttttagtcctgactctgcaccttactggcaagctgctacacttctgagtagcacttctcttgtccggacagtggggataacccctgaagataggatggtggtagggagcacagctgttgaagcaagagtgcctggctccaaggccagatgctgccacttaggcactgtgtgatctgggcatgctactgaatctctctgtgaagcgaggataacagtagtgcctccatcgtgaagtgtgggatcaaacatacagtgcttagaatagtgcgtggcacagaggatagctcagtaatgttagctagggtcatcagtactttttattacttttccattctttctaaggctcacatgatggagtatgtcagagtgttcattataaagtcatgtggggtcatctctctgacagtgctcttctactaaattgaatttcaagattttctgggaaattggtcccgtggccaggctttttttccaccagatttttttctttttacttacattttctctatgatattgctaaaaactttagcaggcaggattttctgaactaccagaaaactacaggattagacatctgtccccattctgcaacatgcccctgggttttctttgcaggaatgcttcacatatgtcctcaagggccacatagctgtgagtgcagccgttttcccgactggaaccaaaggtaggtggtgcattctgtcacatggcaggctctttttcttgtttgagaatcaaatatgtctatgtttgagtgaaagaacatgtcgttccttcactgtgaggtccccatcccacttcaggcccagccaggtgctcatggggtgagtctccataacccactgactgagcccagaggcctcagggagccgggttaggattgggcccagtaccccctgtgcaccattctcctgaccacttatggtattggatgacacatgtggatggctcccaggagaggacaaaccagatatgaaggtcacagggcctgagtggaagttggtgcagcctcctgtctgccctttagtactgggccagtgcttcctttcgggattcttaggatttattttactgggaccctgacttcagctatgtactactttgcttgaggcctggtgggtggagcattggactgggcattgacaagacctgggctgccttgcttttgggtagattagacatgtactcatctccctaggcctcagtttcctcatctgtcatgcctgcctgtctgcttgcagtctggttagagtctcatctttgtaattctgaaaccttagggtcgcagagctggcaagggaacgtccatgtctgatacggcctctgtgtgctgtaggtgtctatccccgctcaccagcatcctgaatggatgatcgcctagcttcagactgagctctgatggtttctcaggagctctgattgttagaaagttcttccttgtgctgtgctgaaatctgaaccctccagtaacttacctattggtttctgtttcacgttctggagccacacataataaatttaatctctaaagcgctgtacaaatacaattaagtggctctttatgtctttcaggtcaccttcttgactcctttgcccgttcagctttatgggattcaggcctagattacttgcacgggactggacatggtgttgggtcttttttgaatgtccatgagggtccttgcggcatcagttacaaaacattctctgatgagcccttggaggcaggcatgattgtcactgatggtaagtgtccctcacatagagggcatgcgtggatccttgagcctttttgaaagctattcgttgttttgtattttttaattagtttaaagtaaattggcaatacttttcccttccaacaaacttttctgattatagaactgatacatgttcattttagaaaaaatgagatgggaactgtgtaaaaagaaaatgaaaatcatttgcaatctaaccactcaggggaaacatgacttagtgttttactgtattagcttttggtctttcaggtatgtagatagcattttttttttaaatcattgagatcttactgggcatcttgtcttatgttctgctttcttacttgatacattgccttttctcaggtcattgccaagtctttgtaaatatattttaatgccttcattattgtgtcttacggatgtgaaccatgatttatttagtggatccactgttactttactccttaccctgtagccagtgtgcagggacttcagagtctagctttctgcacctcaagtgcctataaaaaagtggccatatgagagaaggtggcatctctaggctcttacaccagatagagtgggctcttcacccgtttcttctcctttggagtagggcagtcatccaaggagtgaaagtttctctctgtagacatcttcatcgtgggctgcttctcatttttgggatttggtttgttttagagcccgggtactatgaagatggggcttttggaattcgcattgagaatgttgtccttgtggttcctgtgaagaccaaggtgaggatttattaaaaaaattttcctgtttctattagcaataatcacgcctcggatagacctcattggctacaatactgccactgcgcaaagcttaaaaattttcctgtttcttagtgtgggaagatgaagacttaatgtctttggagccaagagtatgccattctggggccaacatggagccttcttctccagatatcagggactttcctggaaaccacactccttccctgcaaagccagaaagaaaatccttaatgaactgggatctagaactgggattcacagaccctcaggctgatgcttgcttcacatgatttggggctctgagtttactataggcggcctgttgtctcttctgctaggggtgcctattcaaggcgctaatttccagggcccctcccagaccctagaatttccagggtggggggcctggaagctgtaattttgtcacactccccaggtgacttttattaggtaaagttgaggaaccctgagttatccatgggtcagcctcaaaggcaatacaagacaggtgtttcaccctcttcccccatcagtgttaccaaggttgcagggttttaggctctaggctttacctaaaagacctgtttgtgcctcctccattggtggaattgaacaattggagggaagtagcttcctgtgtctacaaggaggttatctgcggggatctgctctctgctttggcatggaagtcactattcttggaagtgacctcccatcttattcccaaaagctgccatgaacagaaacccgacatgttcttgtgtgctccagtggatagatgtgttgtcgcctgatgggcctggctgggtcaaggcagaccacacagttgactgttataaaaatgattttgaggacttacacccctgcatcctggagaaccaaaaccagagatgcccctaagcccagatacccccatatcctgcccctgtttcctatcacagtagacattagccttgggacctgttgctgggagcccctcagcaccctttgtttggcctttcctgatggcacaggccattgtttgcccagtggaggagctcttggaaaatggcatcaggttccttgtgtgtctgtgaaaagtggtgaccagctcaccacttcttggctcccagttacccctggctctgagggatggcatgctggtggaatgacctcatggtgcttcagcatagtaaagaggagtaaaagcatctgttttcttctttctcccgcagtataattttaataaccggggaagcctgacctttgaacctctaacattggttccaattcagaccaaaatgatagatgtggattctcttacagacaaagaggtaatggggaagtcttggtgggcaggcatgttactaggggaggtggagactaccttaaatagttctaatccatcctctaaatcctaaattctctaatccagtctcactttgtaatttttaaatttagaggtctaggccagttgagtctgaaagccctaggttttctgaggactcctgagcttttcctgtatttgttgggcctccaggtggagatagtcctgtttcccgcagccattctggggctgtagggtttgtgggtggaactcgtatgccattgtttggctgtactattcctccatagctgcagtgaggcgtgtttagcaaatatgagcctatgtgtgtccctacaaaaagccagatggatggtggggcctcttggccactgtacataccagattgttttcttgtgttacatgaaacattaaggaaatggaaagcaaaatctattatcgtatgtcctgttttcacacagacaaggagaaagatagtaccagcccttctcggttactactgtggtcactctggggcagtgaaacccttcacaaagcctggggcacaacagtgcttacttgcccagctcagagggttatgggtcttaactccttcagaccctggactggtaaggccaggtcagatggcagtcctggggacatgagaaaggcctgaagaatcacacagatgttcaaggtcagagcagaaacaagggtcagaaatggggtaggaactgttagcactagacagacaaaacagttcccaaaccaggaagctggaagccaggaggacacaaattccagagcaaggcaggggtcagaagttccaatgaaaagcaaatgactggtgggagccgaaggcagggtaagcacggtgggttactctcggaataagaatattttgttatctgaggcagccaatggcctttgagtgcctctcaaggcaggaacatttcctcactggcgcccacttgggcctcgttcttgacactgtaaaggaaagggtctttgggggttaaggaccttcccttccacaggagctgtggaatgggattctcccagctagaagcctcttctgcctgttccagttcacaggtgggtgatgagaaagtccatccacttcctgcttagctttcctctgtgcttgagcgcctctgcttaaccatccgtgcccttggttcagctaaacattcccactcacaggacccacatgggccttgctgataccgggtgggttatgcagcttgtagatggatatggaaaaggaaactcagcctatcagcacaatgtctggtgtgtctcttcagcaggaagagtccttccagtgtccaggggctcttgtccagcccctgtaagtgttgccttagctgagaggaaatgaaaacacataggtgggcatgggacccaccctgcttagaatccctctgccccataggaaccagtgtctcttgtaatggcccttgggcacagcttccagggacttagcaaggggctttccagtaataagtcatttcgcactcttggaagtccaaggctatggattcctgccaagtaattctaggtcatgcagtccttcctgtccacataaagtgtacccatcaggaggcatttctcccatatgacattcccctttatccagggaagtagtatatgaggaagtttaagccaggccatttttcctcgaaggagaatcagtctactcccgtgacattggacatagaccagggatctgtgttacccagtgtttcattgctgcaccttgcatgcccacatgattgaactattctttcggccagttactctttgtagggcagataatgtcttcttaaaatatctggcttttaaaatatctggtcatttgccctttactatttagcctttattttggagtcactttagggagtttttggtttgggtctgcatcgtcatcacttatcaccagatggcagcaaaggaccttggtcagatatgaatatggccagctgcagactgtcagggccttgtgctgctcctcaggctccaccgaggctgtccacactcccacttttccctccctacttccaaccaaaagggccatgggcgtttggctgtggccccaggcttacaccaggatgctgccgttgccttactgttgagctgctttggacagtaggctgctttgtagccctgctggccttgctgtggacacatagcagtttgcctgcttttgacatcctcccctgcccccatcacttccctgactcccagaaggggctactaggctcttctcagtagggattggaaccctggctgggtcacagccagttggtaacaccaccctatctgtctgccctcagtcccttgtaattaatgggtttgtgtgcccatcctgaccccagctgggctttggtacctggctggattgtagtccctgaaagcagtacttctgtaacatcgctgccctccaaaatggcctttgactcatttatgacaagcacagccatggcactatcagtctcatcagcttccagacagctacccccatagacagtgatgagagtggcttgttgtcctcttggtaaaacctgcttcactccagacttcaccttttcccgtatacaaccaaggaggagagttcaccctttttcctgcctcagagcttttgccatcatgtctagtggatcagcccctgcccaggcaccaagtcctgccagcaggtccttcctttcactctcttttttgtctcctgctcttgtggcatgttgagttgagagtctgaaaactaagtttactcccagcgccattctgctgcaccacagtctttaaccaccgcaggttttgggttcatctaggcagctacactcaaaagacacccatgggcttggctgatcctagttttttattcagctttttcagtggatataggatatgtagcccagtgtgttggcaggacagcttcgagtgtctctctcagcaggagttctcacagagtccggggctattcccccacttaccacctcccaggatggctcaggtttaagggaatgaagccacacaggtgggagcaggagctactggcttagagactgctgtctataatagtaaactgttctgggagccttttcaccagaagccatgaagtctggtcctatgtatttccggggaaacagaacacaaggaaaatacttacctgtgagtaaggagaaagggtgttgcacaccttttctctcagcttgtgatcttagcacatgggggcctttgctgttgacctgtgtagccagttgttaaagatgtggtggtgaataccgtgtctgtccttctcttccctgcagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgctttgtcttagctgtctctttcttcatggtgctgtcccccggcatgtcgggtgagctgatctccagggctgctggctctgtggcagacatttcctaggtggaagggcccctttgagaagagacccctggcctccccgcacatttgggggcttagttgtaagctttttcttttctctagaaaacctaatattatggtgtttttatctcagttttttttcctgattttaaaatatgtcattcctatgcaaaaaacaataaaaattatgtcaaaagtcagttttccataactcaccctatagcagatgccacaagtgtcttacctacatggccacagctctcattgttccgttacttgtaggcaggattctgtgacaagtgcctgcgactcccattctgcaggatttcttttgacttgtatatgtggggcaagctccaagggttggagagttaatgtccctgagatctcagaccatcacgtttggggatgggatgggcaaatagacttcctcatcctttggctaagatatcagaggtatgtcttacattgtcactcagggtttcccagtgggattgagccccacttgcccaccatggtaacttgctcaataaccaaccctttgttttctttcttctcttccatgtcctactttcttcctgtcccattagtgtttcctggtaccatcctgaatgaaccatttacatgcaaatccttgttttagggtctgcttttttattaatccaacctgacatactccttagatataaccactattatctgctttatatttttgctgactcctttttttttgtattcaaaatttactaaaatactgattatttgtgtatgtatgaaagaatatgccatatatgaacatatcacatttacaaacagtgaattattctgtacgtatacaattttatcttttaacttggcaatattttagattgaattatttttaatgacttaattccatcgtatggttatattgttttaaaactagcctcattaactttttaaaaacagtaatactagcatttagacataattttttaaaaaatgtattagtcttaaatcatatagaaaacaaaaactggaatcacaagctatcagtacactaatactggtttttataattgcccaatgtatttatttttcttgagatctttatttcttcatactgctttgggttactgtctagtgtcctttcattgtactttgcagaactcctataagcatttcttgcagggtgggtctagtggtactgaactccctcagcttatgtttacctgggaacctcttaatttctccctcacttttgaagggcagttttgctggatataggattctttggttgtcagtttttttttttttcttttaacattttgaatattggcccactgccttctggcctccagaatttctgatgagaaatctgcaggtaatctcactgaagatcccttttacgtggtaagtagcttttctctcactgctttcaagattctctctgtttttgacttttggaagctcgactataatgtatttttgtgtgtatctcttggagttaatcttacttgtggttta

SEQ ID NO: 13391 - DNA, 24482 bp, Human
aaatttgctcaagattacacaactgaggcaggagaatggggaacatgaggcgtgagagagcaaagggaataaaaatcactgggaaccggtaacccccctcacccccgagagtggccagggagagagaggctgcctgagggaaggaagctcggcaggacccgctgcagacccagggccaagggaagtcccgcgggaggaaacgcgggcgcggtggggctggctccaggcacgcgggccaagggcgggagggtcggacacgaagccacaaggctcctttccttcctcctccttcccgtctgccttcttctgcttctgcggcctgatctccgagtccctctgcctgcaggcggcggcagaacgtccgcatctgtccgcatctcagcgctgtcccccaaccgagtcgcgccgcgttttcctcttctgtcgggagagctcgtgctgggaaccgcggggcaggaggacggcccaagctactctcgatgtccttccccagcccacgcctgccccagccacagttcccctggttttcctgaggttctccagctgctcaatgatgggcaggttcatctacagcctggagcagccgcctcctcctcctcctcctcctcctcctcctcctccagaaacacccctttttccttctcctcattcttccttctcattctttctcctcctcactcttccttctcctcattcttccgtctcattctttctcctcctcattcttccttctcctcttcctcttccccttctctttctgttcttttcttcttcctcctcctcctccttttctctttatttttctcctcctcctcctcttctccctcttctttctccttatactcctcctctcctcttactgtacttttttttccttctgctttctctgccctcctcttcctcttcttcttcttcttcttctttttttttttttttttgtggctggagtgcagtggcgcaatctcggctcactgcaacctctacttcccaggttcaagcgattctcctgcctcagcctcagtagctgggattaaaggggtccaccgccaccattccctgctaatttttgtaattttagtagagacaggtttttgccatgttggacagtctagtgtcaaactcctgacctcagatgatccatccacctcggcctcccaagtgttgggattacaggcatgagtcaccgcgcctggtctctttctcctttttttttttttaaagaaaaattgaaatcatggttttctaaaaatccctcctagctctcagcttcaccgaaccacgtcctggtcattgacttgccgtgtgactgctgtgcttcccctgtttccatttccctccatttctccctccttcctccctctgtcacccatgcccggaggagcacgataagggaccaggccgacctgggttccaaccctgcctgctccctgtcctgttgacgctctaattccacttgcagccccactttcctcatttgcatagtgttctcccagtaacaacagcagtcataccaagttctagggttctttcgaggatagtgtgtattcaccgcagtgcatctctgatgcctggcacatcggctgtgctcaagtaatggcagctattgcattacagtgactatggagttaggggaccgcatatggcaaaatgctgatcactgttttgaatttggtttcattcctctaatctcaaatccagtgttttaaggacatgctaaatgctttgtcctggagagctatcttaagggacaaaatcgttttcccagcgtcatctgtgacacatcctgacagtagagagctgcttccaagaagcaatttgaagtgccattatcaggcagggacgggggctctaggggatttcggggtcagcagatatgaaatgaatgatttcatagggctgtcacagagctgtggtgggaatttcccatgagaccccgcccctggctgagtcaccgcactcctgtgtttgacctgaagtcctctcgagctgcagaagcctgaagaccaaggagtggaaagttctccggcagccctgagatctcaaggtctgtccatctgggggagtgggtgggggcactgagaaggggtgagattggaacttttgctccctttgcccatttctagactttttctcctaatatgtaataacttctcttcaatagccctttaaataaacatcaataacttagcctgaagagtttttcactccttagttttgttaccatacaaacttcacatctcaaaacatgtctctgtttaagaaaatgtgttagtgagttgaacagggaggtctttccacatgttagtagttaggtgttcagctaaagggggaagagtgattatgtgatagcttcttcttgaactgaattgtctgatgcccctgacagattctctttgtaaggagtttatttcaggggcaataagtaattggcattattgctggttggtactgcaaagtacctatgaaagtccccaaaagttcttgctattgttatttctgcattttggcagaacatgatggaaaatgcaccctcaaactttggcaaaccggcacaaagctgtgtgtttaatcacgcctgccttgtcctagtggtttctatgaatctgctacttttccgtaatattgcatcattaattgttcctgaaaaaccctgagttatcctcttatagaattgtataagtaatgattgcaatatagataattttgaaaggagaaaccacctttccttggaaatgtttatcttttgcagagtgacatttgtgagaccagctaatttgattaaaattctcttggaatcagctttgctagtatcatacctgtgccagatttcatcatgggaaacagctgttacaacatagtagccactctgttgctggtcctcaactttgagaggacaagatcattgcaggatccttgtagtaactgcccagctggtgagtacccagttatcatgtgcatttgatctgctctgttggaagtatggttcagttagtctagtagtcagggctaacgagctcccttttaaggaaaggaaaatgaaaattcattcatttacaaatgtttattggatgctacaacctagctgtgtgaacacagcaaagtcattcaacctcttgtgccttgactttctcatctggggataataagagaacctgttttataggatggctgggaggatcaaatgaagggcttagaacagtgcatggcacaaggcaagacttcaataaatgttagttttgtgtgtagggctttgtgctccgactgggggcatagcagcgagtaagcgcgtagtaaagggcttaacagagtggggacggtcagtcgcatttaaattttagtgtaggacattgatgtcctcctggatccagtcatattcatctcctacatcaatcaagataatcattttgttttattcaatagataaagtattttctttctgctgatttatttgttacaatatctggtttttttgttttttttgtgtgtgtatgttttttttttttttttgagacacagtctcactctgtcgcccaggctggagtgcagtggcacgatctcagctcactgcaaccttggcctcccaggttcaagcaattctcctgcctcagcctcccgagtagctgggattacaggtgtgcaccactgcgcctggctaatttttgtatttttagtagagacaggatttcaccatgttggccaagctggtcttgaactgctgacctcaggtgatctgcccgcttcggcctcccaaagtgctgtgattacaggcgtgagccactgcacctggcctgtattttgttatttctaattctgtgattacacaaagaataatcttgcaaatgtattgttttaggaagtcaatcaaactaatgtccaccactgtggcatctagaaaactcatcattcttttataatcttattttcttgtaaacttcggaatgccttgggtgacgattgcccattgtcaaacgtgtaccactattgtctgcctttcttaggtacattctgtgataataacaggaatcagatttgcagtccctgtcctccaaatagtttctccagcgcaggtggacaaaggacctgtgacatatgcaggcagtgtaaaggtatgagttcaaagatattttcttcttctagaagatagttgggaagataagcttttctttcccatttactaactgctctcttttgaaaatctcaagtgtcaaagactgattcttctgccaaccagcaggtctaggacaataatatccagtgacagcaattatttgtggactgagctttctaaatattagaggaaacattcatttgacaagagagaagtttttacttacctaaatgtaaaaatgtctttatggagatttaaaagtaaactttaaaattactgggaacactataagtagagtgagcatgatttttactgcagagcataaattcgcttcctggatttggaggtcaagtgtaataaaatgttgggggctggggggactttgtaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggtacgtttgcgtttctttgatctagtgtagttttgtgacatagacaaacttagctttgatcttgatcctttgaaaataaacaaacagatttgtagaaccttaaagtaacaagggagtatatgatatatcatattttaattaataaaatatttcaattaataaaatatttccgttatttcttcataaatggaaataatttgaaatcagaacatttgttaattgccagaaccattaatcttcacatgttccagacatatacaatactttatgtacaattaaaataaaaactagccatcttagggtgttgtttcaagaattattgaacaatttgtgcagattgcattatggtaatgacttatattaagttcatcacaggaaaagttacaaaatgatgaaaatgcttcccttttattattgctttcatttttaatacaaggttgtaaagactgttgctttgggacatttaacgatcagaaacgtggcatctgtcgaccctggacaaagtacgtataatttcctttagtttatggaataaagaatctgggttaaattttttggaagataaggaatgctatcattgaagcttttttgcacccatcaagtgtagacagaatgtaacatactaataggcagcgtgggaacactgtgaggtcgtagcaactcaataggcaaagtgggcattttctccagaaatagtgcctggaacatctagatcagaattgccagtggaggctgggcacgtgcagtggttcacgcctgtaatcccagcactttgggaggctgagacaggaggactccttgagcccaggagttcaaaaccagcctgggtgagaccctgtctctacaaaaaatcaaaaaattagccaggcataatggcacatgcctgtggtcccagctatagggaaggctgatgaggcaggaggatcacctgagtctgggaggttgaggctgcaatgagctatgatcgcaccatcgcactccagagcagagagcctgtctcaaaagaaaggaaaagaattgccagtggaactttgccgctgtctgcctcttttctgtttccttctcattcctttgctgcctcttatcttctctcattgatcagcctgtctccatgtgttcaatgccagcccctagaatgatacagaagaaactaacaattgctcgttaccctccaaaatgtggcacagacttgggcacacaaggccatcacaggtggtaaaaagccaatagtatacgagagaatgtgactgttgttttgtggaaccagaacttacactgtggtctgtggatgggtgctggtccacaaatggcttgtcctgtgtccccatcgacagtggtgtagggttagagagtaaacatttagaaacttttaaggcaaattggcagagtaatgtggtctgttgactaagaataaaaatttgggcgttgtattttatatgtatttgttctttttccgtttcattttcttactagaaaatcatttttattattttacttttacatttttattgtatttcaaaagtgtattggtttgtaacagactggaaagtgacttttttgagagaaaataaagtgttttgaaacaggaatcatggtatctctctgcttttgtcatttacaatttatcagcatcagagtggctgacgaatggaatcatgattcacaagaaaagtattgactattttctcggacttagctgaattctgtctttggaaagtggcttttttaaaaaggtctgtttgtttgttttgtttgtttgtttgtttgtttgttttgagatggagtttcgctcttcttgcccaggctggagtgcaatggcacggtctcgcctcactgcaaactctgcctcctgggttcaagagattctcctgcctcggcctcctagtagctgggattacaggtgcacacaaccacgcctggctagtgcttttgtatttttagtagagatgggctttcaccatgttagccaggctggtctcgcactcctgacctcaagtgatccgcttgccttggcctcccaaagtgctgggattacaggtgtgagccactgtgcccagctggaaagtggctttttaaaaaaggtctttcaatacaaatttttcagagttgttaagtgagtctgcatggaaaaatgggtttgaactgggctctggaggacgggcggatttggggtaggtaaagggacaagggaaaggtgtcacaacaacagcaacaatgatggcgatgatggtgataatgatagctaccatttactcagcgtgtcagatgtgcaagagtgtgtcactgactctcactcgtttgttctttgaaacagttctggcagcacatacaatcctaattttgcagatgagaaaactgaggcttagggaggtttcttttttcttttctttctgagacagcgtcaaactcctgggttcaagtgatcagcctcaaactcctgggttcaagtgatcctcccacctcagtctcccgagtagctggggccacaggcatgcaccatcagttaatttttgtttgtcttttaatttttgtagagatggggtcttgctatgttgctcaggctggtctccaacgcctggtctcaagtgatcctctggcctcagcctaccaaagtgttgagattataggcgtgagccaccatgctggggttacagagatttcttgacttgcccaaagtcattctggaaagcagcagacccagggctcaaaccctggtttgcctgatgctagtgctggacctcctaaccctatgctagccttcatctgtgccggagatggtcaagtccgattaagaaactgggggtgagagactaagcaggcaagacagactgaactaagctgtcactgaacagaaggaagccatggaaagctgcagggagccagatggtcaagtggaagtttttcaaaatatctttgcatcgctttcgaacccagacccatatatctttttcactaggctacttcattgggtgaaaaatgacaaagttttaaaccagaatcttctggacctaagttaattatttaaattattttcattgaactgtctaagctgttctttggatggaaagtctgtgcttgtgaatgggacgaaggagagggacgtggtctgtggaccatctccagccgacctctctccgggagcatcctctgtgaccccgcctgcccctgcgagagagccaggtaactgggctatgcctttacgccaaagtgcgtatcttatggtgattccagattgtatctaaattgccccaatatcatgatatctcatatcaggcacctcccacgtgcattcttcctgaatcctgccctcagggacccagcagttttcttcccaggcatttgttattcagtctgagatacacatttgtaagcggtgccagaggacacttcacccaaacagagtctatatctttatcaatgccaaggaaaggggattatagggtcccatattttttcttttcttttcttttctttttttttgtttttaagagagtgtcttgctctgtgccaggctggagtgcagtggtgcagtctcagctcactgcaatctccacctcctgggttcaagtgattctcctgcctcagcctcccaagtagctgggattataggcatgcaccaccacgcccggctaatttttgtatttttagtagagatgaggtttcaccatgctggccagtctggtcttgaactcctgaccgcatgatccgcccacctcggcctcccaaagtgctgggattacaggtgtgagccaccacgcccgtccagggtcccatattttcttttcttttttctttctctctctcgctttttttttcccccgagagtgccttgttctgtgccaggctggagtgcagtggcttgatattggctcactgcaacctccacctcctgtgctcaaccaatcctcccacctcagcctccccagtagctgggactataggcactcaccactacacctggctaattttttatttttttggcagagtcggggtcttgctatgttgctcaggctgctctcaaactcttgggctcaagcaatcctcctgccttgggctcccaaagtgttgggattacaggcataagccgccacgcctggtccccaggtcccatattttctatgtgctagaaaggataaactgctcaattattaagtttcttttatttttttgggggggtggacagagtctctctctgtcacccaggctggagtgcaatggcgcaatctcggctcactgcaacctctacctcccaggttcaagcgattctcctgactcagcctcctgagtagctgggattacaggcgcccaccacggcacccagctaatttttgtatttttagtagagatggagtttctccatgttggccaggctggtttcaaactcttgacctcaggtgatctgcccaccttggcctcccaaagtgctaggattacaggtgtgagccaccgctccctgccattaagtttctctttttcttttctttcttttcttttttttgagatggagtctcactctgttgcccaggttggagtgcagtggcaccatcttagctcactgcaacctccgcctcccgggttcaagccattctcctgcctcatcctgccaagtagctgggattacaagttcctgccaccactatgttggccaggctggtcttgaactcctgactctaagtgatcctcctgcctcggccttccaaagtgttgggattacaggcgtgagccaccatgtctggcctctttaaaagttttctaagtttactccattagcaggttggagatgcccaaggctgtgattcttctcatgcttagaaatttaccaatgtaaatatatacatgggtgtatgagtgtcaacacatttctgcatgcgtttctccttttgctgtgttttgcaggacactctccgcagatcatctccttctttcttgcgctgacgtcgactgcgttgctcttcctgctgttcttcctcacgctccgtttctctgttgttaaacggggcagaaagaaactcctgtatatattcaaacaacgtaagattaacataatcatattacagctctggcaaggcaaggctttttataatagaaaggaaaatatgattttaaaaaaaattctagaaatgaggttcatatagccccgtggctatcacgcaggggcaatttcgtccctgggaatatttgcagtgtctggagacagttgcagtgttcaccgctcggtggtgatggtggtgattaggggctattgcatctagtgagtagaggtcagcaatgctgctcaactcctaccgtgcacgggacagcctcccagcaaagaatgatgctgccccaaatgtcaatagtgctgaggtggagaaagcttgcatatagaagagcacacctcggttctagaaaaatgacagatttaaatatgctgcagccttggattattgcatgtatgtgtatgtgtgtgtgtgtgtgtatgtgtgtgtgtgcgtgtctgtgtgtgtgtgcgtgtgtgtgtgcgcgtgcgtgcgtgtgtgtatgtgtgtgtgtgcgtgtggaggacactggcaaagaagaatcagaaaaccatgttccctctatgtccctctggttgataaactggcttaaaatgagtttagacccatatttgaggaaggcaaggagaacaaagagggagcttgaagggggtttaacaaatgaattattacagcaccagtatggattacatgaaaaatttcaataatgaatttcattcattcacttgttcaacaattatttctgtaaggtactcagcaagtgcctggcactgagtcagcatccactagacaaaagccattgatatttatttgaaaaagtatatagatggaaggcaatctgttttttgtcttcatggacattaggatgagacataacaggcttaataagacttaataagagggatataataaaaggagctttttgagagcaaaattttaacccaaagcaccatgtaagaccagaatgtgcctatttggagattgttaaaaatatatatgcaggaacagcattagtaaagtctttttttttcttttttgagacagagtttcactcttgttgcccaggctggagtgcaatggcgtgatcccggcttaccgcaacctcctccttccgggttcaagcgattctcctgcctcaggctcccgaggcattacaggcatgcgccaccacacccagctaattttgcatttttagtagagacggggtttctccatgttggccaggctggtcttgaactcccaacctcaggtgatccgcccgcctcagcctcccaaagtgttgggattacaggcgtgagccactgcgctcagccagtaaagtcttatctaataaattatgctaatgtatttaaaggctctttttaaagcaatatagaacttttatacattgtgacctatacagaaaaatgcataaatgtaaagtttaacaaattgttgtaaacaaacattcaaataactctaccagggtaaagaagtggaacataactcattcccgaagcccttggcatgccctttctagatcacagccctctttgcccactactgctaaccacatctagacttgtatggtattaacttccttttgctgtagttttgctacctaataacacagttttattgggctgcttgtgaacttcatacaaatagaatcacactgttttctgtatcttgcttcttctttcaacgttgtatcatgaagattcatccatgttgagttcatctttagttgatttccactgttgcacactcttgttgaatgatgacatcattgttcacctattctagtactgatggacagcgggatcatttccagcttggggttattacatgtaatgacgtttgaatatttttgtccgtgtatctcagcacacgtaaacacgtgtttctggcttggttttgttttttaacctagaaataacgttgctgagctacaaggaacatgtgtatcttggtcgtgaatatgccaaactgttttcctaaatgattggaccccatttacactcccctggcggtaatgagtttcctgttactccacatcccctgataactcttggtatcatcagattatttttatcgatatggtgggtggatagttgtatctcattgtggttttaacttacacttcctggttgctagtgaggttagacgccttttcatgttattttggctatttggatttcctctttagtgaagggcctgatcaagtcttttgagtattttctcataggattgtctgtccttttcttactaacgtataggaagtttttagtctgctgttcatgagctgcaaatatcttttcctattctgtggtttgctctttcattctttttttgaggtctacacctccagtttaaacctctgcgttctcacttaaacctgatttcagttttgtcttttgtttttttgagacagagtttcactgtgtcacccaggctgaagtgcaatggtgcgatcacagctcactgtagcctcgaactccagagctcgagcaatcctcctgcctcagcctactaaatagctgggactataggtgcataccaccacactcagctaatttttaattgatttttagtgtttttgtagagactgggattcacggtgttgtccaggccagtcttaaactcctgggctcaagcgatcctcccacctcggtttcccaaagtgctggacttaatcctgatttaaaggagtatctctgcaacaaagttccatccacaccccagactgcaacaaagttcgttataaaatgcttttcaaaagtatttatgagtaattagtgagtttcaatggaactgtaatccattttttaaaagtttttaggacactccctggtagtctagtggttaggattccgcgctcgccatcacgacccgggttcgattcctggtcagggaagccttccttctggctgggcgctgtggctcacgcctgtaatcctagcattctggggggctgaggcgggcagatcacctgaggttaggagttcaacaccagcctggccatggtgaaaccccgtctctactaaaaatacaaaaaattagccaggcgtggtggtgcatgcctgtaatcccagctactcaggaggctgagacaggagaatcgcttgaacccgggaggtggaggttgcagtgaactgagatcgtgccattgcactccagcctgggcaacaaaagcgaaactccgtctcaaaaaaaaaaaaaaaaaaaaggttttaggtcgttcaaaagaactttcaattttgacgtaattatagattcacaggaatttgccaagacaggaacatctctcatgcggtttctgggttccattctccagtacaatggcaaagcaggaaattgacattggcacagtgtgcgtgtgtagttgtttgtccctttatcacacatgtggagttgtataacaaccagcacaataaaatcagaactatccatcaccacagagatctccttccactattcctttctagttaggtcctctacctctccccaccatcccctggcaaccacttatctgtctttcatctctatacttttgttatttaaggaatatggtataaatagaatcatatggtatgtgtcaagctaaatcatagatagagagagcctctctaaaagattatattttttcaggagtagcattgcagtgggaatacggtgggtgtattcagggatgtaaaggtgatgcgagtttttaaaagaaaaaatgaggggcggggcacagtggctcatgcctataatcccagcgctttgggaggctgaggcggatggatcacctgaggtcaggagttcgagaccagcctggccaacatggtgaaaccccatctctactaaaaatacaaaaagttagccctgcatggtggcacgtgcctgtaatcccagatacttgggaggctgaggcacaagaattacttgaacctgggaggcggaggttgcagtgagctgatatcgcatcctgcacttcactccagcctgggcgacagagcaagactctgtctcaaaaaaaaaaaaaaaaaaaaaagaaaaagaaaaaaaagaaaaactgaggagggttatgtaagttattttgaaacaattatcctttgctacaaagatcaataccggcagaagtatttttttgttaagatacagtagccttggtgcaaggttgtggtttctgccatcttttgtgatagttgtttttatcaggcatgcatgcataagaaacccccttcacggccttccctggctccatttgtcagggtttttgtttgtttgtttgttttttggttttttgttgttattgttgttgtttgtttttgagacaggatctccctgtgtcattcaggctggagtgcagtggcgtgatctccactcgctgcaacctccgcctcctgggttccagcgattttcgtgcctcagcctcctgagtagctgggattacaggcagctgccaccatgcccggctatagtagagacggggttttgccacgttggccaggctggtcttgaactcctggcctcatgtgatctgcctgcctcagtctcccaaagtgctgggattacaggcatgagccaccatgcccggcccatttgtcagggttttgacacaagttactccattttgattctgacaactttcacaaacgtgaactttttttaagattttgctttttcactcagcacaatgcccttgatatccatccaagttgctgtgtgtttcaatggttaattctttttccttgctgaatagtattccacgatatgcttgtgccacagtttgttttaccatgcacccattaaaagatattttgtttgcttcctgttttgactattacatataaagctgcgaggaataattatgtacaggttttgtgtggacatgtatttttgtatctctatgataaatgctcaggagtgcaattgctgggctatatgtttggtgcttgtttagtttttaagaagttgtcgaactattttccagaggaagtgtatcattttacattctcatcggagtttctctgcatccttgcttgcattttgcattgccacaatttttatttcagctgttctaataggtatgtagtgacatctcattggggctttaatttgcacttcccttatgggtggacatcttttcatgtgcttattttccatctttatatcttcttcagtgaagtgttgttcaggtctttcacctattttctagttggattatttgtttgttttactgttgagattcaagagttcttcgtatttcccagataggagtcctttggcatatatatggtttataaatattttctcccagtcagtagcttgccttttcatcctcttctcaggctcttccacagagaaaagctatttaattttgctgaagtccagtttatggattttttcatttatggagtcatgtctaagaattcttcactgagtcctgggtctcaaagatttagggtttttttttttcctctatctcttataacttttacagttttctatttcatatttaaatcttgattttttttttctgagacagggtctctgctttgtcacccaggctggagtgcagtggtgtgatcatggcttactgcagcctccacctcctgggctcaagtgatcctccctccttggcctcccaagtagctgggactacaggagtgtgccagcacttgctgtggacctattggactgaacaaaggggggcaaaagcgggaataaaagacgagacaaaagagtatatttggaagaaggggtcagggggcaccttgcctctagtggacaagggccctgagctttacacagccctccgtatttattaggcaaaagagatagtgagaaagcggggatgattgtcgggtaattgtcagttagccgtttggtgtttggttcacagcaggcttgtgagactgcatcctttgaacaataggtgctagatttctcaatagataacttcaaggagccagggagtagcgtccctcagcaaactttttggtggcagggcagtgtgagtttgctcacatcttgcattcgtgatgaacactttgctgtttgatcatatagcctccagtggaatgttgagttggtcacgtctcacgggctttggctctctgcatgcctgggtaatttttttttttattttgagacagagtctcaccatgttgctcaggctggtcttgaactcctggccttaaacaatcctcctgccttggcctcccaaagtgctgggattacaggtgtgagccactgtgcccatgcttgattcgttttaaatttttcgtataaggtgtgagaggttttagccaagttttttgttgttgtttttgttgttggactatggacgtccaattgctctagcaccactagtggaaaacattagtcatccttcattgtacctttgtcaaagtcagttggctgcaattacgtggggctatctggtttccctcttctgttccattgatccatgtgtttcttcttctgccaataccacacagccttgattactgtagttatacataaatactgaaattgggtagagggtggtagtctctcccactttattatttcatttcaaaattgttttatctattctagttcctttgcatttccacatacattttaggataatatctatatctacaaaaagccggctgggattctgataacaattgtgttaaatctgcatatcagtttcgggcaaattgacatctttactatgtgaagtacagtcacatatcacttaatgacaggggtagttctgagaaatgtgttgttaagtgatttcgttgttgtgtgaacatcatagagggcacttatgcaaacctagatggtacagcctactatacacctaggctggatggtatagcctatccctcctatactacaaacctgtcaggcatgtgactgtaccgaataccataggcaactgtaacataatggtatttgtgtagctaaacatatctaaacatagaagaggtaccgtgaaaataatatgatctttgccaggcgcagtggctcatgtctgtaatcccaacactttgggagaccaaggtgggcagatcacctgaggtcaggagttcgagactagcctggccaacatggtgaaaccctgtttctactaaaaatacaaaaattagccgggtgtggtggcgcatgcctgtaattccagccacttgggaggctgaggtgggagaatcccttgaacctgacaggcagaggttgcagtgagccgagatcgcatcactgcactcctggctgggcaacagagtgagacgccattagaaaccaggccacccagcaggaggagagtggtgggcaagcacgtgaagcttcctctgtatttatagcccctccccatgacttgcattaccgccttatctccatctcccatcagatcagcagcggcattagattctcataggagcatgaatcctattgtgaactgcgcatacgagggatcgaggttgcacgctccttatgagaatccagtacctgatgatctgtcactgttccccatcacccccagatgggactgtctagttgtaggaaaacaagctcagggctcccactgattctacattacagggagttgtataattatttcattatatattacaaagtaataataatagaaataaagtgcacaataaatgtaatgtgcttgaatcatcctgaaaccatccccccacccacccagtccgtggaaaaattgtcttccacaaaactggtccctcttgccaaaaaggttggggacctctgctgtatatcactgtagtcttataaacactgtacacttaagctaacctaaatttatttaaaatgttctctttcttcaataataaattaaccttagcttactgtgactttttacttcataaactttaatttttttttttttgaggcagggtcttgctgcccaggctggaatgcagtggcgagatcttggctcactgcagcctgcacctcccaggttcaagtgattctcctgcctcagccccccaagtagctgggactacaggcagctgccaccacgcctggctaatttttgtattagagatggggtttcaccatgttggctaggctggtctcgaactcctgagctccggtaatctgcccacctcggcctcccaaagtgctgggattacaggcatgagccaccgcacccagcctataaacttaaaaaaaattttttttaactttttgactcttttgtaataactcttagcttaaaacacaagcacattgtacagctgtacaaaaatattttctctttatttccttattctataagcttttatctatttaaaagtttttaaattgctttttactttttaaactttttttgtgaaaaactaagacacgaacacacttattagcctagacccacacagagttggtgtctgccacctccacatcttgtcccactggaagatctttggggcaaaaacatgcatgtagctgtcatctcctatgagaacaatgtcttcttctggaatacctcccaaaggacctgcctgaggctgttttacaattaactggtttttgtttgtttgtttgtttgtttgttttttgtttgagaggagtcttgctctgttgcccaggctggagtgcaatggggcggtctcggctccctgcaacctctgcctcccgggttcaagggattctcctgtctcagcctcccgagtagctgggattacaggtgcatgccgccatgcctggctaattttttgtactttagtagagacagggtttcaccaaattgcccaggctagtctcaaactcctgagctcaggcaatccacctgccttggcctcccaaagtgctgggattacaggtgtgagccacaacacccggccttaactggttatatatatatatatatggaatatactatgaaataactataaaaagtatggtatagtaagtccataaactactaacatagtcatttattgtcattgtcaaggattatgtgctgtacataattgcatatgctacactttacacaactggcagctcagtaggttttttacatcagtatcaccacaaacgtgagcaatgagctgtgctgcaatgttatgatggttggacatcacgaggcaataggaacttttcagctccactataatcttatgggaccacgatcatatatgcagtctgtttttgaccaaaacgttgttgtacgctgtatgactgtattctaatgcaggaacatagtatgtctcttcatttatacattttaaaatttatttcaccagcattttgtagttttcactatacaagttctgtatgtgttttgttagatttaggcctaagtaaaaaaaaaattttttagaagtcagggtcttgcttgctctattacccaggcgggagtgcagtggcatgatcacgcctcaatgcagcctcaacttcctgggctcaagtgatcctcccacctcagcctccagagtagctgagactacagtcatgtgccaccacccctggctaatttttaaatgttttgtagagacagggtcttgctctgttacccaagctggtctagaactcctggactcaagcgatcctcctgccttggcccccatagtattgggattacaggcgtgagcccccacacccagtttctggatctaatttagatcttgtattttctcagggttcctctgacatcactctagggaaggaaggaggatgggcagctcgttacggccaggcaggggtggaggaagtttgggttctatgctatacctcctggagggtgagggtctcctttttactgctagacacgtgggagttctagctcccactaggcctcctctgacactaccccaggagggagggggagatgagccttaatcagccgtgagggtggaagtccaggctctctactcagtccttcctggtgggcttgcaggcggagccacggtgttttttgtggtgttttgttagaattgagtggttattgtctagaagtttttggaccaggtgtggtggctcacgcctgtaatcccagcactttgggaggcccagatgggcggatcataaggtcaggagtttgagaccagcctggccaatatggtgaaaccccatctctactaaaaacacaaaaattagccgggcctggtggcgggcacctgtagtcccagctactcaggagactgaggcaagagaaccgcttgaacccaagaggcggaggttgcagtgagctgagatcacgccattgcactccagcctgggcaacagagtgagactccatctcaaaaaaaaaaaagaaaaaaaaaagaagtttgtagtcttgctatgctgcccctttcctggtctcataactagagagtacaagctcctcttagttttttatgtgtttttttgagatggagtcttgctctgttgcccaggctggagtgcagtggtgtaatctcagctctctgcaacctctgcctcctgggtttaagccattgtcctgcctcagactcccgaatagctaagattacaggtgagcgccaccatgcccagctaatttttgtgtttttagtagagacagggtttcgccatgttggccaggctggtctcgaaatcctgacctcagatgatctgcttgctttggcttcccaaagtgctgggattacagatgtgagtcaccacgcctggcctcttcttggtttttgctttgttttgtccacgctattggcatttttagagtgctgcttctctagttcccagtcagagggaaatgaggcagaaagaaacccattgccatgttgtttcttgggtctggagatcctgacccaattggccttcctctctctgcctttctgagaggttttcagcagtactcagcaggacaaatacggaaaacatgacatctcaatctttccagaagagatctccattttgaaattcaacctgggaacaatttcaaaagacatcccgttggtatttctgaacatcttgccagtttttcataagttctaggagatggtgtggttattttttatagcaacaagcatatgaaatcggggtaggactttttgccttgccagtctgtaaataaatatctgcttaggattgaaatttgcggagcagtaacacaaatacttcactaacatgtaaaagaaagcctggcagctcacgcacagatcggttcttggttcctaacagatggaagcagtggggataccttcacaatcctggagtcataacactgcattccaaggaaaccatcggatctcgaatctcagtaaccctcaagacgaaaataagtgctgctgaattgaaactagagctatgattgggatatggctaatattttatggtttagtgattcatgcttaagattcatgcttttttagctaatgtagaaaataaagaaaatagttcttaaagaccaatacaaatatttggtaagaggaaacaaatttcaaataatctctagaggaagttcatccttgctgttacctctcttgtggatgagtttgttaaaattattattactattattattataattttttttagatggagtctcactctgtcacccaggctggagtgcagtggcgcaatctcagctcactgcaacctccacctcccaggttcaggcgattctctgcctcagcctcccgagtagctgggattacaggcgcccaccaccacgcccagctaatttttttggtatttttagtagagacggggtttcaccatcttggccaggctggtcttgaactcctgaccttgtgatccaccggcctcagcctcccaaagtgctgggattacaggcatgagccactgcacccggcctgtttttgttttgttttgttttgttttgttttgttttgttttgttttttgagacagagtttcgctgttgtcacccaggctggagtgcaatggcgccatctcaagtcactgcaatctctgtctcctgggttcaagcaattgtcctgcctcagcctcctgagtagctgggattacaggcacctgccaccacgcccggctaatttttgtatttttagtagggatggggttttgctatgttggccacgctggtcttgaactcctgacctcaagtgatctgcccacctcggccttccaaagtgctggggttacaggcatgagccaccacgcctggctgagtttgttaaaattaaaggggagaatgtttgctgcttagagatgttctgcagctataatttatggaaaataagtgttaaatgattcaaatagacaacaaaatatacgtatcttaaaattttttttttagcatttatgagaccagtacaaactactcaagaggaagatggctgtagctgccgatttccagaagaagaagaaggaggatgtgaactgtgaaatggaagtcaatagggctgttgggactttcttgaaaagaagcaaggaaatatgagtcatccgctatcacagctttcaaaagcaagaacaccatcctacataatacccaggattcccccaacacacgttcttttctaaatgccaatgagttggcctttaaaaatgcaccactttttttttttttttgacagggtctcactctgtcacccaggctggagtgcagtggcaccaccatggctctctgcagccttgacctctgggagctcaagtgatcctcctgcctcagtctcctgagtagctggaactacaaggaagggccaccacacctgactaacttttttgttttttgtttggtaaagatggcatttcaccatgttgtacaggctggtctcaaactcctaggttcactttggcctcccaaagtgctgggattacagacatgaactgccaggcccggccaaaataatgcaccacttttaacagaacagacagatgaggacagagctggtgataaaaaaaaaaaaaaaaaagcattttctagataccacttaacaggtttgagctagtttttttgaaatccaaagaaaattatagtttaaattcaattacatagtccagtggtccaactataattataatcaaaatcaatgcaggtttgttttttggtgctaatatgacatatgacaataagccacgaggtgcagtaagtacccgactaaagtttccgtgggttctgtcatgtaacacgacatgctccaccgtcaggggggagtatgagcagagtgcctgagtttagggtcaaggacaaaaaacctcaggcctggaggaagttttggaaagagttcaagtgtctgtatatcctatggtcttctccatcctcacaccttctgcctttgtcctgctcccttttaagccaggttacattctaaaaattcttaacttttaacataatattttataccaaagccaataaatgaactgcatatgataggtatgaagtacagtgagaaaattaacacctgtgagctcattgtcctaccacagcactagagtgggggccgccaaactcccatggccaaacctggtgcaccatttgcctttgtttgtctgttggtttgcttgagacagtcttgctctgttgcccaggctggaatggagtggctattcacaggcacaatcatagcacactttagccttaaactcctgggctcaagtgatccacccgcctcagtctcccaagtagctgggattacaggtgcaaacctggcatgcctgccattgtttggcttatgatctaaggatagctttttaaattttattcattttatttttttttgagacagtgtctcactctgtctcccaggctggagtacagtggtacaatcttggatcaccgcctcccagtttcaagtgatctccctgcctcagcctcctaagtagctgggactacaggtatgtgccaccacgcctggctaatttttatatttttagtagagacggggtttcaccatgttgtccaggctggtctcaaactcctgacctcaggtgatctgcccacctctgcctcccaaagtgctgggattacaggcatgagccaccatgcctggccatttcttacacttttgtatgacatgcctattgcaagcttgcgtgcctctgtcccatgttattttactctgggatttaggtggagggagcagcttctatttggaacattggccatcgcatggcaaatgggtatctgtcacttctgctcctatttagttggttctactataacctttagagcaaatcctgcagccaagccaggcatcaatagggcagaaaagtatattctgtaaataggggtgaggagaagatatttctgaacaatagtctactgcagtaccaaattgcttttcaaagtggctgttctaatgtactcccgtcagtcatataagtgtcatgtaagtatcccattgatccacatccttgctaccctctggtactatcaggtgcccttaattttgccaagccagtgggtatagaatgagatctcactgtggtcttagtttgcatttgcttggttactgatgagcaccttgtcaaatatttatataccatttgtgtttatttttttaaataaaatgcttgctcatgcttttttgcccatttgcaaaaaaacttggggccgggtgcagtggctcatgcctgtagtcccagctctttgggaggccaaggtgggcagatcgcttgagcccaggagttcgagaccagccttggcaacatggcgaaaccctgtctttacaaaaaatacaaaaattagccgggtgtggtggtgtgcacctgaagtcccagctactcagtaggttcgctttgagcctgggaggcagaggttgcagtgagctgggaccgcatcactacacttcagcctgggcaacagagaaaaaccttttctcagaaacaaacaaacccaaatgtggttgtttgtcctgattcctaaaaggtctttatgtattctagataataatctt

SEQ ID NO: 13392 - DNA, 9900 bp, Human
caggttgaagctatcctcctgcctcagcctccggagtagctgtgactacaggggcccgccaccacgcctggctaattcttttatcttctgtagagacagggtttcaccatgttggccaggcttgtctcaaactcttgacctcaggtgatctgcccgcctcagcctcccaaaatgctgggattataggcgtgagccaccgcgccttgctcggctttttcattttcttaccagtatcttgagcaaatgtttctaattttgataaagtccaatttatcagttttgttcatctattgattaatttacaaaaatggtatctatggtatacatcatgacttgtttgtttgttttgagaaggagttttgctcttgccacccaggctggagtgcagtggtgtgattttggctcactgcaacctctgcctcccaggttcaagcaattctcctgcctcagcctcccaagtagctgggactacaggcacctgccaccacgcccagctaatttttgtatttttagtggagacggggtttcaccacattggccaggctggtcttgagctcctgacctcaggtgatccacctgcctcggcctcccaaagtgctgggattacaggtgtgagccactgtgcctggccatgattattattattattattattgttattagtttgatgttttgatatatgcatacattgtggaatggctgaatcaagctaattcgcatgtgtattacttcacgtttttagcatttttttgtgatgagaacacaaaatcgatttttagaaatcttcaactatacattgttattaatcagagtcaccctgaggtacatagatctcttgaacttattcctcctgtctcaatttttttcctgtgtgatttgtgtcttgtctaagaaatatttgcctaacctgaggttgtgaaggtgttcatgttttttcccctagtagttctatcattacgttgtaaccacttttttttctttcttcttttttttttttttttgagacatggtctcgctctgtcacccaggctggagtgcagtgggacgatcttggctcactgcagcctcaacttcccaggctcaagtgatacaggcatgcaccaccacacctggttaattgttgtatttttggtagagacagtgtttctccttctctttttttttttttttagacagagtctcgctctgtcacccaggctggactgctgtggcgcaatcttggctcactgcaccctccgcctcctggattcaagcaattctcctgcctcagcctcctgagtagctgggattacaggcacgtgccaccatgcctggctaatttttgtatttttagtagagacggggtttcaccatgttggtcaggctggtctcaaactcctgacctcgtgatccatccgcctcagcctcccaaagtgctgggattacaggcgtgagccactgcacccggccgagacagtgtttctctatgttgcccaggctggtcttgaaatcctaaactcaagtgatcctcctgcctcggcctctcaaagtgctgaaattacaggcatgagccaccgtgcctggcctatctttgtaacttttgtgtttaggtccacagaaagttttgagcaaagaactaccatgatctgacttatgcagatgcttctggcatcactctgctgtgctgagcctgtggcaggcccgaaggcagacttcaggacgcctgtcggggacctttccacccatccgggcttggaccagcttgggcagagtacagttgggagtagaggccacattctggaaatgtttatcagcgagttttctggtgttaagtccttcctccctccttgctgaataataatcaactttatgaagttatttcctttctctgaagattgaagtgcttgcggcttcacatgaggccacgtgtatgtacagaattgtcttgagcctggagcaatgtttgctatgtattttaacttttcactgttttaaaggaaatagctggttttacgttttaatccacagattgtcattcttcagggatggcagccctaaacacagcatggcaactcatctactcactcatgaaagattaaaaaatggaaaccaacgtatttcatcttatgctctgcgtcacttctgctcggactcataaatccacgtctctttgctttggccacttcaactcatatccaagccttcctttaattcatgatttattgctgtaagttgcctcttttgccagatttataaactcactgttctttatataatacctactttgtacactaggcaacaagacagttaatttattgtctatgacttgttaccttgaaaaattacatcaatgcaaagtgattgccttttagcctccatagccaataaattcattttttttttttttttggagaggatgatgtcaggtcataggatgatatatataatcagtgagcaggcagaatgaggagacagttgaaagttctctacaacagaagccaagaaggaagccgtctatcttgtggcgatcatgtataagctggcctcctgctgtttgcttttcataggattcttaaatcctctcttatctcttcctctccttgactccagggaaatatcctttcaactctcaggtaagattttttttttccccttatgttagtcttgaaagagcctttactagtcttaaattcaatgttagagataagaatgggattcctgctcgaaggagtctggagtcttgttctctcaatagtcccagctttgaaaagaatattaaaggatccttactgcacattttagatgtagtaatggatacagttttttttctgtctctacaatgtaaaaggagaagaggataattgcttgtttcatgttacctctgtactcttgttttgggtaatatatacatttttccaattttaaaaattgcatgaaatttaaaacatcattacttttagtttttactttaaatgaactggttgaatgtagcactggttgttctaattatagattattaatggatttatttgtttcaccttttgtttaaaaaaatcatctgatatgtgttctacgaaacaaaaatgtttactaaaaattttttagtaaatgacaaactagggaactagggagttcatagacttccaagtatattgatcgtttccttttgatttatgttaattcagtttaagtctaagttgagttaaagaaatacacatcagtcaagtagtttctcattttgccattatctttccatttagttagagaaatgagaaagctaatgcttggggattaggttccatcaaaaacttaactagatttaatcttatctttaatcttgagtactttttaaataggctttttttaaataaagaaaaaaaacaaacaaaccctcttttaagccaaggattttatagtttctcgtctctaaaagttcatcccaagcagctttctgatgatcgtcaagcactgtcatcaggcactgccaaccaacttcccgagtcaccgagatgatcattggctgtcctactaatagttaaacactggcattaactttactgaatctctgctatttacaaagaaacagcacacatctcaagatgaaataagtgaaaatactcagctactactgtcatcttaaaaaattttacaagtaatttaagaaacatagatgaaatgagtgtagcatctcacacaaattcgaaacaagtggcagcttatcgcagaatttgttctcatttatttctccagaaatgtgctttcctatcagcatttacagatgatgaaattttatagattttcattaacagtctttagaagtgctgtgaatgtgctctgatgcctttatgatgatctgctcactgtcctccaatcaaggttgcagctatttgtaagcctgtggcacgctggtcccacacatggcctcccaccctgactcccacagcctcgaatcgcaacacagcagcaggtctgcacttaccacgcctcacactccggtgtgccctttccacacaccttaagcgcacttaccatgcattctatatgccatctggtcgaccacatttcacataggaaatgccacaatcaagttccttacagatgattttgaagccaattctaagtataataattgtattgaaatcttgaagttcagtaaaagaagaggtgataccatcctactggctttataggaagattgtaaacgatctttctttttcctctccaatgtcaccacccaaatatctaaaagcaaaaaggcagtaggcagcagtagataagcagaaatgagggagagtcagactttttgaaccaaaatggttttgagaaaggctgtggcttatccctcagctctcgttcgaggcagccgaggggcttggctcatcacgcgggtgtcagatccacgtctcccggcttcccattctgctggctggcacacgggctggtagcatttccacctcttctagaataccactgatgacacgtcatgaactcagcgttggaagtttttctagtgttcatctccctatctctggtgctcgccaaagacacaaggaacagaaataactaactgaaggatgaacccaattctaagtatctgtttttactctgtagcacctcatgaagacgcgcgcttaactccggaggagctagaaagagcttcccttctacagatactgccagagatgctgggtgcagaaagaggggatattctcaggaaagcaggtaaaatgcttctcatgtttatagcgtgtctgatttaattgctactgaacttaccgtctgtcctcatctagaagaggtaaagctctattttggaatataaagatgagctatataaaataagtaattaccaacactctcccctcccggcctgtgcaaccttcttttccccagcagctccttgctcgcactgtgctctttggtacctcagcattttgtctttctgtgtggacttttatttttgcggggtagagcttggtggtaattattccagtttccagtgagtgcaatttaaaatcctagtttcccgtttactgaaaacttaaagtaatctttctgtactccagtttcttaatctgtaatcaggaatgattaagtttccacctcagaaggtaacttgtgaagagtcaatgagtcaaggcaagtaaaatgctcgagtcacacagaaagtcattaataaaatgtcagcttattcccccgtggccacattcccccaagcattgacacatatgctcaggaagttctggaaacaaaattgagccttttgctgggtgcggtggctcacacctgtaatcccagcactttgggaggctgaggtgggcggatcacttgaagtcaggagtttaggaccagcctggccaacatggtgaaaacccatctcgactaaaaatacaaatatcagccgggcatggtggcgggcacctgtaatcccagctactagggaggctgaggcaggagaattgcttgaacccaggaggcagaggttgtggtgagccaagatctcaccactgcactccagcctgggcaacagagcaagactctgtctcaaaaaaaaaaaaaaaaaatttgagccttttaagataggtattgtttaatagacaggagttcatttgttataaaatatctttgacgagctactggactgcgaagttactgaggacaatgcagtgacttctgtgaattcgagataagaacaggagtgcctgtctgtctgcattcaagaaaagcttgctgcagtgtggaaaaagaccagaaactagacataatttagtaatattattttgtatattttaaaacaagcatacaagagaaacaacagatctgatgaactggcttcaaaactgtttttcagactcaagtaccaacatttttaacccaagaggaaatttgagaaaggtaagtgactctatttatgagttaggtttaaaaaggtgaacattctgtactggttttacaggactctgaattcatgaactagaggagtgttcttggtggaaaccacaccttaaaataattggccagcatgaccaggcgcggtagctcatgcctgtgatcccagcactttgggaggccgaggcgggcggaccacctgaggtcagaagttcgagaccagcctggccaacatggtgaaaccctgtctctactaaaaatacaaaaattagctgggcgtggtggcacctgtaatcccagctactcgggagactgaggcaggagaatcgcttgaacccgggaggcagaggttgcagtgagctgagatcgcgccactgcactccagcctgggggacaagaatgagacttcatctcaaaataataataataataattggccagcattatttcaaagcattaatttttccaaattttgattgatataagatctgaatgcaacaggaacctacccagtgcctgttttgggtaaatcaaataagttgtgaaagaatgaaaaaaatgggtgaggtccctgctctccagtctggcatccacttgtgctctcattcaccatctaacatgcggcccaccgccagcagcaccgggagcacctggaagccagtgagggatgcaggatcttaggcccacctaggacctgcggaagcaaaatctgcatcttaacaagatccccaggtgattcacatgcatgggaaagtgtgaagggcactgcaagacaacatctaatggaggaaggccatgctccagacattgacctgaacgatgtacagaaggccgggtgcggtggctcacacttgtcatcccagcacgggaggccgaggtaggcggattgcttgaggccaggagttcaagaccagcctgggcaacacagcgaaaccccgtctctacaaaaaatacaaaacttagccaggcgtggtggcatgcacctgtaatcccagctattcgggaggctggtgcaggaggatcacttgaacctggaggcgggggttgcagtgagaggagatcgcactacttcactccagcccggggaacagagcaaaactccatctcaaaagaatacaatacaatacaatacagtatacacaatacatacaatacacagaagacaatacatgcacagaacatgttactatttatttatttatttattgagacagggtcttgctctgttacccaggctggagtgcagtggtgtgatcttggctcactgcaacatccacctcccaggttcaagcaattctaatgcctcagcctcccgagtagctgggactacaggagcccgccaccacacccagctaatttttgtagagacgaggtttcatcatgttgcccaggctggtctcaaactcttaggctcaagtgatctgcccacctcagcctcctaaagtgctaggattataggcatgagccacctgcccagccgctgaaatgatttaaatagaaatcggtcaatgagggtttaggaaaattcaggacaatcgctgggctgaacagactggaaggacactcattagaggtagggaggtgggcacaggagccccacgggcccgggacactcttgttacaattatagtccagggaaaaatgcaaatacttttaagaagtccagtgtcttgactcaagattcctttttcttataggaatcgtcactcgttggtaacttatctgtttttttttgttgttgttgttcgtttggattgttttagtttcaggatttctctggacaagatcctaacattttactgagtcatcttttggccagaatctggaaaccatacaagaaacgtgagactcctgattgcttctggaaatactgtgtctgaagtgaaataagcatctgttagtcagctcagaaacacccatcttagaatatgaaaaataacacaatgcttgatttgaaaacagtgtggagaaaaactaggcaaactacaccctgttcattgttacctggaaaataaatcctctatgttttgcacatatcatgagtggttattttccctataaacatgtcctgaaaatttataattattcttttcttccatttatccttagaaaattctttgacatttcagaagcaaagctaatgaatgaacagaagcaaacactaagaaaaagtcacaaaagttaaacttttgttaaatggcaaatcatttaaataaactacattatcttagctatgatgtcctctcaaccttttaaaaagacaacatattacttttaaaaaataaatcacagccaggcacagtagctcacgcctgtaatcctagccctttgggaagctgaaatgggtggatcacttgagaccaggagtttgagatcatcctggggacatgacaaaaccctgtctctaccaaaaatacaaaaattagcagggcatggtggcaggtgcctgtagtcccaactgctcaggaggctgaggcacgagaatcgctcagacctttggggtggagcttgcagtgagccgagatcggaccactacactccagcctgggcaacagaggaagagtgtcttgaaaataaacaataaaataaataaaataaaaaataaaataaaacaaaataaaaagaaaacagtatcttggcttggaaaaaatctctagttacgggtgtctgagatgaagggcgggagtgtctgatgctccttggtttctgaagttcgtgggggaagttcatgtgctgagattctttctcttggctgaccaaagtcctgaacacttgacaattttaatcttttaacattgaaacttgtatgatctcagcgtctgtgagctcaaggatcacagtttcttacaccgggaaaaacaccttgatgtctcttgcagagagaagaaagctgaggcaagatttaagattgtggaagaaagagcctggcttacgaatttttaaaaactatgtgtgtaagtactgacttctattccgtgaatacatctgtataaatgtggtttatgtatgtatagaatatacagtgtgaactcctgagagttctgtgtggttctacacagaaccatgtataggggaggcctggatgtttatgagaaacttgtttctctcattgagctctgacatcccaccacattccagaggggtctgcaacaaccaaagagcaacacacgacttgtgtcaatcttgtcactgaccatcacaagtttcctagagagtacaggtctcagagagtttaccctaaagacatcaagaacttggccgggtggggtggctcaagcctgcaatcccagcactttgggaggctgaggcgggtggatcacgaggtcaggagatcgagaccatcctggctaacatggtgaaacctcgtctctactaaaaatacaaaaaaattagccgggcatggtggcgggcttgtagtcccagctactcgggaggctgaggcaggagaatagcgtgaacccaggaggtggagcttgcagtgagcggagattgcaccactgccctccagcctggcaacagagcgaggctccgtctcaaaaaaaaaaaaaaaaaaaaaagacatcaagaacaaatctaagggagagatgttttaaactggaatgaatgtgcaagctcagaaacatgctaacattgaggacagctatgataacactgtggtgtgtctctcagtgttgaaattaaaccagttctctggaacacaatgttggcaccataaaactattcctgtatcagagataacttaaaagtggaattccactgcagaattctgaagtccctactcattttagtgtatcaggtgatgattcatacagattggggctttgcatcaggtttctagggtcagattcctactcccagtgcacaccagctgtgagtctctgatccagttacttgactccccctgcctcagtttacttctctgtaaaatgacaataacacaatgcttatttcacagggcagttgtgaggattaaataattcacatcaagcacttagaccagcacctgtcagagtagtatacacgcaaagtata

SEQ ID NO: 13393 - DNA, 94884 bp, Human
  misc_feature (1)...(94884): n = A,T,C or G
aaaatgtgttcagtagtataatgtggttaaggaggggctgtctttataaaagatgttcattaccatcttgactggcttcctccccctccccgccacataactaaagcatgatgctattgagttctaagtctagtttccacccttatatgaaaagtcagcttggcacagagtttggtagagctaagtctgaccagctgcactctcagccacaagggaaattagacgagacagtgtggctgcttcagtaccaatcaatcaaagtttttgaaaattatcttgaaaacacacaccaataaaggcatgtgtgtagttgtcttttcatataaactcaggttagtcctagtgcatgtgaacaaagaaagtaaggtgtcttcttcaggttgactacttggtagttcctatttctctatcagttccatgagcgttttgggagaaagtgaccacatctactacagtctttcaacatcttaagttagatttgtgtaccctccaattgaatcacttgaatcaaaacaatagctactagtctatttgactttctttgcccaggccccatatatatctttttattttatttttattttttgtagagacagggtcttggtttgttacccaggctggtctccaactcctggcttcaagtgatcttcccaccttggcctcccaaaatgctgggattataggccccagcactgcacccagcctccatatatatttttaagtgtataatccagtggtttttaatatattcacaaagttgtacaaccatcaccactatctaatgccagaacattttcatcatgaccaaaagaaaccccatatgcactggcagtcactcccaattccacctcccttaggccactggcaaacactgatatactttctcaccatatggatttgcctgtcctagatatttcatataagtggaattgtacaatgtgtgttctattattttttattattattattattaatttgagatggagtttcgctcttgttgcataggctggagtgcaatggtacaatctcggctcaccacaacctccgcctcctgggttcaagtgattctcctgtctcagcctcccgagtagctgggattacaggcatgcaccaccatgcccagctaattttgtatttttagtagagacggggtttctttatgttgttcaggctggtctcgaactcctgacctcaggagatccacccccctcagcctcccaaagtgctgggattgcaggcatgagcccagcagtgatctattattttatagtctacgtttgtatgtctgactgacttctttcacttagtgtaatgttctcaagcttcatccacgttgtagcatgtgtcattgcctcattcttttatatgtcctataattttgaaaaatgatgtttttggaaaaaaatgcaaacgcagagtatcccctaatagaaatctttgctattcttagagaagaacatgagacaagttatttaacctagagatttggcttgaaaaattaatattgacatatcaatgaggaataagaaaaaatataaatgcaataattaaggactgatgaaaatgaaaagctaattggagcataaaagtgatcatctgaatacaaagacttttctgcctaatcttagtgaaaattaaggtataggttggattggcatattatgatttttaatttgtttttttaatcatccagcaaactttttgcactcctgagtcagcacatgcatctgtcagagagagaagagcaagacggagcacgaggctgcagctgaatttagaaagttagaggtgttctcatcagccacatgagatgggcaggagattccttccagtaggcgagagagcagagtgcagacaacagatgtgagaaaggtccccatagctgtcaagttcctgcatccttgtgctgaagaaagggaggtgccatcatgattgatgttcagaggcagtataaaagcactgggtttctccccaactgcttgtcacaccgacctgcaccatctctcgcctgcctgtggggtttctgtcaactagtcgtggagggaaggagactctttaaagaataacatcttattgtggccatgccagaacccactaagaaagagggtaagacttatctagaaatctttttgttgtactcctgaataaagtgtttattttggtatttatcttcaaacaaataacaaatatcttaactagatgagaaaataaaatcactatgatttaaggaaacgatcttttagattaaacagaccagaggaaaaatacagcgagagtatattgaattgaaaaatttctgataacgatagtttctaaagggatattgactaaaattatcaaatgataattctatcattcaattgtaaagaatccttaaagtgtaatttaaggatgttaattgctgatggtaaacagattacgttttcaagcatattttcttagatttaatcacaaattttttaccatgtatttgcaatttgcagagagtaggagacttaaaatattttctcaaatggttaatacattggatcaagatttcaaaaaagaatttgtgacattatttccatatttgctactttttttaatggaaacatatttaaaatatacagacgaagggttttttttgttcttatcagtgcctttggaggttcgttattaaattcttgcatggaaagaaaaccaaacacctgataaaaaaggatgtccctgaatatcatgaatagattgttctttcatgagttttattgtagagaatttcataatatgtagtaggctttaagaatagttaagctgaaagtataaaaatattcttccttagaagaaatgttttccctaacaaagtttctcctttctataaaaaaattagtgtattaaagctaccaattggtaacagaagtaaattggaattagtagttatgaaaataaataataataagcacaaattaatactatgcatgcattgaatttaatttttaattaaaatatcttttaaaaatattatttcatttatattcatcttcattaatgcttactgaatctttatttttcccttctgcaaataaaagaaaaagaaagattagcaggaaacataaaaatagtcatagttttcagtttttaattcttaaaaatgctttagctattattttaaggaaccttgaaaaagatgttgaaatactaaccaaattatcaaaagtcttttaaacatattttctttatataattaagtaaccagtgttgacaggctgtggtgatcagtttacaggttggccttacttagtggcagagggcattgatggatgaagtctttcacccaaaataaccacaccaaatgcatgtattaatatgggaacttaatcctgactgtcaggcagggagtccaacccctgctaaagtatcttatttgtaatgcaaatgatttacgtgtgtactaagtgtcctttttatctgctctgtcactttaacctctccgaagtgtacccagaagcaatacattctaccatgtttccaaactggaaacacaatattgttttaattattctgaatttagtgaatgattttgcatttgtttttttaaagcctaattgaaaatgagaagaaagctgaaaaaccaataaataaggtgacagcctgtaagagccaataaagctaattaaattattctgatcgcaaaggcgatgaagtttacttttcatttgacaactcagtctgattcactcttttatggggaatgaaattatagagctgcaaagaggaaaatatatctttaacttcagcccccacccccccaatatatatttttttctttctgaataaaacagcatggatgctaaagactccatcatcttcttttgctataaaagcatgttgctattctgtgtaggagttcctccacccaggacagtaattttatacccataaattctttggttagtgtaaatttggatgatggggattggggcaagaagagttactgatatatttaaaatccattgaggaagtacagagatttttttggttcccttaccagcagaactgattcttaaaggaactgtaccttgaaaagctttccttagtgaaataattgcattttaatattgtttacattagaagagtaaggagtacggcaattcatgaactattctggtcctttcttcttctcctaactgtgatttcattttcactggggttagtttgattgcatataagcatccctctgaaaaataaaacatggcctagagccagttcttcagaatcatttcaaaatacctgcagaaaccctcccaaagaacaggctcctccagcccatatgggtcttctgaactcttccccacagctcgtaaagccatgcccaggaaggccatgaccacttgctgtgaatcttaataggacacatgagctggtttggccctcctaggatccaggaggatctggcaactcctcaaaagaggctgagttttcagcacctgaaggtacaaaaaatgtctcactcaactacttcccagcctaccgtggcctaattctgggagttttcttcttagatcttgggagagctggttcttctaaggagaaggaggaaggacagatgtaactttggatctcgaagaggaagtctaatggaagtaattagtcaacggtccttgtttagactcttggaatatgctgggtggctcagtgagcccttttggagaaagcaagtattattcttaaggagtaaccacttcccattgttctactttctaccatcatcaattgtatattatgtattctttggagaactatgttatttgtactgtctattccagataaaacttaccttacaccactttggattcttacagaacctaaggcctagtacaattaagttattccgatcaaattgggaggatgttgtaggcagtttcagatttgtggggatctcccaggatgcctttgatacattcatttatatatcaattattaattgagtacaagtaagtgcccgaaagttaattgcccccggttcctactgtgtaaagaaatcacctttctttttttttttttttttttttaagacagtatctcactctgtggcccaggctggagtgcagtgccacagtctccgctcactgcagcctttgcctcccaggttcaagtgattcttgtgcctcagtatctcaagtagctgggattacaggtgcccaccaacacgcccagctaatttttgtatttttagtagagacgaggtttcgccatgttggccaggctggtctcgaaccgctgacctcaggtggtccacctgcctctgcctcccagagtgctgggattacaggcatgagccactgtgcccggccaagaaatcacctttcactggaaatttctcttttccagtcaaaaagaaattttatcaacctcaaactagacaattgcaatagcctttcttccgtggcagaatctctgttcattaaagaatagtatgaatggctgttaaacccataaaaatgatttcctcagaattttacctctggaatatgtaatgattaaaaccataaagcctgattctttaacatcctgcgacaactgttaactggattcctttaattttttatttattttttatctttttgagaaaaggtctcattctgtcacccaggctggaatgcagtggtgcaatcatggctcactgcaaactctgcctcccaggctcaagcaatcctcccacctcagcctccccggtagctaggaccacagatgcatgccatcatgcccagctaatagctgattttgttatttttagtagagatgggggcctcacaatattgcccaggctgttctcgaactcctgggctcaagagatccacttgtctctgtcttctaaagtgctgagactacaggtgtgagccactgtgcctggcctattaactgtcagatactataaaacccagaaaaattctcttctaaaacactgagttgaggccttaacatgaatttcactttttgtttctgatttatcagaccttattatatttaatgtacttaacttgtccgaaaaggcaaaagttcctctttggtgcttgtgtgtcattcgaaaaatctcaagagagtcactgtagttttctcatgttccgtgtaagatctcttcttgaaaactcaaacgtatggccaatcacaggttcctttatgaccataattttaaggtgccattctgataactttaggaagcaaaggcatggctttgttactgcagattattttgctgtgtcaacatacaatattcatcttatccatcttggtctacatttcaataggaatagatgggaccatggtaatagagaacagttttgttgttgttgttgttgttggggtccataagggtttttccatttctgtatcttttttttcttgctctctagagatttcatcacattttaaagttttgccaagccaaaaagctacctgaatgtagagcagcattcatcccctcttgcctatttctaagcatttctcagggcttagtcatccatcagaaaaggacctcccttgatgggaaaactccttctcatatctcttctttgaccttcagtttctacctgcaagagagtgaatggcctatttcaaacaccgaaatcaatttgtctttggaaagtcatcttatatacaaatattatccttacctcaaattggggaaaggttaataatttatgcagaaaactaagagaaaggaataggggaggaggaaagatagtttatcaagggcaattgtttcccttttgacttcaaatggttcatcgaggccaagctgatgatttcaattgaaaataaagaagttgtatgaacgaatgccatcatattttttcctcctgagaaaaaccaccatgctgtgctggagattcatggcatatatttgagctctgtgttgtaagaaggaataccctagggcaaatgcgtgctagaggggcttaatacttggcagaatccttctttttcagtagcctgcttttatgactgctccgactgcacctgttaggaagataaataaaggactggccaattctttcctctgaagcgccctaaatatatcactttaaaaagactttggaaaaacaagttgtatccttacttctcacccagtaaatctaaagaaattccctcttgttcccaggcctttcaaacagtgaagtcaggagtaagggagactgtggactggtcaaaggtggaagttagactcactagctggtctaaggaatccaggagggtggaaaacatgaagaacttacaatcctttatgctctcaatgactcactttattttggccatgagacacagccttgaaacttttttttttttttaggctctgtatacacacacaattcatagagtttcctttttaacagcaatttcaaagtatccccgaatcaaacatgaatgttgaagtcaactacccagactgaagttgcttttaaaaaatgcttggacacaaaaacaaataaataagtggtctctttaaaaacttgaataaatacaaaatgacatttttgcaatacttttgtaaacaaatacattcttcttttcaattttgtatggttgtgagaggagattgctgtgtaattattgctattgtttttacagtccaaggaagcatttttgttacttttatttaaaattattgcaattgttttatttaaaaattatttttaggctgtttgtggacacagagaagaattttgattataattaataatgactatttttatcttcactgctccttaattagtctatgaaaactatattaagagacacaaaatactcttggctgccagtatgttctgtggtaattctaaacttcatctctagacatacttaagtgtgttagatgataaagaacaggattaaagttctagcaatcaaacataagtatggaaattttaatttcatgtgtgtacctgagagcatgtggccacatcttctttgttattattccatgttagttcttgatggaaacagatgtcttttctggaatccatggtttgttcaaagtactgcatcctggggaaactgaataaatacacagaaaggtagtagctgaattagtgttctgagttaggttaatcatgaagtagctactgtttattcatgaggggtttcctaaaatttgagagcataccagttaaggaaagccaaactgtgaaaaagaagaaaagactttgtcacttaattttctacatgtatgcaaattatctcataactggataagaagagggcttctgtccttgcagctttttacaaagacagcccccccaaagtcaaagtgatcatactgtcttgtcgtaattctgctctgtgtggataggctcagttttaatttacaaagagtatgtttgttttagacagcccaaagatggaccacaggccaaatttcaagatgttcccattcatgggacagagtatttatgggctttaacgtacattttcagagtaaacttttaggtcccatcagattggggcatgaattgattgatttggcagaggcggagaccagaatcattcaatctcacacttatttctctttctataatgagttcacaaaaagctaactgtaatctgactttcattatgcctttcaagtctaaatccactttgataagacttgcccttttatactcccttaggaatcctttttaggccaatttggcacatcagggcagcgtctaaaattacatttaataatatgtcaaatgttagatcttatgattttgttctattctttttttttgatgtgtatttagctattttggtaagtattcttcttctctaaaattgtccaaatctttcctaaatactctttataaattgctttgcttgcatctggtgatatcgtttgccttctaaaaattttaatgaatcttggaacagaatgctctacttaaaactcaaaatgtgtcctttttaattctacattttgtcatgtttagagttagatgtctttagggttgttatgcacacagtatgtgtcttggctttttctttatgcatcttaaatattatgcattattaaacatggtgacataaaaaaaattatactatttgtagaacattctagacagctcaaattccagctgcaccatagactgaattacttacactttgtatgcctctgtttcctcatctgtatgtgaataaaacagtatcaactctttgggtctcagtaagaattaactgaaatacaccaggtaaagtgcttattttatcttattttattttttatttgagatggagtcttgctctgtcgcccaggtcagagtgcagtggcatgatctcggctcactgcaaccttcacctccctggttcaagcaattctcctacctcagcctcctgagtagctggggttacaggcatgcgccaccacgcccagctaatttttgtatttttttggtagagatagggtttcaacatattggccaggctggtctcaaactcctgacctcaagtgatccacctgcctcggcctcccaaagtgctgggattacaggcatgagccaccatgcccggacaggtaaagtgcttagaacagggcctaacatatggaaagatttcaagcattttcctcctaaagcagtaaactcagaaatcttgtctggcacaaggtattaaatgcctcatatttcacataaactgatggcatttccctcaacataagggatgtaacaaccactgctcacctcctcactagtgtaatatttataatacacgccaagaaagctgctatgatagtcataaccatcattcccaccactatatttccttcttttacttgtggtgatacatcttcgctttcacccatagaagctcagatcaaataaaaggtctatactccatgacctctgttgtgttcttactgaaatgagccatgtccaattcgggggtctgtagttgtcagcataaggtgataacggttgggttgtttcttcactgttcttgtggggacatggcctttcccacttagatgaaagagttaccctacagagttgaacaatatctatgtctgtctccaagggttataagtcttgggtttgtgggactttacaatttctctccctggccaggcgtggtggctcatgcctataatcccagcactttgggaggctgaggtgggaggatcacctgaggtcgggagtttgagaccagcctgaccaacatggaaaaaccccatctctactaaaaatacaaaattagcagggcatggtggcgcatgcctgtaatcccagctactcaggaggctgaggcaggagaatcacttgaacctgggagaacggaggttgtggtgagccaagatcgcgccattgcactccaacctgggcaacaagagtgaaactccgtctcaaaaaaaaaaaaaagaagatttctctctcttatcaggggtgctttttggtggatagggtcttcctcagtctgcgctttcctgagatgaccacataaagaactctccatgaccacatatggatgtggtgggtgattgattgagtgtcactgtgtttattgcggtggaattttatttttatgaccccacctggcgtcaggactcttcttcctctatttttaaaaagtcacccaatgtgaggtccagcaacagtttggagcaaggcctttaagaaatttatcctataaccctatagccacataaataagtgatacaagatcaggtacaatggctcatgcctgtaatcccagcattttgggaggccaaggccagagaattgcttaagcccaggggtttgagaccagcccaagcaacatggtgaaacagcatgaaaaaatacaaaaattatctggatgtggtggtgtacacctgtagtcccagctacttgggaggctgaagcaggagattcacttgagcccaggaggctgcaatgagccatgatcatgccactgcactcctgcctgggtggcagagtgagactctgtctcaaaataataataacaataataactgattcaagatccccaaaaaagacacagtaaaggaggaaactgttaacaattcaaattgcttttgcaataatttctttttgacctatgctaaaattttaagctccttcaatctgagtaaatcttcccctgcaaaacacaccccatttgattctttaaaacatggtaagagtagtgaggaaggcaagtcctcagatcttagcaattttcccccagccccatgttaacaatgagaagctatttgttgctatgtaataaggaccatattttaatcctcttcctgtgtgaaatgacatcctgagatgaaacttgcataattagaaggacaaaagaatgaattgactaggggaggaaaaaaaaccctgtagattcagggaaattccaaaggttgaataatgagtcattgaatatttacatgatcaaggtacaattagacttcatctattcagaacattagagtacagtacagtctttggcaacattcgaccatagtaaataaatatggattaaattgattgaatcattctgaatagctggattctctgcacagctaaaggttaattttgttatataacctcagagccttattttttccaccagtttgaatagaaacattcttaaaatgtaatatattactccttgctttaaaaaataaagtacagtggatataatttgtcttaaattatagatatcagttattagtagcatgtgacaccctgagggcccaaattatttgctcttttgaaaaatggactcatattgatttgtattttgaatttctttccaatttttcttagctttcctactttatccctcctagaagtgtgctgtcttctttagtactcttgtcagtcagcatatgaaactgttcccctcactcccctttgtcctttattatagacgccattccaggtaattaatctggctgagtagagtttagcaccacctaaggcacaacatttaagaaggcactgactttctgggtcaccaaaatgcaggttcagccccttaagtgacctccttaaattttgctcctcaggcaccctgcttacctttcccaagtcccaggccctgggtttactgaggagctagggccttcttccatgaggaaaacacagaaactcttagtgcctggaacgtaggagcttgagataaatgcagaggcccttcagaggcccttttatttgggtggtcagaagctgttaggtaagttgctagatagctgaattctgcatagggtaggtgttactagacactattgcccttttgtctctattatggtgcacttaggaaaatgagttattgcttcaaaatcaatgtaaggtttttattttgactgattcattcattttatcaaagctgcagatgtatatgatatatatgacctgagtttgttttaaaaataacatgcacaaaatctttttccaaagagatttgcaataaattcaaaaccagtggttcaaaccttttggtctcagatccctttgcacccttaacaattattgaataaactaaagatcatttgtttatgtgcataactagtgtattatacacactaactttaatttggaatacagtaaatattgtattagtgtgtcatatatttactgaattaaaaattaaaattggttgggcatggtggctcatgcctataaactcagcactcagggaagcagaggcaggtggatcacctgaggtcaggagtttgagaccagcctggccaacatggtgaaaccttgtctctactaaaaatacaaaaaattagctgagcgtggtggtggacccgtgtaattccagctactcaggaggctgaggcaggagaatctcttgaacctgggaggcagaggttgtactgagccgagatcatgccattgccctccagcctgggcaacaagagcaaaactgtgtctcaaaataaataaataaaagtaaaattgataacgtttaaaatacaagaatacagccaagtgtggtgacttatgcctgtaatccaagcactttggaaggctgaggcgggcagatcacttgagcccaggagttcgagaccagcctgagaaacatggcgaaacttcgtctctactaaaaatacaaaaattagtcaggcatggtacatgcctgtagacccagctactcaggaggctgagctgggaagatcatctgagcctggggagatcgaggctgcagtaagccgagatcacgccactgcactccagcctgggtgacagaatgagacctttcttctcaaaaaagaaacacacacacacacacacacacacacacacacaagaatgcacaaacaattctattagctgtcagaacattgatatcattacacattatgtatcctctggaaaacttcactgtctatttgttagagaatatgagtgaaaaaggcaaataatgtcttagcattactattaggaaaatcattttgacctggtaaactccctacctaggcagctcctgaagatcccagactgtactttgagaaccactaatataaatcaatttagtatttttttttttttttggtatagagacagggtctcactacattgcccggcctggtcttgaactcctgagctcaagcaagccacccaccccagtctcctaaagtgatgggattacaggcttgagccaccatgcccagcctacttcttttaaaagtatgtaattctgttaaatcccaaagtataaaatatccagacccataatgcctataatgaatagagtggggaacaaaataagcaagtaactgtgaaaatgttgaattaaacattgatttttgtccaaattcttcatctctgctacataagcaatttggccaataaaatacactgtcatttatatttgctgattttgggggggtacactgttttttgtttctttgttttgttttgtttgagtctgtcactcaggctggagtgcagtggtgcaatcttgactcactgcaaccttcgcctacccagctcaagcaatcttcccacctcagcctccaaagtagctgggaccacaggcacacatcaccatgcccgactaatttcttgtatttttggtagagatgtggttttgccatgttgcacaggctactcgtgaactcctgagctcaagcgattcgatctgccccccaaagtgctgagatcataggcgagagccactgcgcccggccatggggtacacttatgattaacagaatcaaacatctctaagcattatgaatgtccccatgaaagcaatattttatgctatgggagcttccattgtgctcgtgtctgggcatatgaggtccaggttggagtatgcatattgtgtcagaccccaccatcaagaggggagacacctgatagtgtttattacatatttaatctaaaaagaaagataatttgctataccaccaaaaatgacagtacaagagttggccaggtagacccttccttattcatcatgatgtttactaaacacaaagccttcacatgttctatttcaaagctagaattttactttgagaataagaaacgataatcaggaatagcatacaattttctcttatgcctcaaatttctaaagaatatttttatttttaaaaaattttcccctagaaagtgacagaaagccacaaaaacagaactagaatcataacatttaatgataactgttattgtgtcttcttctgtcttttttatgcctatataatatattcatatgatataattttgctctccatgctataaaaaagctaaattaaatggtatataagggcccataagatagttaagtaggtcaaataatgtaatatttgagacagcccacgggaagaagagaactgggtgttttgttgtgttttgttttgttttatgtgtatagacgcagacatataaaaagagacaggttaattaattttaagacgtaagatttctttttttcccctttaagttactggccatgaaacccttgatcattgaaaatagaaatggactccattggagagggccaagccatttatggagttactgggtccctagtgtttctgcagcagcacaaaggccacatatggggctgtctatttcatagctgccaccagtgcccgtcaattagaatgccttggcacaggctgtgcaggcatgccattggtggcatacctgtgctttttacagtaggtgaccataggaaaaatccaccataaatagatctacccctttgaaagcatttcagtgctgcagagggagagaaagtctgtatatgttcattagaaaggatcaaagaacagccgcccttgcccaggaaagagggggctagctttagttgttggttcacaaactagttcatttttaggttgtcccttaaaatatccccttgggcttatttttttcaaaaagtatccttgtttttcctttttattcaaaaagttttaaaatatgcttctttagtcctgttagcatgttttctaaaaaagatattgtgtgagaggacaaagaaaggagaacaaaaaaccaactgtatttacctagcaagaatgttccacagaactttgccctttggcttttgaataagcagaagtacagcaggacctcacctcaataaatatcggtttgcttgtttatgatttagagagcttgccaaaggtgggtgcctcccgaccattgcaacacagctaaccttgttgacaacagttggtgtgattgactgagtgttatttgctaagaaactggtgggacaggttcctcgacacaagttgctttgccgttttggggagccccgattttaaaagcgggggattccttagaaaggtgaggggtgtaatattcctgagagtcaaaactctagccctaattgctctcctgcccttgttaagaaatggaagacatgtgttgacagtaagaagaaatgtaaatgatggagctgggtgaatgcccctggagccttggccagcgggaggggaaccaatgaaagacatagtgttccttgtgggtaacacagatgaagaaagctgcccacggaatgccaggggacggttatggatttcttggcagcaaggagaagcggcttttgtgcagggaggaacagcctgccagtcaactatatttatggagcacctgctgtgtggaatctgaaaaggagaaggagaagggccttgtcctcaagaagcttgtgatcaaagggagaagaaaagtccccatctactgtaaaccctttagggttcccactcacatttgaaaagggagtggaacgggtgatatttagggggtgtgctgagccttgttactcaaagtgtgggttgtggaccagcagcatcacctgggagccttgtaaaaatgcagaatctttttagttttaaaattaaaaaaaaatttttttctggagatggggtcttgctctgtcaccccagctggagtatagtggtgcaatcttgactcactgcagcctccacctcctgggcttaagtgatcctcccacctcagcctcccaagtcgctgggacttgggaagcaccagctaatgtaaaatgtttttttatgaagacaggatttcattacgttgcccaggtaggtctcaaacacctgggctcaagcgatcctcccaccttgacctcccgagccaccatgcagccttgaaattcagaatcatgaaccctactgctgcagactccaagagtcagaatctgcagtttgatcagatccctaagtgattaatacgcatactgcagtttgagaagttctagaggatttctggaagtagtgagtcttgaatgttttaagagtgcagagtgagttggttcaatgactcaattgatactaaaaggcaattcatttacctgtgaatttcttaaacacaagtatcttatcatattgtaaccacttttataacctctttgaccttgttaaattcataatgggagttcaatgaatttaggttgcaaggatgctcctgcctatggtccctattcagtgaggtacagtggaaattgctgttaatgaatgaatgttacagaggcagccaatgaattttaggaacatgtaaattatttttagagaagcgggcaaagctagccatgacaggacctgtcagagacaaacatatgaattagagcgagagagatgcatgagcagttccttcaaggtaaatggggacaccttgggggctctgagacttacctgcaacacttcattttccatttaagtcatgtgctgcttggcctttaccactccttggtttcccagtttccaggtttaagacaactggaattctctgtttcaaatgctctgaaaaggactaaggtcctattttctctgatcatttctgtctcaccatgattgattaattgaatcgttgattgatctacttatctgcagtgtaaaaactataatgcataaaaattgcatcgagctcaactactattcccactttacagtaggggtatgagggactcacctcttctgtccagtccccagatgcttcctcagtccccatcccaaatgcaaacacgttttaacacatgcagctcacagacctagaaataaggcatatccttagcaggcagcatgtggaggaagacataagtgtcttttcgtaggtgtgtccgagtaaaaatgatgatcataatgataaaagccatgaaaagttaaagtctatgtgacacttgccatgttctctacccctgttaatgcattcattcctgccaataacccctgagttaggctgtgctattatttctctcatacttgaggaaatcgatgtgcaccccactcctacaaatagggagggcaacatccatatgaggttatgtggtcttgagaataagaccaagcaattcagtggggaaaatggtgtaattgcgctgagaagtccaccagtcctcctctgccttgtccaacataggtagcagggaaaggaagtgcaggcccgggctgcagagcccaggctctgagtcaagcaagcctggatcacagcctggttccacactccctaggctgtgggatctcaaagagtctcagttcccacttgcaaaatggagataatcatagtactgatttcacagagttgtaaggattataaggattaatatgcactaggtcctacatgcagtgggttctaataaggggttgcaatgtatttactccttcactggctataaagtaaagaggtttctgtaattttgagaagaaaaagttctggatctgcctatttacaggccggtatacattttcctatttctactccctgcaaccatcccacaacggtcctagcagtcctaatatcctataatgtttctgccattctctctgatagagttggctattcatgaccaatattttgtggattcagtggaagttgaattaagccctttaaattatcattttgatttttggtctgttacatagcccatgggggctacagacaaaatggaaatggagaatgtacatttagggaacatttacagatttagtgcccaagatgattctcttttacgtatttgattagaattcaccattggccttagttggattttaagcaactacagttacccttaaaaaatgggaattggtcacatagatgctaaacaagtatgatcaatttaatagatgtccaaccaccaaaagaagccctccttaattcttttgtatcaattctctatgcatttaatgtgttttcagcaataaaatgagataccagggagataagaaaggaaggaaagatccctggctttgtttagatggggagaaacagaaacataaatatacagagactattagaaaataattaagtcatagtgaaaagagaatgtgttatgatgtagtccagaatgcaaaagaataaggaagaagaacagaatagaataatcagctctggccgggcacagtggctcacgcctgtaatcccagcattttgggaggctgaggcaggtggatcacaaggtcaagagatcgagaccatcctggccaacatggtgaaaccctgtctctactaaaaatacaaaaattagctggacatggtggcatgcacctatagtcccagctactcgggaggctgaggcaggagaattgcttgaacccaggaggtggacgttgcagtgagccaaggtcacgccactgcactccagcctggcgacagagcgagactccatctcaaaaaaaaaagaaaaaaaaaaaagaataatcagctctgagagccttgagaaaaatattggcaataaggataaagattgccaaatgatagtaatggtaacagttcaattatagagctctttctacatagcaggaactaccctatgcatcttacatagaattggcaccctaagaggttatttatcttgttattcttatttcacagatgaagagcccaaggctgttagagattaaggaattgcccatgattgcacaatgaataaggcagagtcaggattcagacctaagtctgactccatcacatgttcagaaaaagcaggaggtctgctgggaagaacagtggcagaaaggtcagaaggggaacagaaatggctctagaacagagaggccactgagacgtagtaagagaagggagagaaagaagtgcccatgaacaacggctttgaatgcgaacctggggagtgtagacctaaccaaataataatagaaatactttcaagtagaataatgggatgaaacacagttgtaggataaataacttctgcagctgtggagaaaggagactggagggatgagaaacttgtctgtagacagagccaggaagaagtccttgggcatggcatggcaatggcccagtctgaaagatagcgtgtcaaagaaattggcatctcgctctcagtattctgatatccgtgtgctgcaacaacttattcaaagccaagaggacaatattagatttccatttctgcactcagatctctgaaaataaaatgctttgactgacagtttcatgttttggttgacgataaccctagtgattctttccatgatgtagtgaagaaacaaaaacatttctgacaatgccatccaagggacatttgtgttttcactgtatctgcaaattacatcacatcctgccacgttttcttctgtccatctataagtttatgttttttgtcttttggttatatatatccttctccctcactagtaaatagtaataaacttatttatggccatctgaataaaagtttttaaaaaacaataaattggagtttatactagccccaaaatcagtgatggaaaaagacatgattgcatcctggcaggcctgcattactgttttcttgatttctgttacggtgcaatccattcatttttctatgctcattccagccttcctagactagaacggggcatttggcctacacatagtggtgactgttcagccaaactgcttgttatggggcatcgtccgccctgcttaacaagagtcacttgtggaaaaaaatgtggaaaatcccatatgctgacaaaggctcccaggattccacaatgtgcctataatacaaaaactttgttatctttatattttatttagtaatcaagtagaagataattttagaagcgatcaccttcattaactgcctcttcttgtcctggagatgaagcaggtggttcatgagtgagtgatactcacatgtcactaattcccaattctgggcatccacagggatttggcacgggaaatgctatgctctttgttcatgtggatgcctttacctacttggaaatagtatgttctttaacagaagtttctttgtcagacttcatagccagactgctctgtaataaccagacatcgaaagccaggtaaaccaaaaccaaacctcaaaaccagagcctggaaaattttggataggtgtaggtgggaatctactccaagcacgtatgcttccagaaacaactctgagagggcttaattctgtttcccagtgaattgcaccgtccttgtaaaacaacaacaacaaagcactgcaaagccagaggactttcatgtcatctgctttcagaaagtgtctctcatgcaggcagaacaatgttggcgatgcagtggtgctcttgctttctgggaaaaaggggtctcatttctgcaccgaccttaccttagactctacgggatatgctcaccatatgcttgctacccattgtgtttcacttcatcctaacagcagtcctgcccatataagatgcggccatttctctagaggcaggaaaacaggctcagcacaagtaaatgcccggcctgcctctggaggggataactaagtggcaaggacactcggatccccattctacctttatctttccatcactacaccatgccacctcctggaaatctatataccacacataaatggcagcatgtatgtcttgggcctcttgatgcagtagggtgtgtgtgtgtgtgtgagagagagagagagagagagaagagagaatgtgtttccctcctccatccctcttgtgagtacacacaggtgagatggctgcctgcagcagaagctgcctggggctgtagaaagcagttcttctctgtgataaatgagcctgacatttccatgactctttccatttctagaaaatgaagtgccagccccagccccacccccggaaggtgagtaaaaacactcactcacacacgtttgggctgcaaatacagagggtccatcccagcatgatttggcctccacgggtgctgtgagctgtgagctttaacctaactcctactgagaagttggatggtgaccattgtgataagttgagaataataaaaataatacactgtgtttatataatcctcttgtgttaatctaatttggatggcacttcatatatattagggggacaattcttatgaaacctttcaaattatgtaaaagttattatgtccgcattttacagtgtggaggctgagcctccatccaaggggctgaagaatttgtgaggctttttcctatatagtgaaggtcaaacaaacccacatcttctttatgagagtggggagtggatccatctctaccctggaagatcagctgtcccttctcaacttgacatatgtcactattgagcacctccagaaactccctagcagctatccagaaaggtttggtgacctctgaggttcaacgtgaggaccaacttcttgagttcttagcaccatattgtccaccagctggcaacaggaaatgagtacagagatccagtgagacccttggcaggtagggcagtcccctatgacacacaatatatgaagcttgtttttatgtccacatacacctaaagaagaaaagaaaattaaaagattaaaagattgaaagctcaatgtggcttaaactcccaacatggctcttcagagtcatttatcagccaaatagccccaagatggaagcaaccaaaatcatgtgcattttcccataaagactccaaagtggccttcctcatccctcttcctccttgaaaaggatgagaaactggcatcccactcaataattattcactaggtatttaccctgtgcacaactctgacctaacccttcagagggattcagacatacctatcatgtacgtattgatagctaggtgcaagcatattgtaccagatgtagtggggaactctacatagaaaacatctccctgtattcagtttgtttgcagccaagtagaaaatagaatacagcctgggaaacaattaaataaaatgcagccaaaacattaaaacattaggcaatattataagaaccccccgccccccccccgcccccccacaccaagcagtatgtgattacttgtgagttgcttaaactggcaatgtgttatgaagccagcaggtgactgtagacctggtccagcttaggtgaaagcaggagtttggagaaggtctcagtttctaatcatcttttcacacaaaaacttatgaggcaattataaagctcttcctcttcctccctggagatcgtttttcttttttctttgttttcttttttcttttctttctctttcttgagacagggtcttgctctgttatccaagctggagcgcagtggcaccatcacagctcaccgcagcctcaaactcttgggcgcaagcagagattgtttttcaggagggcagtttgagaaatctagctgctcacaagaggccctttgtccagctaagaatactagattcacacactcaaaccctaaacagtatagagaagtattactatgtgtcgaaatgaacgaaaactggctcagtgccatatgagttcaaacgggaaagctcagatttattttctttagatcttgatcttgaaactagtgtagatgtgtgacattcttcttaggatcttcctgttccttggtatgttttctccttgcccataacaaatgtactttgaccaacattgagtacactgagaacctactggccattataaacaaacctttcccttctgtttttcagatcagttactgccactgagccactatcgtttcctttgtatgtcatatttcatattcattgcacaatattgacttcctgttgctcaaatgtctcctcccaaattctgctaaaattgtccttcttagttaactgagatttgaatctccattcatcagtccgaaaaaagagaatgcattcttgaaacaattcttttcttactgattccataagtcagataccatttgcaggtctaaactaatatgatcccaaacacagagaaatgcaaactagatggtctcaactggtagaatctgatgttactgctcttgttttgcatttattgccactaaacccaatccagaagattcacatggacactgaaacattttctttgaagcaacatacactgcacacaattacatattttgtactttactagaaaatctagaagtccaaactcttggaatcattacatggggcaaactgacttttctttaaaaagtcagtcccttgctgaggtctaaaataaagtggctcacatttgttttgcctaattctactccagcatgttatataacatgatccaagtatagttgagtgcattttaacaaaatctgtattgagtgttcttatgtgtacttttccaaaaatgatcagattaattgcttttcactaaaagtttagtgtggctctaagttataatttctaaattcataattcatgtacagcacgagtattcagtatcatttatgacctgttctgctgtcatttatttcttccctccccctctccaccccgttgctcatcacacaataaaatgctttaaggcactttaaaaaatatgcttgtactttctacacagaaccaagtaaagagaaggaggccggaactacaccagcaaaaggtgagttggagggagggagagtgaggctgaagtcaacaaaattagaagcagaaagaagtcagtaatgattgtcatggtggctccatagaatttctctgcattatctttcgttctgcctttgcatcttatctgcaagtcccaatcagtataatgacaaatggtgcattgctaagtttccattacatgtatttctaaaagaaaaacaacaatgataaaaatatcacaagcacttgttgagatgccagcaaattaattggtagtttccaagtttcgacatgcatgctaagaaagagaggtgtttggtcttcttaggattatatcaattgggaaaattatctgaattacccggtttttttttaaattaaatgttttcatgttattgtgtgaactgttccagggttcactaataattttgaaggctagcatctcactttgtaacactgactatgtattcatgtagatttatataatgatttctacagatacacaatataacattaagaagacatgttgccccttcttgaactggaaactattcctgtaatattatcctatttttactttatatggagatagtctcattttagaaaataatcttaatcatatacttctgttactccatgaaatgctaattcctttgtctcaccatggaagaaatgattatcattactgaccatctgtcttaagctaaggagcattagtctttcatagagggaagtttcatgaaggtggattagacagctttgctgtatatgtttgtattgtcattttaaaagtgaaccttttatttgcataatgaataaaaaagtttaaattttggaataactatttcctgactgcaacaagaagtttctctttttcctggacactgctcaaaaccatgttaagtatctctttgttcttgatgtgtcatatttcattatctaatttctatgatattcttgtgtcctatacattagtaaaatacttttttctttctttcagtagattggattactttccttcagctaacttgaacttatgctctcataatgaacgcataacgttagtatactcactttgtccttgaccttcagtggctcccatggagagtaacatgaatactaatcctggccacgtgggcgcagtttgaaggttatttgcttatggaatgcagacagtgcaaactcctagaactccttccatgggatggtttcaaggaggtttgggcatcctggctgaaattattgtaatattattctctacaaggccaatgggcatacacctctgtttccaaatttggaaaggtgtttgggccaggctgcaaggctcaaccaacagagcagatgatgtaatcccagagggcaagctgtcaaagtttaaacaaagcctgtgcctgacccttaatttgaaaagtcaccatattatacttgtatgcttaaatgagaaaatgtctttccttaaagtcaaccaaccaacaaaaactcttttatttatggagaacacagcgtgatgaaagagcaaggctagatgactagggcattttgaaattagtagcatttttctgacgtttgcagaagataagcaaaaccatgaccacatgcagttgcatgcccaggtacaaaaactgccgtgtgtgtgtgtgtgtgtgtgtgtgtgtgtgtgtgtgtgtctgtatatatattatataatggcaaatacatgtatatatatatgtatttgccttacatacctaggaagcaaatcaatttgggatagaaagtgacatccctaaataaagaaggtaagtgaatggaagtttataataaatatacagtcctcttcatcaaggacagagaaaatacctatgcaaaaagtagacacaataattactgctacttggatatccccagttgagaaaggagccctgcacgagcataaacaggattgatgggtgcaacctaccttttctccagcatgagctagaactctcctgctctccctccctcctccaactgtcagtctattttttttttttaaccatccaactcaggtttcacttctttgaacagctttctcctgaccatcctggcttacttttatctccccttctttctcctgatttctcttggacctgttgcctccatcattcaatcactcttgtctccacataatcgcacattaatggttgactccttttcctaacaggttgtaagctttttgacattggccccctcatcttattccctccagcatctggcagagagctgcacatagcaatcatctaatgaatacttgcaaaatgaatgagcagttgaatttccatgctggcttagctgctgaccattcaatggtaatctggatagatttttatttccattcaacatgtgtgctgggtaggaggatgaacatcctatgtatgttcttagtcactgagggttagaatgagacactgctgcagaacagaaggatgatttccactgtaagaccaacttgcctaaagctactgaaaatggtcttgcctggattttggtacattttcagcactttaactggtcttctatttaattggttgacatatattcaattaattgctccaaatctgtcactattaagaatattattcatcgcaatccagccttaacatcattcccagattgattgaatcattctgcaacagctcagaaatgttctgaaaatgctttttgaagccacagagagtagattctagaagatttaatcttagaagtagtatttgtgattagatttgccaactttttcatatttgctaaaagtctctgtctggaaagcagccaatttcccagcacggggttttatgattgtttgcttgcttgcttgcttgcatctggctatccatccagctatcctgttccttaatactgaccactttgtcctgggacctgggcaaagtcttctggaattgaaacaagagagatgacaataaagaaatgtgtttagcccaacagcaatagcagaaattagatgtgcaaatctcctttagaggaatcataccaggaggcaatgcctttatacaaataacgctgtcctggcttagaattctttcataataattataggtagcaaattgatggaacactaaatatagattcttttctgtatgctcagtggggccaaagattcgccttttattctagcacgtatttattcagcaagatttgctgagtgttggctacatgccaggcacagatctgggcactgggtcctgccctcctggagccaagttacactttatggggaagaacaaccatcaacagaggaaggtggatttcagttttgaaagcagacaagagtcacagagggccatgtgtagggaataacgtgggtgatcaagtgggatcatactttttttttgtcaactaagatccaacatcctatgtctgaacatagggtaattggagtaggtttctgctgtgcctcaacagctggccctgtggaaagttccgaaaatggttctgtggctggtccaaaaagtgacagcagcattagaatcagaggccactttgaagacctgtactcatttccatgcctaagtgctgatattttatttttacatcttattagcttagagtctgtatcttttcaattggtaaagttacttcctttttttattactgcttttggtaatcgtgaaaagggaaataaaaccttattttcttttcccaggcattcaccacataaactatcgtgaatgaaccctgtgtgtattaaatatctcacataacctgagatgaagtctttctttttcatgaatgtgactggcagatgaggaagtgagtcagcagaagttccaacctgaattatgtgattttgttttaaatttaaaaaaatgatttttaaaaaaatttaggttcttttacatctgcaataacattaccctggtgctttttactagcatgctaaaatatttttgtacgatttacctttaggtgtcaatcagccatctactaaaatttctccatgcttaatctatgtattctaattacattacttctttgtaatgaactttgttaaaaattaatgtcaccacacttttcaattcaaagacacagccactattaggcaagattgatttaatagatttgaggaagaaaaattcattaaatgtacatacttattgtaggataaatcatggttttataagcatcaaagtgtgaaggcatgtatcgtctcattaagaaaatgcaataaattaaccgaatgcctcaaaacatgatgaattaatgttagctattgttattgtctcccatattttattgctgttgttattttggtcacaaacaccagtatgtactacaactgattactctgcttgaggaattcatgaatttgtctcagtcaaacaaggtattgtatcagtatttcactgtttgtttacaagtcacatatattttaattttataagcttttggtctttattattaaatctcaacaattgtctcaagtttatattgcttaattaattttaaaaggcaatttaaaatcaaccataggtaggagttgctttatgcccaagagagtttggataattataagaatgtacacattctactatctctggagctttttattcagttacaagtctctcactcatattacgaagtatttatgtgtactcccctaaaaccccaggcttgtaatataagactgggttctttccctactttctagaatttcttctctgggaacttcagttgtttaaagaatcatttttacagtcttacaaatgctattttcccatgacttacagatgaataaaattctgctttagtaaactgcccttctatgtagctagggggaagatagccctgctacgctgagtgtgtggtttccctgtatgtcatattccaacaagctaaaatctgatgtttatgtattcatcatcaccacgtttagatagaaaaaaatgaaatatgacttacatatattttttgttttgtttgaaaatgttgtaagatgctacgtcattcatatatatgttgttgaactggacacaaccagaaagatttggatattcaaattacctcctagcaatagaacctggtttctatgaaaaataagaaccattaaacatttcagtctcatcgaactcaaccaaatcaagccaggcaattttttgagaatttaaggtcagaatcccaatatcttaactacatttcccaatctaaaaaaaagtgccaggactgaagcaacttttaaaagaaaggaaactggctgggtgagatggcttgtgcctgtaatcctagcactttgggaggctgaggcaggaggatcacttgagctcaagagtttgagaccagcctagccaacatggtgaaaccccatctccaataaaaatacaaaaattagccaggcatggtgacaaacacctgtatttccagctactcaggagaccgaggcagaagaattgcttgaacctggaaggcggaggttgcagtgagctgagatggtgccactgcactccagcctgggcgacagagtgagactctgtctaaaaaaaaattaattaataaataaaaataaaagaaaggaaacagtaagctttgctcatgttgattatgttttctagcactttcataaatttgaaaatttatgtgcaatgaatccaagattgccaattgagaagtaattgctatttgacactactgttgggtgatctagacgaagactatttcatgatactctgaagcgctgcattcatatgtattccttcatggtctaaaacaactgtgcatgtcctccaaatagtcttaacatttagtagactttgaaactactcacctatcaaatttttgcttaaaaaacagattgccggccaggtgctgtgcctcctcatgcctgtaatcccagcactttgggaggccaaggcaggaggattgcctgagcccaggagttcaagaccagcctggccaatatggtgaaaccctgtctctactaaaaatacaaaaattagctgggtgtggtggcagacgtctgtagtctcagctactcaggaggttgaggcacaagaattgcttgaaactgggaggtagaggttgcagtgagccgagattgtgccactgcactccagcctgggcgatagagggagactctgtctcaaaaaacaaacaaaaaaacccagactgccatcattacatattctatgcatgtaacaaaccatcacatgtaccccataaatatgtgcaaatattatgatgtatcaatcaattttttaaagacaagattatttttcttcattttagtttcatgaaagtaagtgaatactcttctcattttgtgttctaggtaattaactcaatgtttcattatgctctgtgcacaaacaaaaagtaaaccaccacaaaacctttataaagtattcatttgaatcaaaatggttcaagcgtccagtttatatttaataaagaaagctcctttctaggacttgattgaattttaacttcatttctgttaatttttacaggactttaaatcaacaatcttatatatttcagtaaataaaaacctctgaataggtaacaagaataaagtactaaatactgaattaaatctatggcaagtaatattatgggaaaattgtgagttattttcgttttgaacatgtaaaattttaattatttcacagtcttctgaataacggaattcttctaatagctcagaaatacctataccgggcaaatgcacaatgttgtggaatgtgaatgcatgcatattagttcaggagaaaaaattcaaaatgaactaagtttgggaggtgctaacgaccatatcatttcttgtcacccccacttccagtacacattatttgcacactgagagctttgagatatcctgcagtaaacacataaacacaaaacaataaaatacaagcatttaattccagcctagcatttttcaagcttctttgaccacagagagcttcctgttaagaatctcaaatcccacatgacccagtgaatcacctcttggattctgaagtaatgatattaatatattatattagtaattttattaaaaagtaataacacatatccctgtttgacagtttgggaaaagaaatttcaggccagtgggtaatacttgtagtaaatattctaatagattatataaaaacatactattttatgtctttttgtcaggaatttttaaagcactttttaattaacattcctgggcatgtatttcctgtatcctgcttgtacagtcatatacatttacattttgaaatccacagttattctagtttgcttttgtttttgtttttagagtcagggtcttgctgtgtcatccacgctagagtacagtggcgtgatgatggctcactacagcctccaattcctggactcaagtaactctctagcctcagcctcccaagtggttaagactacagcacacactaccaagtgctcagtgtgcaaataatatacaagcccggctaattaattttttttttttttttttttttttttacggagagagtcttgttatgttgcccaggcaaattcacaaatattctagtattttaagtacgaagattttattattcataaaaacactagtttatgctttgggaagagcagagcagaggttcagataacaacaaatgctctttaaggatgtaaaatgtgaactttgttcacagacctcagtgatgtgagcactgttgcttaggagtaacaagttgctaaaatgcagaagggatgggtagtgtttcttgcttctcatgatgaatgtttctgtatgttagtgacttgctgggtaactagtaaggtactagaattgataaatgtgtacagggtcctttgcaataaaactggttatgacttgatccaggtgtttaaaaatcggggctgttaagtctgaccatacatcactgtgatagaatgtgggctttttcaaggatgaagacacaagtcttaaccacactgtaacttatagttcccttaaaaaaaaaaaaaagaataaacctggcagctatagaatataccaggtgcattcataatagctgttttatatattggagtgttaacatttttaaattaaatgttttacattcacaagtgatggggagtcttatcattaaggtgtgtgtaatttagagttcagttggttttattctaactggactgcacttgttttcatagtggtgaaatgctatgcgcatttataccttgcgtaagtcctcattctaccacacgataaataacccgctggctgataatataaacactaactggagagattttatttataagggctctagaataaaatacaagtttttcacaccagcatcatctgttactaatactcttaattagttagtgcagcttttcattttgttgtggttggtctcctgactaggttgagttttcctcctctgctaacaggaaacaataccgacgttctttttcttatagcatttgtattataaaaagcacaaagctccagcccactgaacctctgccaattaagatggtgttgggttaggctgcatctggttactgtcctgggaaaatcactttaatagagatggtcttccaagcagttttaaaatttatccttctgccaggcgcggtggctcacgcctgtaatcccagcactttgggaggccgaggcgggtggatcacaaggtcgagagatcgagaccaccctggccaacatggtgaaaccccgtctctaccaaaaatgcaaaaaaaaattagccaggcatggtggcaggtgcctgtaatcccagctacttgggaggctgaggcaggagaatcgcttgaacccgggaggcggaggttgcggtgagccaagatcacgccattgcactccagcctgggcaaaaagagtgaaactctgtctcaaaaaaaaaaaaaaaaaaaaaaaaaaatttatccttctactgaagtttttaggtcaattaggtaggctgactaaatttacaaatgaacttgtttatccaaaacaaataaataaaatgtgaactttgaagttcagatgttttttaaaagggaaatattctgcacataaacactaaaagacatattttgaatttcacaaatacatatgggtaaatattcagaaatgatacagcattttccaacaccaatataatgttggaaaaaatgcttataaagtttatattaacttatcttgacttttgtttcttaaatactgagagcaattaatcatgaggttttctgggtagaaatgagttctcagatagtacatatataggcttttatgtctgtgtccaaacgaatgtgatatatgaataaggtctgccattcactttagttacaaaatcaggacttgaaaaccacttccattattgatttcatcaaggtttgatttttagcattcattttttcctaacctacagtcacataaaaaatttgcagtgttccatttttaaatctgtgcttccatttggattaccctactctgtcaactttttatttattattttttctttctttgcctgaaaaactcaggtttcacttttcaggtaccaagttttctaaggcttgctcagcagttgaaagtgtattgtgtggtttctcatcttctttttcagatttctcttttctcaggttacttgggatgaagtcttttctccttgactttttactcctatttcttgtttcagatgaagaggaagtctccccgcctagcgccttgcctccaggttgggataatttctacccttttccctgcttttaaatatattattcattgacggtagaggaaaagaaaaggcagtgagcctccttgctgagtcagtgcacagagcaggggcaacagttttcgcctgtgctggcaccaagaaggaaatgttggctttaatgacaattttttgttttacgtgagaaacttcttagaaagaggcattctttgagaaataaataagattggtaaatcttgggtataaatgttaggggtcaacatatctgtcttccatttctcactatatatccacccttttccctgttctttaaatttagatatttggattttaaaatttttcttttcttttttgagactgagtctctctctattgcccaggctggagtgcagtggtgctatctcggctcactgcaacctgtgcctcccaggttcaagtgattctcgtgcctcagcctcctgagtagctgggattacaggtgtgtgccaccaagctgggctaatttttgtatttttagtagagacggagtttcaccatgttggccagactggtctcgaacacctgacctcaagtgatccacccactttggcctcccaaagtgctgggattacaggcatgaaccaccgcccccagctgggattttttaatttttctatcattttaaaataagacacacacttttatagatgctttcatacttggagctctactgattttccatccaagccaacttgtagggttttttccttcctatcaccagaggagacagggtttaggggaatccaagaaggttgaagtcagcactccattttcatcccctttccacccctctgcatcacccaaatcacactttcctttcaggtttgggtagtcgggccctggagagaaaagattcaggtgagcgcaagcccagagaaggcatcctgacctcatcctaatacaatcactaatgagctcatttcttgaagctgtattgattctaatccttgtcttattcagattgtagtttttacggcaatctttcattacgtttcctcttacaagaaaactaatgtattgagaaacaattaattttgcatgatacacacgcattcaaggatctagccaaaaataccacaggtttgttctatcatttttaatatttagcaaatacacagagatcaatcttcattttggggatgtactaaagttagataataattcacatttttatagaactttacatacagataataaaacattttcaaatgcatcctatcagctgtagctcctgttctgtgaagtcattcattcattcattcattcgacaaatttgtactgaggacctaatatgatcctattatgggcctcttatgggccagccactcctataggcactgcaggtatagaagtgaacaaaacaagagaaacacttatcctcatgttctaaatgtgctcctattaatatcataaacacaaacaacaaaattttaacattagcttgggtgtttaaaaatatgtaatcacatgactatgattgtcacataattgtgaaaatgtttaacctcattgtgaaaatgatggcctactactacagatagaaatatcaagcatgattgatacatgaaaactaaaataattaaatgtgcattttccttcttttcaagaaacatcaacaagcagagagttggcaacctatgcatttttttccagttactaaatggctgaacctgaactctgcattcggctcagagacaggggaaatatctacagttctctctactatcctagaattggaattgactgcagattaacacttatcaccagagtgcaaatgagaagatgcaaaagaaactctatttccagcttgtctctctttatgggaaagcctcagtttttttctttccagttctctgtttcgttttgcttttcccccttgcagcacaatctcagtatccttgtaatttgtaccacaggtcatgatctgttacttccttgtcaaactatggccacatctgtacaaccctaataaaactctcttacaaaagcaaggaatctagaaataccaggccaggcttggctttctgacccttgtcagacagtttaccctccaaatgacctatccgtttagtctttttcaatgtagttgtatcgatgtggccttatagtccatcacctagaaaaacaccaagagtactgcttgaatacactggccaccattgtttacctgttaggggacaggcaagatggggaagcaaaggaattattgccatcaaagagagaataacagcttacctggaaagttccactatttctaagaattacataatgttcatttgccccatcatggaagagatacccctgtaagaatgggaatctgttcccctctactgatggctgctgggggcagaaagaatgatgttgtatttatctaggtttattagacaaagaaaagctacagcgttggtgagaacaacaaatccaggtaagactgcctaagaagagcctggccctgaaataatccttttcctcctttctgctcatcagactggacccttgtcgaaactcctcctggggaggaacaagccaagcagaatgccaactcccagctgtccatcttgttcattgaaaaacctcaaggaggaacagtgaaagttggtgagtgcctagcattcaatccttccttttttaaaaaattaaggtgagccgagcacggtgcctcacgcctgtaatcccagcactctgggaggtccagacaggcagatcatttgagctcaggagttcgagaccagcctggccaacatggtgaaacccagtccctactaaaaatacaaaaattagcagggcatggtggcagacacctgtaatctcagctactcaggaggcagaggcaggagaatcgcttgaacccacgaggcggaggttgcagtgaaccgagatcgcgccactgcattccaggttgggcaacagagcaagcctctgtctccaaaaaaaaaaaaattttgaggtgaaattcacttataacattaaccattttaaagtgaacaattcagtggctattagtacgttcgcaatgttgtacagccactacttctatctatttctaaaacattttcatcaccccaaaaagaccctatattccactaagcagttactactcattgacctctcctcctaggccctggcaaccattaatctgctttgtctctctggatttacctattttggatatttcatattaatgggatcagacaatgcaggaccttttgtgtctggcttctttcacttagcataatgtttccaaagttcatccacattgttgcatgtatcagaacttcattcctttttacggctggataatattccactgtgtgtatacactaaatcctgctttttacaacctgaaaagatgagtgacagctatgatttcagtaaccttcagcacataggagtccagtgcctggaccctggaaccttgggttctgatcttgattctgcttcctgctagctattacccttggaaagacagtttaacttctttatgcctcagtttccccatctgtaaaatggtgacaagaataggacctagctgtgaagtattttgaacagtgcctgacacaccataatgctgagccagtgtctgctgacattaccataactcactccataagatgattccaaatctacacatgcgctaggtcataattcataatatctgagacagctgattgggcaaatggttcaactcttcaaatattcaaattcaaaaatattgattatatacctcctgttttaggcactgagtataacatgtgagcactcagaatttatagtctgagaggagcagagaaaaaaataaacaaataatcacaaatgccaagtgctatgaagggatggtgagctggaggaggacctgagggttgaagaattttaaccaaataaatctttataagggatatattatgatctgaactagtctttgacacttatcaatattatgcaaatgagtacatagccaactgtattccagaattacttctttccaggctagaatgtcaaaatacactgcatgtgaacagaaatgttggttccccttatgttcctgtacgacattgaaatgctgggctggaagctggactacaatgtcacgtcctcagggtctaaatcactcaatacaaacagattgcaggtttacttcaagcagatcagtttgatttagtcacattcctataattccaggcttctcatcaccttgcctaataaaaagagtgaaaaaaattcaattttttcatttttatttcatacatatccatatatatgaaataaaattttatacatatccatatatgcaataaaagttcacatatatcatacatatccatatatgtccatatatatgaaataaaaaattacccaaatgtaaaattatccatatataaaaattacttccactggtttccctattactttttctgcttcataaacccccacagcagaacaagctgggacagcctaaggacctctagagcattcataaaaaaatcaggacgaattcatttcacaattccgagggcaccaatcacaccatattctgtagtgcagtcccatgtcaactccttccagttgaaagcaaaacaaatgacgcttgttaaagagcaagctgaatcccttatgcttcttctaggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtaaggccctgaactcccaggacaggcgctcagctagcgcattccttctatgtgaataaatgattattttcaggttcagctttgagagacttcagttccagaaaatcctctgaagttaccattgcagtgtctacactctattgcgattgcccggctgtgtccgggggctacaggacacatttgccctcctatagtgagaacattgtactggaattcccacagacagacacagctttaagccaatgctgagaaatttggaaaataaactgaaatgtgtgtgtctggatgcatttcattgcaggtgtacacatttgagatgcagatcatcaaggccaaagataactttgcaggaaattacagatgcgaggtcacctataaggataagtttgacagctgttcatttgatcttgaagtgcacggtaagagagccttcttgcctagataaatgtaattttttaatggggtgtgaggggatggagaagaagtagttcatttaatactatgagatttcagagaaagttttcctttaaaactgtttctgattgtggtagtctcagcaagcttgctgaattgaattgtaatgaaataatttataataaaagtagaattggggggattttatcgctaaatatctcttgtccatgctatctatattctttcaatctcccagataaaagatgatgtcagtttttgctgctacagaatgtatgtttcaaggggtccactttcccacttaggtttggggatagggtaatatgctatgagagttcaggatacccagatggaagggagaatttctcttataacgactaatgtcaggcatggcagttcttcatccatatgttctgtgcactacccagagtaaacatagaaggcctaaatgcatacgatgaggttggaaaaaaactcgcttttacaagtatacaaaggaaaagttgacttggcagcaaatattataaacttaaggtgaatgtaaagtgtgatgtagttgcaaaagacaaaaaagtgaatgtaattttattttatttgagacagagtctcactctgttgcccaggctagaatctagtggcactgtcttggttcaccacaacttccaactcctgggttcaagcagttctcatgcctcagcctcccaaatagctgggattacaggcgtgtgccaccacacctggctaattttgctggggtatttttagaagagacgggatttcgccatattagccagcctagtctcaaactccaggcctcaagtgatccacctgccttggcctcccaaagggctgggattacaggtgtgagccactgtgcccggccatgaatgtaattttaaactgggctattccaagtgctataggatctaagtttaggaagtgatacttctctctacaacatgctacttattctacatttggagtgatgtctttagccgtggtcactatacctctgcctggacctcttctcgagtagagtaaccaggaagatgaagaatccaaaaaccacaccctatccagcttgagtgtgtgggtgaaggaagtcaggcatacatggcttgttgcaaagaggggaaggggctgtcacacagaaaatggaaaacaaatttccatgcatgagaagcatttaggcagtttagaatcaaaaggtggaaatgatgaggaggtgaattttgtcttaacgttaggatgagctggccaggcacggtggttcacgcctgtaaccctagcactttgggaggccggggcgggcagatcacgaggacagcagtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggctaattttgttcttgtatttttagtagagacggggtttcaccgtgttagccaggctggtcgcgatctcctgatctcgtgatccgcccgcctcggcctcccaaagtgctgggattacaggcgtgagccaccgcgcccggcccctggagggctatttaagaatattgatttctgggtgcccctccctgatctggtggatcaacatctttggcagagaggatcaagaaactgatatatttctaagtccctcagtgattctagtgggcagacaagttgaatgacacctgaacaaggtgaccccaaggtcccttcattggttcttcatgagggaggaggaggtatgatgaggccttggcagcacagccattcaggagaaaagcctccccccttcacctgacattcttccatctaaagaatccccacagcctataaaggaactgaacacaaactacctccttaatgggtatttatgttattgttttctttcctttcaaagaatctactgggactactccaaacattgacatcagatctgctttcaagagaaggtaactccaaaagaaaaatctagatagcttttgtataacacagaagtggaggattttcaaacacatttcctttcccctgtattccgtattccaaatacgaacaacacttttcaccgcaaaaacaccatatatttaaacattggtgttctagaaaaaccatgggtttaaggcccagtcaagcatatactgaccattttttagaatgttcttgttataaagaagttcctgttttggaggtttcacagttgccttagaaagacactttcaatttattcatatgtagcttcctccttaaagcattactttccaccaaatggccaaaagaaatacgcaaagagactcatttcattggttaagtcacggcagaaaacttttatttatattgcctttcatctagaaatcactcagggagctactgaaccatgtgcccaagaaaaccacaaccaagtagctacttactgaagttagtgccatataatattggattatcctaaatgaaactggcattaagaatactacagaaaggcaaaatttagatacctatttcatatatttttgcaattaccaaggctgaaaaatggagggggggcggtcaaggaagaaatgtaaaagatttttggtctctgagaaatataaccagccccttcctgtcattatgttattctctgtacttaattattccataatataaattctttaatgagaccaaatgttttgttcttccgaagactgaatccacatacagaatccacatacagttttgctgaataaggaaagtcactccaaactattataaaacaataatttagcctgttaatgaggcatattttcctctgatattataaataaatcaaaactttaattactttgaaaagttatttaatattactggtattaggtattttttaattttaaaaaatgtcataactttcaaattttattactttccttccactttcccttcatcccatgctcagcaaatgcacaggtctaaaactatgctcatactgtatacaagtatatcttaggagagggaaacatgatctactaagttttgagctttaaaagaacagaaatgtatttacttcaaaaggcctgcaaacacctgaagaaattttgaaaacacattactgagtttaattcttatgacttacatgttatacacactgtttttaaacccacagactcttttcttagaaaccataactaacatttgtaaagagcaggaaacaaaacttccttaaaaaattaaacatgtaagtaactatgtagtgccatttaaatgttagctctgtagcttctggttagagtttatatgaaatcacagtggtggctgcatgcctaatttaagatgcatttctctacaagaaagcacttttttaaactgctagtaaaagtttcattaacaattcaagacaaatttttttaaaacatatttaagaaggtataaatattaataagaaaattagaataattatcaccctttaagacagaaaggaatgcatcttttaaaaatttctgtgttagctccttttttatttttgccatgttagtatcacattatctgattcatctgttcatggacacaaagaggttaccattgaatataaggctttgtacttatatatctgacattggtacacttcgtcctccaagccaatctctgtcttacatgaataacagagatcagcaaaagttctttgctttttacataggtatgtttctacagcccccaacttgcaaaaacaaagtactttgtgttgcttggcttaagtgcatttgtgttacctggttttaacacaaatccaagcagttttatatatgcaatctacaaaaatgtgtcttctgaaatcatagcgtaacacaagctcctcatatgtttacttttccacaagtacatactccaaaaacttaacatgtcacttgtgtgaaaagaaatagtttgtgttgatttagtccttgtgtggcacaaaattgcatatacgttacatgtagagtgtttgggggaaattgttgtgtatgtctctgcattaaacccagatttgcttttcttttgttaacgacagtggagaaggtcaagaggatgcaggagaacttgactttagtggtctcctgaaacgtaggtgagaacaaagtgatggagtgagacattgtggcctggaagtctttcagacacccactcagagaagtcaagtttaaagtggatgttcttcagagaatttttcatttctgaaaatgtgttttgcttatagaatataacagagttgactagaaagagagaaacaactgcatactaatcttttaaagcctttaacagttgcttttaaactttctttttaaatgtttcatgactcttcacctatttttttttaaatggggacgaagagatatgaaaactgagacataagacaaatacctagaaacctctaagactgcacatatgatttggtagaagtctgaaggtatacacattgtaagaggcagacctactttaatgtattatttatgatgtactgtatttctgcaagtctaagacaccactgctattaagatacaccagcactttataaatcactaagcaatgaaaaaattgttccaaatggtttgacacaccattgattataagatgcattgtcatttcagaggtctttaaaatgcctcaaaaatgtgttttagaagtgacaaaatggaaataaaagtttagtatcatcacacactgacacttttcattgttctctcctgcaataaaatttataggatttcattatggatacttagaacataaccattttataagatttctctccatatatatttctataactgctatactcttcactaggattccctatatatatactatattatatgcctgttatagatatctagatatttactatagtgcagaagcaacaaaaagaaacactttttttctgagattatgttttatctagcaaatttgtaaataaacagagtaaaactataattttaaattaattgtatataatatcagttttcatttaactttccaggcttttaaaattacttttagtgctttctatggttattaaaagactacaagtacaaatatgcttcataacaaattacaaacacttgaaatatactgggattgtgtttattctctgtttagttagatagctgtattgaagtctctgtaaatgaaaaatttacccctatccctcaacatgtaggttgagaacagaaatattaatgggtgtgatttattaattcctgagggctattagcccatcaatagactacttcaaataaccattagtctcaatagtattgattaattccccaaatgcatttaaagcaatagtatatgaagtgcccttaagtgagcctcacgtttcctcattctacagataagaaaccaaggtacagagacaacaagtgacttatcccaagtcacacaggagttagaggcagggccaggacccaaacccaagtttcccttttatgagtcagctcatttcctgtgactccatattaaagataccactctgaatttgccttggaagctggcgcttcagtttataacacaaattgacactttaggaagacaagagagctttgtattctccctgcaatcatttactcagtcaggaaaatactaaacactgtctttgcgtagaatataatgctactgatgtgaggaaaagaaatccagtgcctggcacatagaaaaggatagatacacttttgtgggaggaaaaatagtggtaaaaacatggactggagtctcagctctaccatttactaattatgtgactttggtcaaatatttgacccctctgagacttggatttcacatctggaaatgtgaagaataaacactacttaatagaattattgtgcaaattaaattaagtgtaaaaagcttggttcacagtaggtggcaaataaatatgtacttcctctaaggaaatgtgtcattttctctaacatagtttatattcataaggagacaacacacaaacacatacacaatcaatcaacaaaaatgtgatacagtagattattaagcaccttgctctgattaaaaaggaaaaaaagaaagaaaaaagaacagactttttcaaccagtaattccagaataaaataaatctaattacatagtcaaaatgacaaaatttaaaaatcacttaatgggcagccaacatgtctccagttctcattttcttttatcccctgcttaagatttgcattcataattagattgttgttaatataaggctatgttatgttcatttagtatactatactaatccactaatataactttagaaatcattgtgttttcctactagtgagttgcatgcgttttcattgcggtaatgacatatggttaccatttctactcctccaagtgtgtgtgccaaaatccccacaagaaaaaaaaatatgattaaaaccaacatctctgtacaacgaaagatcttcctgctctgaacaaagccagcttacttcaaatagacattagctaaatcagattaaatcttttgggcagcatcctgttataggaattgacctgtataaatacttgtaagttgtactctacataaaatttctataactgttatactcttcactaggatcaccaagttattgaaattttgatgtagatgaaaatacagtgagtattatacaggtctatcccgaggcttggaaaagaatcagaagtgcctacagaaatttggctttttctcctcactgtaacttaacatagccatgcagacagggtcatgtgcagccaccatggtaagtaactaaagatatgttccaggtgcattaaggaaatgctggaggtgagagccttgacctcacatttcagtacaagatagatgcttctctttacgatttgagatacaattaagtaatggagagaaaaggaaggaataggcaagaggtcattggtgttcttatatgaaatttgatatgactaagtatgtgataagagtggagagtatcttggcattttaatgaaaactggtgaggatgattggttttataaatctaccaacaaaactgactcaggaaatcacactcaaaattatcatctttattactggtttccttcatataaatattcacctcatggatctatgtaggactcagtgacttgtgcctcttgttagctattttaattatatctagcttgatagctttaaatcctccgccaatgtcaggaggatagctgaaatatgtaatgtatgtgtgcaattcttcatggttcaaatacaaatttaacataatccagtatggcataattttatagtctggggactatatttaggctggaatgtgacaaaaatagagcactaataatctagattgagggaacaccccgcagaaaatatatacatatgaacatacatatacatcttttttgggtttttctttgagacagggcctcactttgtcacccaggctggagtacaatggcgcaatcttggctcattgcagcctcgacctcctgggctcaagcaatccttccacttcagcccaagtagctgggatgacaggcatgcgccaccatgcccagctaatttttgtattttttgtagagacggggtttcaccatgttgcccaggctggtctcgaactcctgagcccaagtaatcttcccacctcagcctcctaaagtgctgggattacaagactgagccacttcacccggcctatacatatacatcataattgtgactctcctagacttcctactaaaatatttaaaggatgtatttgaagtgtttactgtttccaggaagtagatttagtggatctggcaaattattaccaatattccaatttcaggacaattttcttaagcttttcgattttctcatgttaataaaggatgtagctgttatttcagtgagatgaagataatgcttgtgtcttgagtttttaagaggcacattttgctaatggtgttgtctagtccttcccatcaagattattggagagaccagtgacctttcacttccttctattttccaggagttctgcctcaatgtcccccaaacccactgggcaaaaagacttacatggcaatgtaaaatggaagttagatattcagatgtcatccttgcctaatgccaccctaaactctatattaatatctataatctcctcccctcccctgcatattttatccatgattacaacccagtatttccttctcaaagtacacatgagtgtaaagatgacactccaggctggtgtggtggccagcactttgggatgccgaggtggacggatcacttgaggtcaggagttcaagaccagcctggccaacatggtgaaatcccatctctactaaaaatacaaaaattagctgggtgtggcacacacctgtaatcccagctacttgggagactgaggcaggagaatcgttagaacccaagaggcagagattgcagtgagctgagatcacaccacttcactccaacctgggcaacagagtgagactctgtctcaaagaaaaaaaaaaaaaaaaaaagaaggcactctgaaacaggtgtaatgaatatgacaatgcaaacagatgtaacccatcattccctaacatgatagcatgaattcattttcacactgatatataagatgtttgaccagttttccagaaaatcatatccaaatcagcattacggtaagcagtcgttgtaacatttctaaattaacctgataaaaatagtcatgtaaatgtaaacaaaatcaggattatttattcaatgaaggaaaccaatttgtttatactaagcctgttttccaaaagagtgtttatttctgaattttatttttattttatgcttttaaaagaaaggaagacaagtgtaaatcttaaatcttacttaaatcttaaatcttatttttaacacatatatgttctttatgtgttctgtagtcaatgatcaaaagttggggtcataattttggtatgcaccctaagaagttactttcccttgttcatggtgccctaaaccatttgcttcacagtttaacatttgtatttttataactcatacccaatttgcttccaaaaaacattcaagacagtactttaagatgaaatgtaagaaaatttttaaaacctagtctcctttccccctgccgatttagaaaaaaaattttaaaaccatcagtatccataaaaaccatgtgaaaaacaaacaaaaaactcatggcagtttcaattttttttttttattttaagaaaggtaaaaaatggttcatgtacttagttactaatatggtagggaaaatgctatttgcaaaatccaaatgtttgaaataatgtatttgtactgtctccatatttagctagggtgtgtacatcaaagaaaatagagatcatttttatttcataggccaaatctaaaccttttagttctagtccaattttcaataattcaatatccatatcctagatgaaaactgttaagtttctcaaaatcccatcttctaattagactttaaatttgaaaataagtaaaatatatttttaggctatttcctgatgtcctctactccccctaaaattgtttttattaactaggaaaacgaaaggtgttactataagggcacacatttgatcttctactacctgcaagtttccctaagacttccattccagcaagcaagacttgacttctgggcttcaagtactcaggctttaaacagagcttttttacactgaactgaaaaagcagaattatacctcgaccttcgtggtctctaagggtcagtgcagctactaaactagaccatggttctccccggttagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcaggtgagcgctcccgggggcgaggcagcggccgaggggcgtggcagcgttcgaaagccttgaccgtgaaccccatcccgagctccttccagtctcccgcggggttgggagtggggctgggtaggagtgcaggggttacgcttgtctagacggacagctcctgaaggttcaaggtaacaggagattcatggtccacatacaacgtagaatggaatagtacattacccccgcggttactgggaatttctcagccgccccctttctccagcctccacatccccactcactgtcaaattattgatttttacttaagcagagtggactctttcaccatccttttctttcacccacttgatggcgtgtggagagttcactttctcacacccaatatggttagcaaaatgttttgtaaaaccaataagcagctccgtgggggtctgaaatgggtccagtttattgtggtctgaaatacctttttaaagtggaaagaaaaaaaggagagaaaggaatacattttacgctgaccattagctcttcgaagcttcctatactcggtcattattggttatgggttttatgacacatcaggttagtaatatatcaatcctattattgtttattattttgttaatgttccaatagaatttaaagatttttaccaccctttaaaaaaaatctgacctttatttctgaacttcctggaaactggttgagaaatggccccagagaaatgtagtagggttttttttagtttatgtagttcagccattcccactatcccagaactcctgaagttatatttttgagaggtgtattaatactacaggggagagccagctgacatctcttttccccaagctgaactttgttattgttatcacttagctctgaattcatctcctaaggtgtgtggtagatggcttttttaaaagctagggtttattttatcttgttaaaatatgagacagtgagcttacctaaacaatagtataataaggttggaatgatggaaatacaagcatgacaacatgaagcatttcacatttgtattttccaaactgctaaatgagaattattatcttttaaaaagcaggaaaaaaacttattaaattaaaaaaagaagttaactatctttatttaggacccttcaaagacaactttttttttaattgctgtgttctatgttatttaaaatatttggaaatcctgaattcctaaacgtatgtgcaaggggtgtttttaaaatgccactgtttgggcaagttaccacagtataaaaactttagtaagcctactgtttcaattagtcaaaggcattcgatttaatatgaatcactgaatttatcttataaattctgtggttaaaaaaccatctgtgacttagaaggagtgcagaaataaggccaatgacactaacagtaattctgctggaagaataagcatgttcttttatttttatttttattttttgaaacagggtcccattctgtcacccaggctggagtgtgcagtggcatgatctcagctcactgcaacctctgcctcccaggttcaagtgactctcatgcctcagcctcccgagtagctgggattacaggcatgcaccaccacaccccactaatttttgtatttttagaagagacagggtttccccatgttggccaggccggtttcgatctcctggcctcaagtgatctgcctgcctcagcctcccaaagtgctgggattacaggagtgagccaccgtgcccagccccagcgtgtttttaaagttcactttcatctgaacgctttatagtgtacattccctgaagaattaggtcatttttaaagcttcttcaatgattcttttcttacctttcttctagaaacatgtggattctcttttcaatttaaaccatcttattgtatataagtcaacacagtgttcgaaatataaaggataatttggaaggtttctgatttttttcttgagattcattttttcatttgcttttaggttctcctacatgtattgactatttaaattcatagcatatgtatacatatattaacatacttttgcttcttctattctatcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaagtaagtgggctttgcaaaaatcagtgatagctctacagtaaattaatcaaatagtagttcgactgacttttctgagaataaaaggatatttatattttcataatacaaaatcatatggagagagagtaaacatttaagtcacattttatttattagggaaacatgatagttctatataaactaaacctttttttatgtttaattctaaaaaactatttaaagtgttttccaattatggttttgtgtcgctataggttatatgtgattatttcagagtattgccaaatttctcccaattttaaaaaataaaattgaaaaataacttgcaatccatatttgatatgccacctgggaatcccatcttataattagatgacttttgcttttccaaaataacgactatatttcataatgggtgaataccttctattttcaattcaggtactgttttgagcacttgcaatattgcatataaaaggaactctttaatgttgagataaaacaaaatgtgggtcaaagcctgtgttttattatttattggccttctcacagatggagacggactaaagacagactaatccctgacgtctgatggtatctccagtctattataaaactactttacagagatcctcctcagcctgagagattttcaactccaatatatttttttaggttaacaggagccatgtgtacatttataaaagatgttaatcctggaaagctgttacttgtggagtacaattaggtggtttccaatttcttaatgtggtcatgccactagagtgactttgtgatgataacattaatatctggtgtaaaaatctcttgaagatggcctgaatttaccaaaaacataattttaattggttatctttatgtagaaaatatttttaaatatcttgttcttgaaggcttcaatctgagaaattcccaaaacagtgtttttagtctattttaatcccatcatgtgctcctccataatacagatcacagataattatattttacaatcttcttggcttctagtttttcgtttctaaatactcacattctttcttagtacatgtaactgtatgatagcaccagttcttgagctcatttaagagaacatcacattctatagaactgctgcgtgtgtttgtggttatatcacattatttcttaaattgtataatcatttattcacccaaggaaatctactataccactgggataggtaatgaatagatcttattcatacatcaatggataagatcaagtctctacccacctataaagtacatgaattggttagttaaagaatgtacagagttaaaaatctgacaccctcagccaactctatcttccaacagtgggttaaaaaaattaaatagcaaatatgtgagtactgatttttatttgaaataaaaaccttatgtaaaagaaaattataatggaaattaaatagtatatataaatatgcttatacattaagtattataaagataaaaattggtttttttttttggtttgacgttaaactgtgtaagatatgatacctaaagagcagatcaaaattatatccctgctgggcacgatggctcacgcctgtaatcccaacactttgggaggctgaggcaggaacgcttgaaccgaggagtctgagacaaacctgggcaagatggtgagactcagtcttacaaaaaataaattagctgggcctgatgccccacacctgtggtcccggccacacgggaggctgaggcaggaggatcacttgagcccaggaggtcgaggctccaattagctatgtttgcaccactgcactcctgcctgtgcaacagagcaagaccctgtctcaaaaaaaaacaacagatccttgactttcaaacactaccaaattataagccaaatttgctggcaataaagaaaagaataaaatcacattcacagactctgtttattttcatcctattcaaaacagatacatctttgaacacaaaggatgccagagaatcctgtttatcaataactgtcagatgacagatgattcagagtattatgtgacagccggtgatgagaaatgttccactgagctcttcgtaagaggtaaaaatgaaatctcttattgtggtcaccaggagctgttggcttcttctcccagggataatgatcaaagtgaaagtaactgaggctcctctacactggcagctattatggatcctaatgagtcttctggtttgttgaagactagaacagcagaggggagaaagagaacctgttgagtacaaatgcctcatgttttgactcaagccaagcactatcttgcaaaaataattattctagttatagctttgaaacccaacagattttactggataatccttgtttcacacactcaattgatcacaaataggtttctcttgaaaccagcttcattaataagtggttggtaccaagcacactgaaaattatcatttactaagacattgtgaaaagagctggagggtgtgaatacagccatgtcttccttattttctttatgagggcttctgatgacagacaaccctgagatctctgtcatccatctggaactaggatcaaagatttgagttttatatattctccttcatcagaaatgtctagcatttagtatcttctttgctaaaagaataatatttgatatatgttttgtttgttcttgagaacaataattgatttgacttggagaactgtgaaaaaattgggagaatttacccagggttgcctgctatttattttgccaagaacagacatagaaaacaaaacaaaacaaaacaaaactcacagacagccacagtggctcatgtctataataccagcactttgggaggccaaggcacgtgatcacttgagatcaggagttcaagaccagcctggccaatgtggtaaaatctcgtctctactgcaaatgcaaaaattagttgggtgtagtggcatgcacctgtaatcccagctactcaggaggctgaggcaggagaattgcttgaacctagggggtggaggttacattaagccaagatcacgccactacacctcagcctggacagcagagtgagactctgtctcaaaacaagaacaaaaacaaaaacctcacttactgttatcaccatgtcaaccatagatgttgctttctcactgttggtttttcatctgtgaagaaatcagggctcatgggataggctttggatatttaatgattctgatttcccctttttgtatactagagcctccaattatggtgaccaaacagctggaagatacaactgcttattgtggggagagagtggaattagaatgtgaggtgtctgaagatgatgccaatgtaaaatggtaaatagccttaatgaagtctgtccatgtttaatagacaaaaaaattggaccttcatagttgatagaacaggaagtacaaatagcttttaaacctttgaaaacaatctccacctcatttgtgttagtagagatgataaataaaagtatactaatatactggggtttttccactcatgagactgaaaaaagaaccagagatctatgtgggtaagcacgtagggaagtgggtacttaatactaagtggatgactcaagtttacccaagtctatttgaccccaaagcctatggatgctcttaacctttatagcaggcttcctctcactatgccatattggcaacttacatgaaaaaacatatttagtgtttagtaagtttagtaagacttctttagatgtcttctaagtgggcttactaatgatagttgtgttaattcggttttagaaaagtttctatttgatttctatttgcaatgatttttaagtacatatttacatgtgtttttcatgtaacccctagtcactttattttcatagtacctcaggggaaaaaaatttagactgagaatcaccaattgcttttagaaataagagtttatttgttttgctcaggtggggaatgttttctcaggttccttgtgagtaatcttaaaattaaaaactagaaattttaaatcttaaaatgaaatgttatgttgaaaggtacagtaaattacacagcaggatttgtagtaattggtacagtgtagattgttcattctaatagagaatcatagttatctttaaaatgcattaaatgatattcttactaatgtgcttcaagagcctacatgggggtaatatccactcttagcagttgcacctgattcatcttgagtgcgagcaggtggctcgtgttcttttaacacaattttgtagacaatatttgttacattatgaatctactgatggatacagagattgattcgtacattttttaattcaacaaatagttcttgtgtgtctcatatcctccagaaattcttcaggatattgcaataagcaagatggacaaggtatttttcctgaaggatcttttacaaacctttttaatattttatcttaattcaggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgactgtaagtgagacttctttagatgtcttctcagtgggcttattaatgatggttgtgttaattcggtttcagaaaagtttctatttgatttctatttgcgatgatttttaagtatgtaaaatggatttcattccagctaagtgtctatgtcagatcaatcaggatatttaaggaaggaaccacgactcaatttaatagtagagcgccaatattaggaaggaagtataaaaatcacctgccagaagagttataattccaagaccgtaaaaataggggataaatacttagatacgatgtcatatcctgataatgttagctagctattcatcaaataaccattcaacactctgcaattacatttggcatgagaagaaagtaattcaaaccaaaagggctcaattgagaagattgtaagagctaatttgctagtaggcttcagaggcatgagagaattaatgtacttccctcaatgccctctacttctagtcagttagcaatggcagaatctctcccaatttgccataaaaattaaaacagcaaatatctcaagatgatgtcacaaaaagagcagaaatcttacttccacatttattgcttagtccagttgcagttcatataatcattgaattattcaggatcaatcccaatacattccttatgctttatggatctgtggccattttagtttaacatcaagaagtctttcagccatagacagatccttatctgatatttgtatccatttaaagcaattataatccattctgctatgatgtaacatgtgcatttctaaaaataattatgctatgcaaagtcatgcagtaaaaaccatagggtttgtaggggaaatgggattatgggtatgacactcaagaattttgctggtttattagtccgttctcatgctgctaataaagacatacccaagactgggtaatctataaaggaaaaagcttcagttgactcacagttccgcatggctggggagacctcaggaaacttacaatcatggcagaagggaaagcaaatatgtccttcttcacatggtggcagcaaggagaagtaccaagcaaaatggcaaaagtcccttataaaactgtcagatctcatgagaactcagtcactatcatgagaacagcagcaggggggtaaccgcccccatgattcaattacctcccaccacgtccctcccatgacatgtgaggattataggaactacaattcaagatgagatttaggtgagggcacagccaaaccacatcagtcagcgacatattttttaaaatataagaacccagtaaaaagtagtagcacagttttacacatgctaaatggttaataaatataataaatatggcacttaatgttgaaaaagacctgagatttgcttacagaattaatgctggaagtgttgtggcttgtgaactgttgtgaagcagtagaaagaggattattcaaaatctgatgagtagttgtgacctcagatgtaaatgggtgtggcttatatcacatggatgaactgaggtagctgatagatgtttgaggtgtgagtctgcagattttgtgcattccttgctgggtcatttcagctggatgcaattttctgcattcacctagtttttctaaggaatgaaattgtacagaatcaaatgtgaaattatcctctaatatattaattgcattggtacagcttctcactttcaaaacaaacattgtagtagagctcactataccattgtgaaatgccaccatcttggcctgttgggagtttgggcttggcatttgtgatggtctatcatttctacagtgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggtaagcgagccaggtgacccgcaagtgaggtttggtcccatttctactttctccattttctaaattacatatttggtgaggatatttgaagggtagccatagggagatcatctattcctgattcttcgcttccaactagcaagaaggtgtgatttctctgttgtatagcatgtcctactcataatcctgtatctgtacctcacactatggtactttgtctattcaaaatccattgactctttttccatttaaacatgaagttagaggccaggcaccatggctcatgcctgtaatcccaacactttgggacgccaaggcagacggatcaattgagctcaggagttcaagagctcctgggctacatggcaaaacctcatctctacaaaaaacacaaaaattagccaggcgtggtggcatgcacctgtaatcccaactacttgggaggtgggaggatggcttgaacccagtagggggaggttgaagtgagctgagatcacaccactgcatttcagcctgggaaacagaatgagagaccttgtctctaaaataaataataaacatgaagttagaggaaaaatactgaattctaattgaggacctgatcaaatggattaaccgtctctaaccaataagtgtcacaatgccttcccacaaatctttatttgcgtaggggacataatatcctagaatctggcaaagatctaaggcaagagtttaactttgaattcatgggcttttagggtatcataaatgaactttaggaagccccataactcctgtgaaattgtgagaaaattctatgtgtacaaaaatacatactgtttacacagaaaggattcatagtgtccatcagatattcactagtttgtgaccccaataaagttaagagctattgttcttagggtttgggatgtaaagccaaaatcaagattattcttggcatctcttgaatcttaaagtatagcattattgatatgttctattttagcctttttaaagttatgagatgaaaaaaaagaataatagactctgcatatacaataagcagattctatttgtggagataattccatatagtccaaaataaagatttaatttgaatcaataagtaggataattaaggcttctcatcctctctctctctctctctctttctctctctctctccctctctttcctgcactaaagaagttaatcagataaaggtcaagtgtcttttcagtttgggtcatatataaactagatctttggagtcttagaaatacattttccttgtttccttaggatccacaagttagtgatagccaatgccctcactgaagatgaaggtgattatgtatttgcacctgatgcctacaatgttactctgcctgccaaagttcatgttattggtgagtagataaaataattcattgcatagttgcgttcttttttgtttgcttttgcttaccatggaattataatatattcaaaactaagtgacatttaaggaaaaatacatcaattggtattaatcaccaatcagaaagattggtgacttataccaacaccttacaataaaatggttttgcaaggtgccaggcaccaactatcttgactcctcttatattctttttgattagataaaatattggttactaccatcatactagccaaacattagtgcagatatttacacagaaatgactgtctgataacaaagactatgcttaatattctagatcctcctaagatcatcctggatggtcttgatgctgacaacacagtgacagtgattgcaggaaacaagcttcgtcttgagatccccatcagcggagaaccacctcctaaagccatgtggagccggggagataaggtttgttttatgcttgcacacactcacatgcacacacacatatgcagacacactgcctaccccaccccttgccctccattattcagatgaaggtagaaaacaaataaatgtacagcagtacagtaaagatgtaattcctttgaaaaagaaagatgactgattttcaggcaaatctgatcatcattaatttacttctcatatttctgactattatgtagcaaagcatgttttgatgcacagtgaaaaaagcctcatttttattctaatgaaattggggggatgaaaaagaaaatgaattattaaataaataaatgaacaaagtcactttggatagtaataagtacaagaagataataaaagagaatgatacaatagcaagtaactgcatagtcaatggcagcctctgtgaagaacaaggaacccattatgtgaagatcaaacagaagacatttccatacggaggcaattacaagtgcaaaggccaaggggagagaataagcctgatgtgttggaggaacagaaggaaagccagcatggctggggcaaagtgaatgattgggagaaatgcaagtgagggtgaaatggtagagtagtgccagctcaagtgtgactccgtggctttctacaaaaataaaagcaaaaaaaaaaaattacatttaaaaagaagacatgaggctgggcatggtggctcatgcctgtaatcccagcactttgggagctggggcaggcagaacacctgaagccaggagttccagaccagcctgagcctgcatggagaaaccccatctctactaaaaatacaaaaaaattagccaaatatggtggcagcatgcctctaattccagctactcaggaggctgaggcacaagaatcgctggaacccgggaggcagaggttgcagtgagccaagatcacgccactgcactccagctgggtgacagagtgagactctatctcaaaacaaatttttttaatgttaaaaataaaattaaataataaaaagcagaatgagacttctactttcaaccagaattgaataacaggaaccagatttacctactcacttgaaataacccccaaaatagacaaaatatgtgaacaatgggtttcaagacattggacatcagatcgtgaaagacaatgactatgaaatatgataaacaaatgaaataagccctataattgcctcaagcttattgccataaaagagtatccaggcagtggcacaaggaagaaaaacctggacagaacccagtggactccctaagtttaggactcccattgtacaaggagaccaaggcagctagagttcataggatacatactatacatactggaggagagagctgcacagagagtccccctggagctctgcagaggaacacgctcaagtattcagcaaagatcagtgcacatttatgaggaaactacccaagattcaagaaaggaacatatgaaaggattaaagagaagtggactggcactcacacaaggccaatagtagtgcctgttccccctagctagacatgaaaacctcatcattcacagtgcattgagtagagtactcaggaaagccttgccttggttgcaggaataattaaccctagactgagcactgtcatggacccacctaataagtcataaaaacaagtctaaaagattcaatcaatttccaaataatttaattgcatttcaaaacaaagctcaagatttatataggaatacaaaaatatcaagcacccaacatgacaaaattagcaatatcctgccatccagtcaaacattatggtagagaaataagcaggaaaacacagctcaaaatgaggagaaaagtcagttacagccaattcagatctcacatgtaaattagattagcagtcgagcatatgaaaatagttattttaactgtattccatatgttcaaaaagttaggtggagaaatgttaagctctccatttaaattaaatttaagagaaatttaataaaataaaataaaaattaagagaaagttaagtgaaaaaagtgaactgaaatggaaaatataaaaagatccaaatctaatcacctacagatgaaagcaataaaatgtctcagataaaaaatatgtagatggaattaatagctaattagacattgaaggcaaatttgaagacatagcaatagaaatgatccaaaatgaaacacaagagaaaaagtccaaaaaaatttaaagaatcagttagacttcaaattttcattcgggcatgtaatcagcttagaagttgccactctatcctaacaagtaaaaagctggacaaacggaaaaactagcaactcctcttacatatgtcagagaagtgaggatacagggcaaactgccaaaatgtgagagtggagtgacacattgaaagtgttcagggtgaaaacccaccaacctagaattctgtaccctctgaaattatctttcaaaagtgaaggagaaataaagactttctcagacaaacaaaactttagggaatttgttgccaatggatctgtcttgcaaaaaaatattaaaagatgttcttcagaaaaaggaaaataatataggtcagaaactcagatctacataaagaaagaaagagtataaaataaagaataagtgaaggtaaaataaactttttcatttttcctattctcagttgatctaacaaataatactttgttcaaaatgataaaagcaacaatgtattcaattaggtatgcttatatagttatatttatgtattttatatataagtgaaatgaatgacagcaataatacaaaaaatgggagaaaggaattagggacatttcattattttaaagtacatgcactacttgtgaaccactgtagtgttgtttgaaagtggagttgggttaattgtaaatatatattgtaaactagggaaaccactttaaaaagtttaaaaaagaggaagtaaaattaatatgctaataaaggagagaaaatgaaatcacatagaatgcttaattaaaaccacaaaaggcagaaaaaaatgtagaagacaataataggaacaaagaagaagggcaaccaatagaaaataataacaaatatgacagatattgatcgagctataccaatatttactttaaatgtcaatggtccaaatatacaaattagaagcccaaaattgtcagagtagagcgaaaacatgacccaaagatatgttgactataagaaacccagtttaaatataaagttgcatccattaaagtatagggagagagagagacatgctgtgctaagactaaacaaaagaaagtatgagtaaccatattagcttcagacaatgcagactacaaagcgaagaaatttatctggaatagaaatgagcgttacataatgatgaatgggtcaatactccaagaaagcctaataatccttaacatgtatacacctaacaacagagcctcaaaatatatgagacaaaaactgatagaacggcaatgaaaaatagatgcattcactattatagttggagattttgacatccctctatcagaaatgggcagattcagcagacagaaaatcagtaaggacacagctgaactcaacagcactatcaatcaattgtatataaataacatctatagattacttcatccaatagcagcagattacacattcttttcaagcacacatagcatattcaccaaaatagaacacattctaggccataaaaacaccttaacaaatttttaaaaatagaagtcatataatatctgctctcagggacaatggaattaaactaaaaataaataaattacagaagtgaaactaaaaatcaatacataacagaaaaatagctgaaaatccctcaaattcctgaagattaaacaacacacttcaaagatgaaatcttaaaagaaaatttaaaatatattgaattaaatgaaaatacaacatatcaaaatgtttaagttgcagcaaaagcagtgcttaaagggaaattaatggcaatgattgcatatatttaaaaataagaaagacctaaaaccagtaatcaaagtttacgtgttagaaaacaagagaaagaagagtaaattaaattcaaagtaagcagataaaagacatgatacaaattagtgcagaaataaatgaaattgaaaactggaaattaatagagaaattaacaaaagctggttctttgtaaatatcaataaaacgtataaccctctagccgggctaagtaggataagaagagtcaaggctaattaacagaaatgaaagagggacattactacaaatcccatggacattaaaaggatagttaaggaatattatgaacaactctatgcccataaatttcacaacctagttgaaatggaccaactccttgaaagatacaatcttctaaaactcacacaagaagaaataggcaatcagaaaaggattatctctattaaacaaattgaatcaataattaataaccttacaaaacagaaagcaacaggccccaatgggtttgttggtaaattctaccaaacatttaaggaagaaattgtgccttaatctctttcagaatgcttcctaattcaatctatgaggtcagttttatcctaatatcaaaaccagaaaatttcagaccaatatctctcataaatgtagatgcaaaaattctaatgaaacattagccacgaggtcaggagatcgagaccatcctggctaatacggtgaaaccccgtctctactaaaaatacaaaaaaaattagccgggcgtggtggctgcgcctgtagtcccagctagtcgggaggctgaggcaggagaatggcgtgaacccgggaggcggagcttgcagtgagccgagatcgcgccaacacactccagcctgggcgacagagcgagactccgtctcaaaaaaaaaaaaaaaaaagagcaaataaaacccaacaatgtatgaaaagaattatacaccaagaccaagtgaaactcactctaggtatgcaatgctggctcaaaatttgaaaatcaattaatgtaatccactacatcaacaggctaaaggagaaaagtaacatgattatatcaaccgatgcagaaagaatctttgacaaaatgcatgaagaaaactctcagcaaaatagaaatagagggaaatgtattcaatctgataaaaaaaaaatctaccataaaaagaaaaacccaacagctaaagttatacttaacagtgagaaacttgacgctttcctaccaagatcagaaataatgcaagagtatcctcctgtcaccactgctttttaacattttactggaaggcttagctaatgcaataaaagaaaaaaagggtatacaaattgggaaagaagaaataaaatggtctttgttcacagatgacatggttgtgtagaaaatctaaaagaattgatacaaaggagatggattagctttgggagggagaaaaataaaaaataaataaaaacaaaagagaacatctattaaaatcttacattagaatttggctgatatgaggaaattttgttctattacaaaatggaagaattagagaattatttcaggtattcttactgtgatcacaatctcaggttattgaagacttatgagtcctgatacagacacaaaagagtagagagtttacctagtatttagtggcaaataaccagtttctaaattactttgaccttctctgtttttcctctttgtatattggctattgattgtcttatagaagatacaacctgggaatcagaaaaatgtaatcctgctttaaatttcaggtttaagaaagaagaaaaaaagtgaaaaaaaagaagaagaaaataaaagaaagaaaatataataggaggctcaacctcgctctgtctttactttgggaattagatgtgcattcttttatgtttttactagaaaaagaaaatggaaaattggccttgcagccttcttcaatccttttcggtattttaaaattttccaaacatctaagaaaatgaacaaatcattatttagtttctgataggagtttgagggtttctaatttcatacacagggattcctctcctagaatgacatgtctgcacttgtatttttagtcctccaattttctcttgggaaagttggtggctagtgggctttgggatcaaatcccatttctgctacttcctacctgtgtgaccttgagcaagatgagtctcagtttctttatgtgtaagatggtataataataccttgtcattagagttgggggagaattaaactgagaaaacatataataggcatgaacactatatagttacactatatagtccaccaaatacactatataatctatacactatacactctatagtctgctgaattgctcaatttataggagactctgaagtagccctgtttattgtgtaaatcatgccacattttgtttctccacttcttaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtgggtaagtcctccaggtaaacgcacttctagaatcaagctgacatgtcaagattcagagtagactttccttctttgtcctttccttccatttccttcctttgtctttcccttatcttctttttttttcttgcctagaggacttatcattggagaaagaagagctaaggtcagccatttggggttgctggtcattagctctccaaagtcatattcccttttggtgccctttaaacatcactgaaacacaattgctaaataacttcccacatcacaatcattacagagggattagatctgccttggtccttagacaactatcgaagtgcatttttcctaagcccaaagctgaataaaatgagtctagcagattactactgttccaaggtctgatgctctcctcttcttactttagtttctccttaaatgacatatttcaaattgaccaaaaactgaggtcatttttatcagacactgaactatacttacaagatattgtgactcgccatttttgacttggatttctaccagccaacatcttgagtcttgtaaaactctttgattcagttctgcggaagttcactttgtagttaaaaacaacaaccacaacaaccatattcaacatttagacaataatttcttggttaacattttcaaggtaaggaatgagagtcttgggtttcatatggggcttattctgtaatgttgggacacgggtttaagggatttggagacatcattatttttatttcgggcaaggggtgggctcatcttcccttatcccatattgagcacaaatttttgcccaaattagttactaacttgtatgagtctgttttcacgttgctgataaaggcctactagagactgggtaatttataaagaaaaagaggtttaatggactcacagttccttgtagctggggaggcctcacaatcatggtggaaggtgaaagccatgtcttccatggcagcagacaagagagagagaatgagaaccaagccagaggggtttccccttacaaaaccatcagatcccttgagacttactcactaccacgagaacagtatgtgggaaactgcccctgtgattcaattctctcccaccaggtccctcccacaacatgtgggaattatgggagctacaattcaagatgagatttggatggggacacagccaaaccatatcataagcataattcagtaaatatgggaaagtactcagaaataacagtttcaatgattatcaccaagaaacatattttcctattaactttttttttctactccctcttccttattttactttatcctattttttgtctgccacagacttccctgatcctccagtggcaccgactgtgacagaggtgggagatgactggtgtatcatgaactgggagcctcctgcctacgacggaggctctccaatcctaggtaactgcatgttggttagtctgtgtaactgccagtacagttgtgtcctctttacgcatcttagtacagagcacattttaaagtattgcatttagaagaaaacctattttactgtgactttatgcattcaaaatgaaatatatatgttgagatgctctgtaattactcgagatttaaatagctctgatgaatatcatctgattgctggtttctttttttgtttgacatttatacacactaattttgaagcaactataagcccaacttccaccatcctagccagtgaacgtctgattctacatgattttgtctatgaagaaatttattttagaattaaataattaggctgagcattgtggctcatacctgtaatcccagcactttgggaggcctaggtgggtggatcacttgaagctaggaattcgagaccagtctggccaacatggtaaaaccccacctctattaaaaatacaaaaattagccgggcatggtggtgcgcgcctgtggtcccagctactcgctactcaggaggctgaggtgggaggatcacttgggccctggggcgtggaggttgcagtgagccaagatcacaccactgcactccagcctgggcaacagagtgagactctgtctcaaaaaaaaaaaaaaaaaaaagaaagaaagaaagaaaagaaaaaatatttaaatgcttagaagcatttgcttcccctatgccatgagaattttttctctttgctaataatgagactcacaaaactggtcatttccctcttcttatcttccttgctgggactcagagtcaactacattgcctctgattatattgttcacctacagtgactaagttgctatggctgacttaactgtgatccatttttcttctctttgtagtataattttaatttcttagtcccattattttcatctatattttatattaatatttctattctcttggaataagataggttaaaaatatttacatacatatatgactatttcacatagattgatgacaaaatgcaaaattttaaggacttctattatctgacaatgtttaatttcagagaccaaggaaaaaccttagttttcattttgcatacctgcaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttgggtaagtcaagagagatgagtctttgtcatcagaatcattgccccagagtatgactgctttctctctgatccctaactggaacaggcctggacacttcttagagttgtaggtgggcaggagcttgaaacagttaggtacaattttatgtctaagaaattaaaaagtaggtttggtcaagttgaataacttcataacataggccctggaattcgttaccataattccagtgccaactgtgggtggctctgattgccattccccactgaaaacatattgctgagtccatggacatgtgagtactttccatttgcccttctgaaggtattaacctattaatataacccagcttagtgtaaacaactatcactgaaacaaattgagatcggttcaacaggctacacttggaaactggtttctttgctttacggtcacaccttaaatgttatctattaaatcaaaaaagttagttcagtgaaggcaaaaaaaaaagatatctccattgttttatggcaatgaggtatttttttcaatggaaaaaaatgtaatacaagtttgcacttggaaattagagagcaatgggaaaattactctagatcattagatcccaaaccttgccttcttcaacttctttgggcctcccagcttcccacaccggcttctcaatttggaaaaaaatccatgacagcatttccaaaattctcacattgatcagctctttgccttacacacatccatgctcaaggtgtcttaactgaatttcattaagatgtagggcttttgtgtctatttttatttgtatccccattggttttatcacagttcctgcactatagctgtgtagtaaatagtttattcttttctgtctcttttatctttaagctgtaacaagccctcctactcttctgactgtggactctgtcactgacacgactgtcacgatgaggtggcgccccccagaccacattggtgcagcaggtttagatggctatgtgctagagtattgctttgaaggaagtaagtacaaccagtagataaaatgaatactgtcatcaataggtgagatatgtccctcccctttcttttgtctctctttcttgagaacgcatcaccttcctacgaaaataagatcaagccaaacgtcatccttctgagatgtatataaactaagcccttttttagtacttggtgcttataaattgatatctcaaaagtatcttggctaggctgccagattggacactataattgaactaagagatgggaggaagagattgtaacaaaactttggggacttccacttcttaaactggtggaattgaattgcaccacagcaatataaaagtctagttatgatgaagccagttggaaattctaaaacctataatgagctgaagttaactatcaaaagagtgacctattttgggtaataaagggagactacatatttggctagtaatcatcacctgccttcatctaaaaataagatgaattaagaactgctcttagttttaaaggaagcagcattaaatcctcgagtgtataagaaataagttcaatatgtagcagtaacttatctcaggagttggggatataaaaatgtaatcagtttaatttaggaggggaagagaaacaaggccataaatttttaaaatcactgatagaaataatagaaaaagaaaaaatgacagaagaaaatatgggccagaattacctgaaaaccaaaagaatgtgaaacttaccaaaatcctgttgtgtttcttggtttcttatttgccataactagaaagggatgacatttgaaaatggctctggacttgggttccattctagatgctggtaggtaaacaatctcccaggaaacttgttcaaattccacaaacagtggcccaagacttcacctccaggaaaactctttggacaccaaactttaacacagatcctcgaagtgaaggaaggaggttacgaagcacatttgggaaatcaggaatgtgaacgcaaatgcacctcccctggaggaaactcactatggagatgaaacttcctatgaagagaaaactgctgaaaaagaaatcccaggtgcctggattggggcacctgtggaaatgctcacctctgttctggagggaggaagaggagagggacaatgaagtatcctgatacccctcaatccctcttgcacctactccacacacagagtcctataattggtttctccaggatttaaaaagccactaaccaaaagcagtggaaacgtcagaaatttcccagggttaacccagtaagggaaggggatagtgtcactaatgcaacaagtaaattcttgagcacttcagtttattcctcttccatcctcctgcccccatttaaaaaagtcatgagcactccattctgtttttttgtattgtccagccagcagaatatcccaatcttatgtgtgatgtggcctttgagcataaaccttttgtgtatgtatgaatcgagcaaattctttactcttttctttctgataggtttaaaaagtaagaagatacagcaaaatgatagatggctgtcattttgatgttacccaccttagataaaatacaatgaagtgtattttacaaaattttgcgtgtggtctgtgtagatacatatgtatatccgtatatacatatgtatatgtacacagtcattattatgtatatattttgccgagtaacgttctggaattagctttctatgggagttctctcacaacgtgtatctctttcttcttgcagtcttttcttattttctttatgtggctgccgactcttcattctcttttaatggctgttgtcctccagactaattttctatagtgtttaatgcttttagagacatcaggttttattctgtaagagaattctttgttttgtaagatcgtgtgttgttttggactctgcctttctctcgtttttgttttgttattatttttttaatgcctgcagcattttactcttctttgttttctttctgcactctagttttttctttcctttcttaaaaattctcctcacatgttaaataacttacatgttccttcctcatcccctgggacaccatcttctttgtctgtgtttccccaattaaagtggttccaatgtgaagagatgggctatttttgttccccctctggtcttgtttcgtcctgttttctcttgaaattgtctcttttactagttcttcactcttttgtacatgttttctgagtctcttattttcactttctcatccactgtctcttgactatgaaaataccaacacagaagctcccaagcagaccatttgtttaaagatgtatctctttttcaaagacataaggaatttttattctccacatgccttactagctgccaggatattctagttgcctgtcccttctccttgatactcctgttagggttagaacaagagagaggcaaaagttccaagggacagccagtccagtccccaatgcctccactcctctcctgatactgagaaagtcatcatcccaaaccagtgggtatgcccaagaccaccctgtgagccacccatgcggaaccctgagcaggctcaatttgttttcttgacagagttcattgtcatgggaaccagaactgcctcctgagctgctggggcagcctccaattctattcagaacttggaccctggtaaaacagggctggccttatcccaagggcctgcactcccagtcttgaatgagggagccccactgtgggagcaccgtgttccctggggacccaagagaatcctcccctgctggggtggcagagacaggcacaaggatagactgtctcactgtgcgctgctcccccgcagattccaggacctgctcctctgttttcttcagggtcttgctttgttcttctctatctcttcttcccaccactggaggtgtcccagcctcctttctcctcttctctattcttttcttttttctcctcttctctgtggcaggtgcctcaggtcagaagccacagtctgcacagagcaggctgtgctctcctgaggaacccccctaacaccgtttggtctcttccgtcactgctctgaggacaaatctctttgcacactttgcatactttactaacagagaatgctgactgctgatacgatattattctggtgtgaaagtgggtgtctttaattaattttaatgacggattctcaaaggtacatcagcaaaacagtctgatgaaaatggggaggctgcctatgatctgccaggtaaagtattccgtgaagctctcaaattttcttactatattataatgtttctgggaatattgaatgaccaagcatgaagaatactcatcacatacacacatcacacacacacacacacacacacacacacacacacacacacacatccttagagatgggggagagggagcagtgagttaataatgtgggatcaaagtcttctttctttctgtgggcaaaatgcatactaacttttagatgctgaaacatttgtaagccctgaatgctgggttaaaattctctcgatgtgatacacaagctgccaaaaactttttaaaattagattttggttgcaaggatagaattctaccaactccttatgaggaatcagcccatgaactgttttctctttgtgaaataagctttttctcttcatcaatgtgaataaatatgatcaagttccctctacccatgttagtgtcttacaatagtaaatcagccaagataaaaacatattatatgactataaaggtcaatgtctcattcataaagatagccttttcctgtttttctgaactttaatgtgtatagatgactagctatcatgattgcatgaatcattataaaaccaaattggaataaaactgctacagaattcttgtggacagttactattattcaggatgctttcatgctgaataaagatttttcagaaacagcagaatcttatagtttatttttcctgttatttatgttagctattttaggctgttttttatttaatatatgaaaaatgtccacccatgtagtcggagtccagaccaaagtcataatgtctctaaatgatgtattattatgagtaaaatactaatttggagttgactgtaatggttaagatgatttttttcactaaacagcattcctccttcttttccttttcttttacggacttcagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcataggtaggagacaaggctttcaaaagttagactccattttacatggttcactttttttttcttcaaactactttctttctcaaaacctcctattttgttgttactcctttgatattttgttaatgcttcctaagagttagaacttaataaagcagctctcttcaggcaatgtgggagatcaccttcaggtttatcttggtactctgaggaccagttagttaacctctcctggttccaggagccaactctggctgggctgcctatttacagtggagagagagtatgttaatacaaccatgcaaacaatccctacgacaaccatatgcctccaatgaatctgcagggtcagaactattttcataatattatgaaaatattatgtgtacctttcagtgttttgacatcttcactgatagtataaaaatgaaggtgagtaaaactgttgataccttagtatgaaatcaagtcagtgccacggagccatactagccagccttgccttcctcaccaccatgcactcaacagatgaaataaaagggccagttttgccttagagtctcttttttttatttttgagatggagttttgctcttgttgcccaggctggagtgcaatggcacaatcttggccactgcaacctctgcctcccgggttcaagcaattctcctgcctcagcctcccaagtagttgggattatagacatgcaccactacgcctggctaatttttttggtattttttagtagagacagggtttcaccatgttggtcaggctggtctcgaactcctgacctcaagtaatccacctgcctcagcctcccaaagtgctgggattacaggcgtgagccaccacgcctggcccttagagtgttcttaatgaagcataaaaataattaattttggctgagcacaatgcctcatgcctgtaattccagtattttgggaggctgaggcgggcagatcacttaagcccaggagtttgagaccagcctggggaacatggcaaaaccacgtctttactaaaaatacaaaaatttgctgggtgtggtggcacacgcctgtggtcccagctactcaggaggctgaggtgggagaatcacttgaacccaggaggcggaggctgcagtgagccaagatcacaccactgcacttcagcctgggtgacagagcaagaccttgtctcaaataaaacaaaacaagaataagaataataactttcatcaaatcttggctcttgagtatgttttttttctagacttgtgtgacaatgaaatgcaaagtatgtctgaagtacttaggctgcacactgcagtacaatggttgtccccaggaaaagcaccgtacaactgagttggaggatgaataggtgacttttttgcacagaagctccacttttacttggggaaataagtaagaagaactgcttcatccctgtgagcctatgagcctttgactccctgctcctgatggatttgcagtgacatgctctagtatcttcatgatgtttaattaatgaatattaatacacagtgggccagggttgcctattatgtacttcaccacagtcacacagggagaaagttactgtcgaactccaacagagtcacctaaatagcaagtgctgggtgctaacattttgtttttttctggtaaggaagaatggacagtcctcccagctaatgtggtgcctatagatctttcgtggaatgttcccttgcaaatatactcactgttagaaactatgaataactggccagacgcggtggctcatgccggtaatcccagcactttgggagactaaggcaggtggatcacctgaggtcacaagtttgagactagcctggccaacatggcaaaatcccatctctactaaaaatacaaaaattagccaggcgtggtggcatgtgcctgtagtctcagctacttgggaggctgagacatgagaatcgcttgaacccaggaggcggaggttgcagtgagcaatgccactgcactccagcctgggcgacagagagagactctctgaaaaaaaaaaaaaaaaaaaaaagaaactatgaaaagtatgcatagtatgtataaggccctaagagaaaatgtatttttctataaagttgctttaggcttattacaacaataaaaatacaaagttgcaataaagccaaggatgtcagggataaattttgctgagtcaaactgttaaaacatctctgtgtggaaaccacacacacacacacacacacacacacacacacacacacattttgaaccagttactatatatcgtctgttagtggcacatctcagagtttattgcagagatatgccacaagggtacgctggtgagcatcatgccattttgcttttgtaaggctattttcagacaccagactgattgcaaaattgtgctattttaccctctctcagaacctccaaagattcgcatcccaagacacctgaagcaaacctatatccgcagagttggagaagctgtcaatctggttatacctttccaggtaagagttcaagggtcgctctttttctctttagagggctggattagtttaggaagtgggaagaggtactctagcatttaagttcatcatgattcaggatttcctcagagggagaggaggtaaataaagaatgaaagagtattggagaatgattaagcaatctcctgctgtcaaaatagagaaatctatagaaaccgtcacagattttctttctgcatgagacaaatgagatatagtcttgcctgaagctcagcgactatggtgggcagggaagaaacatcaaggagataccaaatgaagaaatgcttgaagactcttttggtcctatacatttgtaaaacccatcattttaagtgaagctctcagtgtaacattcaggaaaacagtgtgtgcttagttcccacaatgaccccaaaccaaaataatttcaataagggggacaactgaaatttgaaataacgatgacactaactgaaatatatgaacaatattaaatcattgttccagcaaaagaatctgttcttcacaaaattcactagtctttacttacaatagtcaattttggtcttatacaaatacacacacacacaccctgcacctcccaacccttactctccaactccctattcatatgacacctccagacagtgctgttcaatagaactttcttcaatgttagaaatgttctatatcaatgctgtccaatatggtagccactagccacatgtggctgttgagcacttgaaacgtgtaactaggaactagtgtgactggagaaataaatttttaattttcttcaattttaattaattttaatttaaatagccacgtgtaccttgtggctatcgtatcagccagcctggccttagaatgtaggtctctacacacatttgacactcatatacacacacacacacacacacacacacacacacacacacacactcacacatgcacacatgcacacacagagagaactctgttcaaacccaggctcccatgaaaccaaactaaagggatggccaattcaggccatcctcattgcactccgggtgcaaacctaaggagagacattgtgtactacataccccccgcatgaaatcagaatgaaagccaaggaggaagtgaagcagaacacagcccaggaggaagtgggtggcttggcaaggttcttctcactttccttctcttgcagcatcaaataaaaccagaagtggcaacaaggcaggtatgggggacccagccccaaccctgcactggggctgctgagtcagccctcaagcctccacatcgttcctgccaccacaactaatcccagttcccagatctgggggtctgcgtgttcagcttctgtcactgagtctgagagagaaaaaatcatgagaacagggaccgcatagatctggcatcccagagactgttcagcccccaggaagggagatgagaccaaagtgtgatgtttgtatatttgtgtaatctctagagttcgcaaacattttctcatttgatcctcagaaacaccctgtgaggcaggaaggccagatttccttaccttgcttgagaagggaagaaactgaaagggaagttaagtgacttgcccaatgtcacacagaaagtcaatggtagggccaagaacagagtccatggcccggtcacttaattcagtggttttttccactctgtatattattagagaacacacatttttccctagtggctaacagcaagttgtacatttaaggaaataagcttgaactgtttttccctatcttcaacaacgtcgttctctgcttcccatgtgtgagtctgagcatccccaaccactcttcaggctctgaagcaggggtttggtgtgtagctctacatctcttattataacctagccatgttcagagcccacaggaaagctgtgccttacctgacagaattcatgcttggttcctgtctgccagggtacgcctggatgcttggggattctaggaaattcctttgtaatagaaatggaaactcaggttcatgaatgggattatgatttcttaaattctgctcttaaagaatagtttcaacagcgagagggaacagagagagaattctagacaagtctaaaatgagcagcacaggacagtagaatagtaatcattaacatttagatgatattggccgggcacggtggctcacacccataatcccagcactttggaaggctgaggcgtgtgaatcacatgaggtcaggagttcaagaccagcctggccaacttggtgaaaccctgtttctactaacaactaaaaaaattagccaagcatggtggtgcgtgcctgtaaacccaagtacttgggagggtgagcaggagaatcccttgaacccaggaggtggaggttgcagtgagccaagattgtgccactgcactccagcctgggcgacaagagccaaactctgtcaaaaaaaaaaatttagatgatattaactacaaaaacttatgtattgggcagaagctttctcagcactttaatctttataaccactctttgagataggtactaccattattcccgttgaggcacagaaagcttagtaacttgcccagggtcacacagacgttaagtggtcaggagctagacatagattccagggccccagagcccatgctcttaacaattatcctgtgttgtgcaggcttttggagactaggagacccagctgggagacctggttccagtgcttacctaactgcaggaacttggacaaattatttaacttctctatccaaaaaatgaggataatgataagcttgatgtgaagattaaggaaaataatcaatgttatgtacctaaggtagtgccttgcacataaaatacagattacagctttgctgctgtaattgctcaccaccagactagaagggtggtattttccagccctgcctagaatgggttaagccactgtccttctcataatgctgaagaaacatcttgagacaatatgatttaccctctctacttttgctgtctttctttttagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattggtaggtttagatgaaggagccagaaagttctgtcaaagcagtacagggatgaattgtccttgtccctaaggcaagagcaggagttttgttaggctggctctacataaaactctttttttagatttattttttaaaaatagataaattaggctgggcgtggtagcttacacctgtaatcccagtactttgggaggccaacgtaggcggatcacttggggtcaggagttcaagaccagcctggccaacattgtgaagccccgtctctactaaaaatacaaaaagtagctgggcatggtggcgtgcacctgtaatcccagctactcaggaaactgaggcaggagaatcgcttgaacctgggaggtggaagttgcagtgagctgagatcatgccactgcactctagcctgggtgacagagtgagactctgtctccaaaaaaaggacagtaagatttgttaccatttcaaaatgaattctcaccaactcaaaggactaatcacaggagatttaaggcatatatgttcaagaaaattaatgaatgtgctttttagtgaaatccttctgcactattctataacccagctgtctctttctcttagtttctcatctccctgatgataaaattatttcttatgttgaattcttacattctagacagtatagattctagctatagtttaacatgtttcttactacacctaaaatttgctaatgaagttttcatggagaatgaagaattttttttaatattaatataaggaagatgtacctaagcaaaattgaacagttaaatactgaattctttgatcctgccagagtagttagatacgtacctgcccaaaaaataaataaggttagttcttacttctgtccagagtcaggggaatagaggaaggaccccttgtggatagactcctctcacttaaattatactgtaatttttgcaacgtcaagaaataaatttaaggccgggtgtggtggctcacacctgtaataccagcactttgggaggtgggcagatcacttggggccaggagtttgagacaagcctggacaatatggtaaaaacctgtctgtactaaaaatgcaaaaattagccagacattgtggcacacacttgtggtcccagctacttgggaggctgaggcatgaaaatcgcttgaacctgggaggaggagactgctgtgagccaagatttcaccactgcactcagcctgggtgacagaccatgactctgtctccaaaaaaaaaaaaaaaaaaaaaaggaaagaaagaaatttaagagcagagctagaaaaacgttgtttccaatcattgttatcattgtatttcagtaaatttgctgaaagttgctctaaccaaaggggcaacttcctgtaacagcctcccttaaagggtcattccctttaaactaagcactctttccccactggctaatccgttttgagttttgttaagttgcagggagtgttgaggctgctctgtgccctttgatctggcctggctccatactactggaaggcaaagggtctcagaagcccccatggtagggtctagaagagtgatgcctcctgtaacagaggaaagggtcttttaaaatatcctcatgaaacaaaatgtagactgggaaagaaagtgaccttgcagtgacaccatgaattcatcctgtagaccgtccaggtccaccccaaattgtgaagattgaggatgtctggggagaaaatgtcgctctcacatggactccaccaaaggatgatggaaatgctgctatcacaggctataccattcagaaggctgacaagaagagcatggtaaggtctggctttctctggttcatcagtagcaaaaggcacatttcatcagaggtaaaggagatggcacaagggcctcactggtaaggagccaactggggctatggagaagtgatgtggcagagcagaaaggaaaagacctgtggagccacagagctggtcttaaaccccagcattgctacttaagaccacatgtataaggaccacacgtgaccacaatcacttgagctctttgatctctattttcctcatctatgtaatgggggcacaaatatcccttgcttgattattacaaagctaaaatgatataaagcaactggttcaatgttcagtagaattcaataaactcattcattcaacaaatatttgctcaagactttgactcagatttacacccatgcaactctttctccttgtgaaataaatgttggatactgtgcacttatgtctacaaaaaagtaaaaagacagacaccagttagaacagaaagattctacaaggttacagcatgtgcaaatgcggaaaggtctggagaaaaagagcttaatgcaaacttgtccaacccgtggcccacaggcctcatgcaacccaggatggctttgaatgcagcccaacacatatttgtaaactttcttaaaacgttatgagtttttttatgattttttttcagctcatcagctatcgttagcgttagtctattttatgtgtggcccaagacaattctttttccagggaagccaaaagattgaaaacccctggcttaatgtgtttaaaaagcaacctagttggagtatgacttattataaacttattttatagatgaggaaactgaggcttgcagaggataaatgacttgctaaagatcaccagattttctcacgcctgaaatcccagctacttgggaggctgaggcaggagaattgcttgaactcggaaggtggaggttgtagtgagctgagattgtgccactgtactgtagccaggatgacagaacaagactccatctcaaaaagaaaaaacagaaccaaagttaataatatcagctgggagcagtggctcatacctgtagtcccagcactttggaaggctgaggcaggaggattgcttgagcccaggagtttgagaccagcctggacaacatagggagacctcctctctctaaaaaataaattagctgggtgtggtagcacgtgcctgtagtcccagttactcgggaggctgaggtgaaagggtctattgagcccgggaggtcaagactatagtaagccaagattgcatcactgcactccagcctgggtgacagagtgagatcctgtctcaaaaagaaaaaaaaaataataatgttaaataaatgtactggatattactaatgtttctctagtgatttagcttcaggtctttctcataataagttggcactaaaattctgtagttatactttattctacaaaagatagctaggaagacaaataggtaggtagacaggtagataaatagatgacagacacctaaaggttatgaaaaaatataaagatagtagatggcaactagggtatatgaatctaatgtgtaaatgaagattaaattacatagtcaattgcaaataagttgtgaaatattaaacaaaatatacattgtttcaacacattttaacaacatatattattactctccatataaaaatgagtggtctttttttctttttgttaataaagcatccttgttatttatcccaatctacagttagaaaaattgtatacttttaggtgattttcctccagttattatttttttttcttttaggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtgagttgggaatggactgacatttgaaaaccttggttgacagtgaccagacagagaagactggaaaaagagatgtggtgaaagggaacaaaaaaatggtaaatgtacattgtaaaattatgataatggtgttcaagtaaaattttaattttacaggtaaaatttaagtgaaattgtattattattgcattttttacaaatataggctttaattaattccaggttctaggcagtggatctataaatggctaataccccagaggctggaagaagtagacattttcttctagagtttctacttttattcttggacacctttattgtagctacacatgggacccactctgtgataaaaggagaaactaaattctatccttatcttttcttttcatcataaaccactcttcttaaaaccttccttgtgtattttcacattagaacaaatttctattcaaaatactcagaaagacaccaaagtcttctcaatatctggttcagtttcagatgacccctctggctttctatcccacgtgtgattggctatacgtttatacccctcagaatgtttgccacatggcatttgctcatctttgtccatgtttttctaagttcagggaagttttaatcatgtgtaaagtatgccaccaataatatattctcaggccaatttacataattttaacatatttgtaatgcttgtttttaaggtaaaatctacaaaaatccagtgtatgaagactttgatttctcagaggcacccatgtttactcagcctttggttaacacctatgccatagctggttacaatgccaccctaaactgcagtgtgagaggaaatcctaaggtaccatgttcttctatcacatcagttaaagtccctgtcttgtatttgttgtgttataatgtaagtaacaatgtaaacaaatccagctgctacttgtgtcttcccaggatgggggattagaaggtggtagtggtggtagattattaggcacactattcagatgtagtagtaaaaaatgcttacatttctttgctaagggattccttctaaagaaaaagcaaaccacctatttaaaaaagaacatctcctgtgtaaggagatggaagtataataatattgtttcacttggaaaattaggtggtaatgtcaagaattctgtgataggttaaagtaaacaacaatcacactacactgtctgcgataggttaaagtaaacaacaattacactacactgtaagacagaatatgaatgtgctttgataagggtacagtgtgctaagaagggagctatcatatccagttgaagagattagaaaggtttcaaggtttcatgtttgcatttgaaaagaacaacgaattaatgaatatcgcccatagagatgtacatatccctgggtgcaagacagaaagtaccctagaattgggaaaatttatgaacttctttttttcctgtatataccttgatcagaaatagggaagtcgtccgggcgcagtggctcatgcctgtaatccgaacactttggaggctgaggcaggcggatcacttggtcaggagttcgagaccagcctgggcaacatggtctctactaaaaatagaaaaattagctgggcatggtggcacatgcctgtgatcccagctacttgggaggctgaggcaggagaattgcatgaacctgggaggtggaggttgcagtgagctgagatagcaccactgcactctagtctgggtaacagaagaagactccgtctcaaaaaaaaaaaaaaaaggaaaatcaaaggaagaagtcagactaaggatgagagaaaggtgctgaactaatgtttacttggaaatgatgttggtacatccaaatgggaatgatgaggaagcagatggagaggttcacccggagcctaggagaaaggccagggctgttgctcttggtttgggagtcccatacataaagatgctacattctaccccttgccaaagctttagaaaggtgtgaggctcagtgatcgctcccatttgacgggtggaaggaagaagaagactgtgtgaaggagacagaaaaggtgccatctctaggttctgagcaagacaaaataatagaagaggtggaagagagaatgcagagggtgcatatttacaaaagaaaggagaagacaatatgagagtgaggagtcactgatatcaaatgcagttcagaagtcaaggagaatgaagtcatcttcctgggcaattgggtcattactgatcttgcattatctgattggagtagatccattgccatgggatgatgaatatagacatcagaggacagattaagtaatgaggaggcagatgcagttcataaagaattaaaaaacagtatcaggaaaaggaagtgaagaaaatcaaatgatcgtgacactttatggggtttctctgaaaaaaatgctcagcaaatatgcactctctacaatgagttaacaacatggacctatggatgacattgttttttaatttgaaagtatttaattggcaaataaaggtcatatacattcaagctgaacaatatgatgatttgatatatgtacacattgtgtaatgattatcacaatcaaattaatacattcatcagtaccgatgctgtacattcgatgcccagaacttgttcatcctgtaactgaaagtttgcacccatgtagatcaaattgaaatgcaactgaatccatttgagaagattgccctagagttacctctgaacacatctggctttctttgttagaactgttagtttgcttatttgccaagcactaagtagagtttaatgtgagaaatagtgtcaagtaaaagtctatccttctcagatgcactttctttttaagccatgctttaaaattctgtcactggctttgatggtctattaatatgccaattacagatatgttttgacctaagtttcttcaatttgaacttcagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaaggtatgacatccaatatctcacgtatagactaaagttaaagaaaatcattgaattattgttcttaatgcttattgttcttaatccaaattgcttgccaaaatgctgcagcgagggtgggagagggtggtgagggcaagggaagcagggagggaattaagggagagaagacatttttacatcctgcattcacttcactttatttgtggaaggctacttgttatttaagtcaacttatttttatcttatgtgatttgtgctaagggactgttaatttcagtggaatgttagtgtgtgtacagcatggtaagaatgaaaggggctatcactttggtgacataacccatctataaatagaagcctagtgtaaaaatccatctattgaaatgacagttgagtaatctgcactatttttaattagtttactattttgtaaagtttgttattttctgatatttatagaaatagttttgctaattaagtgtttgatattacacatatagaatatagcatatacatattataacaggctgcttttcaaatctctaactggagaacttccatttataggtatacatttcatttatactagttttcaaagtgtagcaactaatgtaaaccaagaaaacacataaggatttatgcggttgaaaagcataacctgccatcttaatcaattttcaaattaatcaactaccatttttatgctgatatttttctttacaagcagaacctactttgggacaccatgaaaaccccttcaaagagtcaccattatgagataataggtgacatgatcctaatgtgttttctctcattcttaactgtattatattgccattctgtaataaccaaaatctttctttttccaacctctctataatgaagaaattataatcaaaaactagtaaatatctattttagaaaatcatagtaaatgcttgggtatttatgttttttaaaaagagtcttttagtcctaaatctagtataaatatgagagggaaacttcttgaacaaaataactttcatatatatatatatatatatatatatatatatatatattttttttttttttttttttttttttttttttttgagacaaggtcttgctctgtcacccaggctggagtggaagggtgcgatctcagctcactgcgacctctgcctcctgggttcaagcaattctcgtgcctcagcctcttgagtagctgggattacaggcatgcagcaccacacccagcttatttttgtatcttcagtaaagacgggtttttgccgtgttggccaggctggtctcaaactcctggcctcaagcaatccatctgccttggcctctcaaagtgctgggattataggcgtgagccactgcacccagctgctttcctcttacaactttttaaagctgtattctttctttcacaattcataattgagtgaaaggaaaaagatttgatttttttttcctcacaaatataaggcatataatattcttagaaaatttcaagccttactattgagataacccttacaaatttaaacatttttagctgctttattggctttaaatgattaagttcataattgcaagtcatctggtttctaaactgctagccttattagttccaaagtattgttgatgcttttgtttcaatatccccccaaaaaacaaaaactaaaaaaaaaagtaccacttatttatgctttgaaactagctgaatgttgttaatgatataaaatgatgctttaacaaatggaacaatatttggggccctccttaaaagcgaatagtattatacatatacatgatatattctttttagtgaaaatgtagtaaatggtacagtaattaaatttgataaaaagaataatgtattctagtacataagttcgtaataaagtatcaattgtgatatattgataaaagcttttggtcctaaaagtaaagctgaaattgtttatcatcagactgttactctgataataggtaacttgaatcaagttgagttgtgaaaaaaggtaagaatgtcaactgagaataaataaatactggtacaaatattctgattctgcagtgatatatcaaggagtaaatacccctggacaaccagtcttcctggaggggcagcaacaggtttaaaaagtttatatcccactggatattctactttccgttccattcctcttacatgaaaatgcaccttgcatgtaaagcttgactttctcatttgcttttaattgtaccccttagcagctcatggcatacagtgcttatgccatgaacaaggaaggccaaattattcaaggatattaagtaatgtagaaactaagttttgtcagaaagctacataccataccacaagtctccatgaataaagccagaaagctacatttgaagatgatctcgttttatataataagactatcaaaacttgggtatcaatatttctttaatattttcattttttaaatgtagagagacttttttaaagatagttgacagcatagtttccttacattcatgatgcaattcagagaactgaacatttcaaacattttttttgatgttctgagcattttttatggaaagaggatacaaaaatagatccaatatttagaggctgggcgtgatggttctcgcctataatcccagcactttgggaggctgaggtaggtggatcgcttgatcccaggagtccaagatcagattgggcaacatggcaaactcccatctctacaaaaagtacaaaacttagccaggtgtggtggcacatgcctatagtcctagctacttggagagctgaggcaggaggatcacttgaatctggaaggtcgaggaggcttcagtgagccaagatctccagcttaggtgacaaagtgagactttgtctcaaaaaaataaaaaataaaaaaaataaattgggaaacttacatatttaaaatattcccattacaaattcacaagtagaatatctgtaacccatctatctgttgaagattttggacattttcatggggactcaaattatttcacgtttatgaacttaaaaggaaagaaaattccaggctctattacaaaatgtatcaagcaataaatgagtactatcatatatatgtgattcacccccatttggaattgcaaattaagagttttttgcagctgggtatgcaacctgataaaaaccctgataatgtagatctatgcctgagtttacaatatttgttttgtgagtttccagagataataacagctttcaaaagaggaaaaaagtaaggttcttttttgaaagctttgtagattgtatatagaatagctttgtaacataaggttttgtgtctatttagatcagtcatatatattccatgcagaatacaatattatagaatacactagtctaatatttgtacttgataattttgccttttagaatttcaacatatatatatgtacactaacactttgtctattgtctatgtttttcttttgttgaaaaacacgatatatatatgttgtagggttttggtttttgtatttgttttaagctaatggtttggaagctcttaccatagatattcactatacaatcagaatgactttgccacctattcaggcaaagtagttgtgcatattaataaatgttttacatattaatgatccttttgacgtgactggatccccacccttcatttcatgtgcttctattttcctacatcttttacatgactaaggattaatgaaatcacctcttcataatcatgaccataatttcatccaacaagtactcaagtttggtgttagcactttattaatgcttacgacttctctctctctccctctttctcttttccttagtcattgcacaataaggatttttgaatgtataatatcatctaaggtaagctttcatatggttttggcatatgaagcttatgactgtcataagccataccaagcctgtggagtatggcatgattttcattacataatccaatgaaaatagacttattttaaatccctaactttgtagttttaatttgtatttcactatcttgaaattaacagctagtacttatccatcacagcagtctcctactgacatgaagcaagttgttgaatgcagtagagcatgaatgaaagcatttaatgtagacaaaaatgggtgatacccaagcattctgaattatttgcatcaaggaatggacatgtacataagtggcatcatttctaccaatatgtgacttgagttgtttttttaaaaaaaggagaatgactttctcaaatttgcattaaagaagtttttaagaatgttcaaatggcatgctgctttgtctggacgtgaatttattagcaagtagtaaagcacttcactaaaggaccatgaatttttgtggtttcatggattctctcttgaagggtacttttatttttttaatataattcagaaactcagaaggtaggtatgaaatattggtaggtgtttctcgcaccttcagaaagtattggaccggtcttattattataattttaacaaaatatttccaatttttgtgcttttgacatgcataaatgaccaaagttaaagggagtagtttttatcttttctaatgtgcttgaatcgaaactctctgtgcctaattaaaaagaacattaacaaactggaagcagatcttcccactgatccataatgtggtatgcatttattctgctgttcagtcagaacatttaaatcatctatgaggaatcacaaaacctctcaaagagcaataaatactttccaaccacttgggaatttaaatgaagattgaacaatagtaggggaaaaactgctgtggttctactgggaacttgcttttccttctagatgccaagtgctttaaattctaaatgtactaaatccaggagaagattttccaagtagagactgaatgaatctttgtaactaatgggaacatgattagtcacatttccaggcagctagtcaagaagtattgtttcagcgatttttcaggtagatggttttgatttgtctgttttccttttggtcctctctaggtgggctctccttctgcagactcctcttgcaaggcgtacctccaaacataattgattcatatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagagaaaaaaaaaaaaaaaagtttgcccagattgcttaattaaaaattgcaaacaaaatctcatttgaagtcagcactttggtcattattatctctgctcactgtattatactttacaaaaatgcaagtcatagaataagcaaaagcagttatttttgtttacatagtaggctataaatgctttttttttcctctcagagtaaaaaacataacacaatgcaccacgactggatcttgaaaacccatctttctcttgatctagtagatttttctaaccaaagcggagttgttgatgtcatacaggcctgcttcacaccaggatctgtgcctttttcttcttatttgaatgcaataaaacatttttaaaagtctaactttcaaacaaattttctcagtagaagggatggtacaacaaatctgaagtgtttgtgatgaaatgatacaatatgcattcatgcatttagggttgtatgccgagacacaaaactgaggctaaaggctgggagccagcatgcccctgaacccaggtctgccctccctgtgtctctagcaaggcatcttggccaaatctgccagagcttctgccaaaacagctagtcatagtgacagagggctgttacagacaacagacctattacagagttagggtttgctgatggtatccattcaatttgatggaaacctttattaaaaaatctagcagctgagaaacatttatactaacccataatattttcagcaacttcctttactcttcctgatataaagtttcagttaagggagtagaatcgaactgtaaggtaccacagtattactgtttattccctcgcctcccctctgtttttctttttggtcttttgttgcaggagctaaatatattgtgacttgttggtgggcccatggcttctttggatgacattttaaacatatctgctcttttttctttccagattttagctgggaagttctatggtggtcatggatctgggttgatgttgggctcgtaaagggaagggtgaatgattcaggtcgttgcagtacatttgagaacaaaagaaagtctagtttatgtccaaactatgttggctctatatatctctgttgaaattggttggtgatgttgccttactggttgttaagaacattggctatcacccctgctcctatgctcccaaaaactccagaataatattgtgtgcaatccctgtgtaaacaccaattttattttattttatttttattgctataacccattgtttttttatatatatatatttttattatactctaagttctagggtacatgtgcgcaacgtgcaggtttgttgcatacgtatacatgtgccatgttggtgtgctgcacccattaactcatcatttacattaggtagatctcctaatgctatccctccccgctccccccaccccacaacaggccctggtgtgtgatgttccccttcctgtgtccaagtgttctcattgttcagctcccacctatgagtgagaacatgcggtgtttgtttttttgtccttgcaatagtttgctgagaatgatggtttccagcttcatccatgtccctacaaatgacatgaactcatcattttttatggctgcatagtattccatggtgtatatgtgccacattttcttaatccagtctatcattgttgggcgttccaagtctttgctattgtgagtagtgccgcaataaacatacgtggtaaactccaattttaatcaagaaagctacgtgcacagtattggttaaggtattttaacataaaggaagtctggctcatctataaagacatgaaaaccttatgtctatgtacaaaccaaagaaatgacaatgtggcaaacccaatcaacgtggtccctgcagcccagctgctgggtcttagccatagtgcaacagctgagctggctgcttaactcaaatactctgagcactttggccaagacatcggccaagctagttaggctgcttatgtgtgtatggttttacatagcctaaaagagactgtaaaacctccctgctgaattttggttccccactta

SEQ ID NO: 13394 - DNA, 82178 bp, Human
  misc_feature (1)...(82178): n = A,T,C or G
cacaaatcaagtgtacaaagagagcttattaaaggaagccacggattattattaaatgcagggattactcacacatctgcacatgtggataatccctgcattaagaataatccagggccacctactaggccacctcttgatgatacctcttagtgtgctctttgggtcaaatcccacccactgaaatttcccaacatggtaccccaaagcctctcatgacacaatctgcctccctcattttggattttccaaaagattttactcccctgtcttcccagagaatgtgtcactccctctcattgtgcactgttcatgtttttaaaagagcacatgcccatcatatgactgtgaagttttcctctttgtctctgacattcagctgaaagcccctgaagggacttgaccatatcttattcctctttgttttcctagggatgttgtagttgggcacatagtagagctcacaaaatgttgctgaacatagtgcaccattgacacaacataattccagatttctaactttgatttctgaaaggtaaacattgctacaatgtattaaccacacagaagactcaaacaaacccaacccccttccaaacaaagcaggtttgtttgttttttgttagggcacccacttctacaaacaaatttctggccccaggataacacaaagagccagagtaggatttcaagcagaactgtgttttcagttgatgtgtcagtcccctgagagtcatgcggaaaaaaaaaaaaagaaaaaattcaaggtccaggttatttccaccactcctgggaaaccaggcctggagagctctctagggaaagaggtatgtctgctctgggcttttgcaaccttattttataattcactttcttatctactgcttcacaaaaccaaagggaaataggtacaaactgtatcgacaaaagatcagaactgaattctcaatggcaaaggcaagtgtacattataaatagcaaaacagctggcttggaccatgttgccggccagtcacccagttgagggatttgaatgacatcataaccctcgagagggtattgctagccagctggtgttatttagaatacacaaaaatcagagaaagaaaacacactctggcacacagactccctctgtcatacacacacacacacacacacacacacacacacacacacacaggtttgagttatatggaaaattcaaacaacaggaaaattgtttgccccccaggtacccttctcccagagtggtggggtggggaggggacagtgacaggcagcctagtagaagaataaagaaaaatgttctatttcagttgggttttacagctcggcatagtctttgcctcatcgcaggagaaaaagtatgagacagtgccctaaagggaccaatccaatgctgcctgcccctccataggttctaggaaatgagatcacacctctcacttggcaactgggacaaggggtcacccgagtgctgtcttccaatctactttaccccagtcacttcagggttaaaattgtagagtttgctggagagggtcttatcgtcctttctttctttttttgttttaaataatgcatttgctctagaatctaaaattgctctcccatcccccatattcctttaatactggtaaggtgtattagcagacgtttgtgtcttcatgcccagcagaaagttaatcagaaaacagatccttattttctatggcagcataagtattttaatgtctgcgaaccctgtcactaacacacattcttttaagggaaaaaaatgcttctgtgctctagttttaaaatgcaaaggtatgatgttatttgtcaccatgcccaaaaaagtccttactcaataactttgccagaagagggagagagagagaaggcaaatgttcccccagctgtttcctgtctacagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtaaatatttcttactctttgaagtcattggggaattctatttaaattgtgtactgtttgcttctgcctagaactgttcttcactttaaaattttcattgtttcggaaccgagagttatttataaattgctgaatatgcaattctgtggaatctgaaaaatagctcggggagatggatgcatttgcacagatatctgtatgagtagaaactattgcaaggtacttatgctaaatcctccacttctgcagggcttccgtggtgtcattacagaagattcctttaaatcctctctatggctaagggctatagagcatggatatgaacttggggatttttttttttcttttgcaggtgcagatgttttatttttaagaccatgttcttttgcatgtgtgtatgtgtctctgtgtgtatgtgtctctgtgtgtgtaactcatcaggactttatttacaaggcatgctatatatgaagggttgtattttagatgatattaaagcttttaaatatgatctttggagctaaggtcccggaactctgcacttatgcccagagagagtgttaaagttagagtaaagtgtaatttgttcttccaaaaaagaactccttgacaactcttgctgaccttgcatatttgtataatttaaacaaatacatactgtatatggaaagcagaaactttctaagagctgcttgcccaacttttctgtttagaagaggactttcatgggcaaagtttggacttggggttctgtgttataaaactctgattttatattcagtgtcgtgaagtccctttaggtaaatctggctgctgctgtcagtgcaccgacttctcgtttccgattgctggccgtagttctagtttccattctcagcaaaattatatccttcaagacttgtgtttttttttcaatttgcaagcgcttttaagctgctgtcactggctccaccgattcaattgcctgagggctcaattcataagacgtctctgccacttagtgcagcattcagttgctgctttcaaacacttcaccactacgactttccctagtcaagtaagtggctccaggagttaaagatacacccttgtcaggcacctgattctgctgttcctgagatgccaacacatgcaggccaccttgctttcaaagaaatgacgtcactgtgcatacatactatgtgatctagcagctggagtttttgtctccttacttaggggatcataaaagaggctgtggagcgttatctctgcattaattacaagttaagaaaattgtttccaaatgcacttttcatgctgtgtatgctgaacacttcagaagtggagctcttaataagttgttacttttttctgtacttgaagcaggaagtggtttgagggagctgcgtggtctttcacatgtaattcagtgggtaaaggtgtcctgcccagaggcagagctcaccagctgattgtactctgactctcaaggtatttccaagtgagtgagtcgggggaagggagtaagggagtggactggagcttgggtcactatctgggctgctacaataggcatacaatggaaataggtggcttgactggggggaaaagattgacttaaatcccagctgtgcaatttgttcattgtttcaatggacaaaaggcagtttacccaggctcataatagcatacctgcctgggtgtccaaatgtaactagatgctttcacaaaccccacccacaaagcagcacatgtttttaagacttcagttttctattcacatcggcctcataatacccaccctgacctgctgtaaaagacctggaacaaacaaaaatgattacacctacagtgagtattttcttatgactgttgccctcaaattttacagggcattttcattgtggcccagacatctggaatcaattaatattccatttatctaagattaaaaaaaaaaagaacttttaaaatttgggtttgtgaatgatttttgagaaagtgttttctgatttttttttctttttttctcatgtctttctgattcttcccttttttttctatcatatctttcctttctctctattgatttcttttgtgtttggcaaaataaaaggccaaggaaataatgaacatatgggaccacttgtttcacactttaaactcctaagcaagttcggtattgttttcatttgtgggaacataaaattctctggttctctgtgggtgtactggactgttccctacactaaaggaaaatgcactagaggttctgtcttgtcctagaactgtaagtactgagatttatctgacaatataactcagcaaaaaaaaaaaaaagaaaaagagaaatctatttaaaaaaaatcttaaattcttaagttccagagacttatatgtatcgctgcacttaaatgtgttatactagaactattaaaaatatagttttgacatctaatgaagtttgaaattcactaaggctataacttgagtaatttttttccctggatttcacaaaaactgaagaacttgaaggcatctacagttgcaggtgcttagccttcagcattgctatgaacgcaacaaagaagggaggggtggagaaataggattcggtagaataacatactttctagaactggcccattcccgcagtgtgggggtatgctctgcaagatcaatcacaggtttgttcttttgaaaaatgccacgaggtccaggtgggttggatttgttgaggtttccaatggaaatattgaacaggaaaaccccactaattttacaaccaaaaaaaaaaaaaaatgagaactggatgataacatgcttcttccagtcccagtgttttgggctatgtagagggtggaagatttccatgcggagatcttgttgagaaaaatgcagtaaatgttcagttgagcttttacctcctcttctattttatgtccattatttatgatcatttgcaaatagagggcgcttttcatcttcaactgctttacaaccattaactgaatatttatattttgttaacgagagacaggggttttggttttttttttttttcctcagttgctgaggtgaaggtctgactacaaaaaatggaaatcatcattagaatgatggggaaaattttgccactgatatagagccactaaattgagagtccatggagggcaaggagggtagtcagaaaataaatgactgtttctccaaaagtgatggggttgaatggacctgccactactctgaggttcaaaaaaaatgctcttcttataattatagcttccagcatgactccacaacccttttaatagcgcccctcacctaacaccctgtcagggactcttcccatgatgctgaaagtagatgcatctgagagaagtgaagccactcaccttgagaggcttcttggaaaaagccacatctttgtgccacaagtaacaatatggaaaaacttaatgatcatcttagcatggtttctactacttagagtgaggatgaagacttgagccacaggactgctgcttttggcaaggctgccgtttggcagtctatcattgactaagtcatgccaaccaggggtcccttggtatattttgctataaaatagatacagtgacacataagtccctccaagagatgaagccataattcctgtgactaaaaataaaataaaagatttttgccagtttgagcccagtgccctatacacagaagggattctcaacacgtgttgatttgatattggacttgaggccagggactttagaatacaggagtggtttctatttgagccaatttcattcttcgattctcatatttttttctgtttctgttattttcttctatttgtggttgtgtcaactgctgatatgccccaggtaaggaatcagtctctctctctctctctctctctctctctctctcatattgaggaaacaaaacaaaaacaaaaccctgtgatgatatatagtattgtcaaaagccattttttggccatagtaaattatttttagtcaaaaatagggaatgatgttttggttaaaaatattctgctcaataatgaatgcatataccatctatggatggccaatattgagagaatttaaattaacaaaacttatttggccccaaatctgtactgagcacaatttaacctttgataattcaaaagttctaccagggtctcagagtgatatgggatcccactgtaataatagcatctttcatttccgtagtaaacgtttctagatattttgtctcaattcattgaaataggaacccataaagaaagggttcagggaggactcctccaaagatccacagtagccaggggaataaacacaggttgttggatgccgagacacgctccatccacaactccctctgggttctcatgtactctattggcttctgtgctgggtagtcctgattaatgacagtcgtggaatcgtgggagtcaatgcacttctgtcccaccccactccccttgcaaggatcaaggaggaaacctgaccctccctctgtttcttgggcaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcagtaagtagccctccctctcaatgtgctgctcaagtctaaagtgtacagctctgtggatttacaaccgcagggagtgtgtgaataactgaatgagtgcccgtatctggcagccatcctaggcctctgagattcctcaccttaaagtaagcatagtgttttggcgggactttggcaggttttgcagatctaggatggaattttcctccttaacaattcgtctttaactacttcctgctaagccttctttcaactattatgatccacctcactattccattcctttcaatgaaaggacaggacaaaataaccctgaggtattgatgtttttgttttcaaaacctatgggcgcacatataaacatatggaacacatgcagggctgctttaagtgctatgtgatttggagtaaaatagtaaggactctccagtcatgtggatctgggaaaaaaaatattaaagggcatatcctagatgtctccattcaatatgaaatcaccatgaacagacagaaggttaactccccttaaaggcaggcctgtttgcaaatacacagactgtctctaaatgcaaactgaaatgccatactgatttgccctctatgccacttgaccttgatttttttgttgttgctctcttttggcatagttcttctccgggacccatcaatgatatcaccatctggaaaagggtctctgacaagtacagaatcacttatctcttaaatagctcttaggtgattagaaagtcaacagccagtaaaaagtagacagccaagtcaaggcgtataaataatacacacaagcaaaagtcaatgattcctgtgggaactgatcacttaaagaatctagctcccatgcatctatctcactgtatattataggacagagaaagatttaaagccagatgcttgttccttataattctttggagttttagagagttccaggaaactgagcatgagtcattcttaaaggttcatatcactccagtgtagacagcttacctcagttacccactatgctttgaatagctcctgtgatgactcacacacttgaagtctctctcatccttcccaaatgtcagcctctctctaggcaggtggggtatgtgtgtgtatgactggcagggtagagggtggcctgtgtataccagtctggagatcagtaagggagatgggaagaaagaggcttgtgagggtattggcgatcagtacttacagtggatttggcaacaaatagtttttaaatcactagtgacaaagaatcagaagtgccttctactatttgaataggcaaattcccactatttgcttccagccagtcctttaattgaacgaactcatttatttttctggcaataaagcaattctatccagttctctgttgcagagcagatgaatgagtgcattgggtgagtgattttccaatagcagacttgttttacctttaaaatatcctgtggaagataactgtgggacatcacatgatccaacagtgggtcataattattctataatttgcagctactgatcctcattttttaaagaaatgaaaaagtggttctcacttattatgcccaaggggactttttttttccttgataatccatttgtgcaatttcctttgatccagttcactaggtaattgccaagcctagaagtgtcctctgttacgtgccaggttgaattgtgatgttcaacacgacattgctccagaatttccatgcacagtgcatgaaaactggatctttctatgcctatgatgtttgcattaaatgatgaaaaatgagaatggaaaaaatgattgttcctaagtaactgtatgatacttataagtgtttgcacagacacttaaggatattggacaactaaaatggaaaccaatttccaggttctcttattctgttactgcaacaatcaaatttcagcaaatttttaaaaattgtatctcaataacttgaaaaggaaatgttatatatagcaaatcttgattcttactatatgactttagctagaaagtggctttgtaaatcatatgttcttgtcagtattgtcattgaaaatatgtgtgtcatgagttttgccttatagaattccatgacttatgttaatccgacataccctcatgcacagaagtgtccaacataccttcatgcccaaaagtattcttgctaactttctagtcaactggacaatcttatttgcccaaaagaaattagtccatttagattattttcatgtaattcaaaacattgatggagcatctgttatgtgtaagcattgaatgagatatgaatgagatgcctagaaatgaatgagagattgaccttgttttcaaggggcttacagttgagtggtaaaagaaaaatgcaactaagtattattgtcataagagaaaaataaccatggagaataaattatatcctttatgtttttcttgaatattttggtctaccctgccaagaataataccctgtcaatgggcttcttgatgccaaaggacatatttatttacatttgaatccaagtgtctagctcatagcctggatgctatagtagctgcccatatttgattgttgaactgacaggattgaattgaattgaattgagtctagttgaatccaatcgaatagaatggaattacttgtttgggatcttggtcttaagaaccatcaagaattaaggttgtcaagtactgtggacaatacttctcacctcatggttatctagttatttaataaaactgcttttatttttttttgaactgaaaaaatatatactaacaatgacttagaggctgctgcattttggtcatccccaggctacattgatgtctgttttgtgtctgagccaattattcctacaggcatcaattgttgtcaacaaatttcattcagtttccttttcatccgctgagatttactgtgtgtggagaagtcagctctaagcacatagtctttgaaatactttttagagggaagcattcttccccacctctatacactgtcagttgactcctattattctctttacacttattttcaaagttttattgtggctgtgacttttattttaaactgcttcaaatccattttggaagtacaatttttttagtagtagaaggcagtttctgattttagtttgaaattcaaacatctaaaagaaaattgcctccatatctatcatttttgtcaatctgcaatatttaacaaggagagtttttttttaactctattagaactgttctgaataaaatattttgtaatgcttactgtgtgtagattgacccaatgatgtgaattgagctcatattccccttcaagcccaagttccactacagcaagtgaaagcaaccttctagattatctgtttgtgaacattatcccatcataaatggaacagttcatgtataattaatgcagcttccctagacattttatgaaatgaaagacccaatgaagagctaattactcattctttcctatgcatcatagggaagataggagagcctatcagccagccttgtgttcttgcagtcctgtgagaaaaatggtggcataatggagatgaaagcacattgggaaggagctagcgattttcttactagattgatggagcccttataaagggtggctcattacaacctcattttgcatgaaaaacaccaagagaaaaagagcttcaaatgaaataggagaagtgaagcttaccatagatataatttttgacagccatggtgattaaccattttaacatgctgctatgggcctgtggaatttctctccttggagattcttaaaaaattgacagacaaccaaccatcttggatggtttcaattaagagcaactgaaagaaagagagtttctggggtctttttaagttttaagagtctataaacagtcccttaaataaactgtatatgctttaccttggcggtctggggaaatggagaagtaaatcaattagaaaagccaagttggatattctttcagctcttcaggatttatagcttttgtaaaacatacttccaatgtatagttattaagaacaggtctgaataaacgaatggcattcttcatgggttaaaacagactgttttgtaagagctttaagtgaaactttacaatgaactttcattgttattgattgcaacaaccttcttagatctaggttattattattaagtcaagcttctttcctttgatatatactgcccagaaaactactcccagacctgtcgttcattagttgtaggagtttggcaggcatttaaacttcctgggtctaaacgtccttgtccatagaacaagggaattttattaaaataaatgacctcttctagctttaacagactcatagtctaggttgtatttaacaaagctctggtgctattcaagaaagaacaaccttggatttaagtagtgaccaaataacatttagtctcttttatcttatttacatagtttctgttggtccccagagataggagattccacccagttaaagtaagaggagccagattcttcgttttgttttgctttaagctggatttcaacccctcggggatggaatagaagcttagatatgaccaaatacatgcaggtcttttggactaaggagccaaagaagcacacgcttcatgaaaacagactgtcatttttctttgttaggatagacccactgacagttctcatctttacattctctcactctcctgactgtgaggtcaagtgagtatgtacatttttagatgccctttattaaattagaggggacaaataagaatctacaggtttctaaaccttcaccaaaagcctcttcccagcctattaccttttcaattaaagaagagagtgtataattggtgaatttgacatcacactcacccaccattagcattgttttgagtggggctggatttgagttgcatcattttcattccttttattggtaccccttagactgcctgctatgcatctgtgtgacagctggtcaaagttaggggtacagtcactagctgtgggaaagcttttctctttgaaactaattggtacatgtggggtttgaccttatgaccctggcctcattagtaccactaagctaataggctacagatattattaaagagaagcaatgtgtttttatattgaccccaaatgcttgttcctgtctttaaatagtaaaggaccagtttctgcaaccataggaccactaagaaaatgatgcaaaattagaaaataatttgcatttttttctgacatgctaatgcccttcaagaccatctccctcctgatggagagttataaacaggagagcgaagggttcaagaccaagggcatggcctctattgccaaacacttcaggtttgaaccccagctctgcaacttacttggtgagtgatcttgagcaagttatttaacctgtttgttcctcaattttctcatctgtaaaatggggcctgccttatagagttggtgttaggattaaattagttattatattggaatatgttaacttagaatattgcctggcacacagtaagcaccacatatgtgagctattacacttaattattctcttctgagatcaattgcagaatctattgccaatgctgaggtatatgaacggcccaattaattacacactcattttctctccttggcggcagctgattaaaaacctattatgagtagtaagaattatgtagtagtattagtaataatcacatgaagaatgttatgtttatctagtatatttactttttcaaaatccagttgtatcagctctctcactttgtcttgactccacttttggtgggcaaagattattgcttcatgggacaaatgagaaatgtgagacatgaacattttgtaacttaccccactgaatggttccagaaacaaagctaggttctcttgcctccaagaagtgtgtagcatagggagatgcttccaaaatcccagtagtcttctgggagataaggagcaagaatcccagggtgactaaattgattttgaacactttcttgaaaagaggcatgagagagatatctatgtaatgaccctatattttagcttctggaaaaattgaggaaattctaagaaaacttcctcaggatgcacaagaaaagtcttcttttagaagaggctaattagaggctgctgctgtacaagacccttcacagactgaattcagacagaacactgcaactcacctgtatacaccaggatatgcagtaggatctggggagcttctcttctgcccaacttcaaatcttcttcctcttcctgcaaacctcaagtgcttcattacttgcaactatttgtttaattggtctttctcaaagacctactaaaaaaatgctgtttaattggaccaaactttttcttggggtgctattagagtcgtagtaatgggaggtggtcacagacaccataatccaggcaggaagaaacttccccaaaataaaggagatgtgggagcagccagtggttgggatgcaagaccgccacctttgctggtattactcaacgagctgtttgaagaccattggtattgaaatgtatcctatctccagtggctggtaggggagacattttggatccaggagagaattttggcattctgctaattcaatgggcctccaatactttgaccagacatcttgtgtcgtgccatcattgcccaagatctccattagagctgacttcatctcttcagcagccttccttctggttttacagcccacaccacagattcagacacagtgaaaatagccacaaggtctctcccaaggagatgtctcattgttctcgataacagcctgcaagggctttgctcttttgtgcagccagacatctttgacaacccatggtggcaaaaaatcgttttcgcattgagctgccgccctggcagagttccatcgtacacctctccatgagacatcccaaagaattactttaggttgcctggaaagttcaaacccccaggccttattagctgttagactaaggagatgacaacacaacattttgtttgtctttatctatacatgagatcatgtttaaaacatagcaaagaggtgttatttgacaagcaattccctaactgcagtaagttgtatgcctatttaatgcattgtttagtctcacattggctaaagccacttaaagaagcacttggcaagctctagcttttcattcttggcatagctgcccctcttactttttcactgaaccttaaataccaagaaaaacccttcacttactttacatctggcatattgctttctgcaactggccagaacctttgcatgtggccctctgcatttgtcctaaggtaattaatggctttgcaatatttgatcatcagcagcacagacacaaagagaaattgtgcaaccagcagagaccaaacagcctcttttaaattaaaatcttttgcattaaatgctcaggcattctgcaggaataaagatttccatgccaaaaaaaagaggggtcaaaaagaggggaggaaatacccaagaacctgattattgattaagtatacatctctgtaatctctccctcttaaaactacccgattgttcaaagaaaataaaattgaagattgctacaaacttagaagtccttgaaaaataaacttgtcaatattatgcaatctagtcatgtatcaaaactgcacttttaccccatacattcatgtacatgaaaatgataataataagaattagccaaatgctgactgaaatccagagagaagtgacatgtgcaaagtcacacagctaattagtgacaaagggagaagatactgtgattctcttttctcatcccactgcagtattcctccatttagcaacaattagccatgtctgtgtcaaagttacctggtaaattaaaatgaccaagagaagccaccaatcaaattcatccaaatgagcatagatcttgttggttccttcctttcaataaattcacctgagacttaggttaacacttttgctccctcgctgtggaaatttgtacaaactaaagtgattccctgcctgtctcctatatggtgtgcaaagccttcacatgtactttgggcattccgtccacttaaggtcataatttgactattattgtatattatactattctgactctatggtcactctctccaatgtcaactttggtagaaatgctttggaatgacttagcaaagctgcgctcctggaaaatctgaaacagtctgacgagttgttggatcagctttttttttctggagatttctctgactgtcccaaaccaaaagaaatttacacctgatttttttgcagactcccaagcaaatactctatgaatctcttctggttttcttctttcatctctggtctttatgaggtactaaaaggctctttgagggacccttttaaactttgaaaatttgtcagacatagaagcaatccggagagtattgctgggaagatggtactacctctgtgccatttaccctgatgaaatgggtctttcatcagaggcaagtgatttagaaagtctgcactgagccaacccacatgcagccaactcctgattacctgtaaaactggggaaaggagcaccaagacttagaattctggattaaatggatttaaggacactatagatttttcttctccctccttgctgaacctatccccaacctctttatgagaccaagtgatgtgggttttttcattttggtttttgtttttttgagacagggtctcagtccattgctcaggctagagtgcagtggtgtgaacaaagctcactgcagcctcaacctcccaggctcaagtgatcctcctaccacctcagcctccccagtagctgggaccataggcgcatgccaccacagctggctaacttttgtatttttttgtagagatggggttttaccatgttgcccatgctggtctcaaattcctgggctcaagtgatctgcccgcctcagtctcccaaagtgctggatttacagtcatgagccactatgcccagactgttttaaaatcttaccttattctcatactcctcagtcaactttccccaagcgccattggcaacagagtttttcagcctcaacactattgacattttgggtcagactattttttgctgggagagggagctgccctgtgcattatacgataactagtaacatacttggcctctatccactaggtgccagcagtcccttcctcccagtcacgaccatcaagaatgtttgcagacattgccaaatgtacccctgggggcaaaatcacccccgagtcgagattcctagactagacaagtctccagaagagaggcaattagagagattggaaaaccatgagtgaaagtaacacatcaattctcagtcactgtttaatccagagcctatggtccattgcctggagcaagccatgagaagagtcattgtggttttgaaagcttttctctgaaaaataaaagttcttcctataggctatttaaaaccttttgcaggccttttctttcttgccttatagccatggaattcatgtattttagtaagagaaggaagggcaggcagaaatggttcagagtagaaccctgtgcttagaagtttgattgagaccacctggagcaaattaaaaagaagttggttatctttatttatttatttatttatttatttatttatttatttatttgaaacagagtcttgctctgttgcccaggctggagtacagtggtgcaatctcggctcactgcaacctctgtctcctaggttcaagcaattctcccgcctcagcctcccgagtagctgggatgacaggcatgcaccaccttgcccggctaatgtttgtatttttagtagagacggggtttcaccatgttggcctggttggtctcgaactcctgacctcaggtgatccgcctgccttggactcacaaagtgctgggattacaggcgtgagccaccgcacccagccagttgtctttgaccttaacatatgtggctgttcccttgtcaggcacataataaataaactcaattcctcacaagtgaaaaagcctggttcaaaggtaatgaccaaatttttctccttttttcttgtgcctttcctatctgagtcctatcacagtcattcaattgctcagaaacagtcagaagttccccatttgggcctgacccagctcccctactgaacagttctatgaccttggagaagtcacttaacgtccttgagccttacatagcttatcgtaaaatgggaataaaaatacacttctgagttgttctgaggctcagctgtagaagtgctttggaaacgaagggccatccaaatagtcacaactgatgaactgaattggatgctttttgccttgtatcccaaatcatggctcacaaattagatcaatgccatgatttctgtaaaaccttaggcaacaattataatctggaaaagttaatttggcagtgtatcttctcaacctcattaattaaaaaagaaaagcatgttgctgcctcctgttcacatatcactttacattgagaccacccaagagttaattaatgtatcttcagaatgctcactcagtatcactatttcctctcattggaagaagcagcaaagagatggggcctatcattttaccacactgagcttgcttaaagactttgttccccacgaggtgattgggtagtcactgagagatatcacatataggcaaaagatttctattctctcaagtcagctattggtgatttctgcttagcctcaaaaagcagcattcagcagaggaaatgtactcactaatcagaaaaagtatcttcgcactctcaagttgtacatccaaactgttttcttatcacagcctgacttaggggaattaaatttttttgtttgagaatggctttgatgaaatcaaaattgtgagttttatcaccatatggaccagtgaccctgtggttcttctatcccaggggcctcacatcccatggctcccagagacacaacatttgatgcagttgtaacacttttgaaccacacaatcaaatactggctactgctactgctgctactgtaaattttcattctctctattttatcttgagctttttcagaagaacacagactaagttttaagggttttcccccctcctgtttttcacagcatctagtatggagcacttaataaaatttcttgatttgatattgaaaatgtcattccaaaagctatttccttcttccagtccccagaatatataccatgacttacaatttgctactgacatcattttggatctgagattgaagatataggagaaaaaagtcaacaagtctacttgagatgtcacctcttaggaccccttcaccactgctccactgaaaatgcctagctcaagattaagctaactctagtcaacaggtaattttcaaaggctactggaccctcaccaataaggtctacttatgaaagtgagaacagaacctccactcagttcctctctacttctatgtgagttatttaaaaggagtagtgttgggcaagggaaggtatgcaacaactggtacatccctggctaaggtatgaatcacagctggagcaccagcccttagagaacactacaagtggtttctatttgccaatgcagaattgaaaaattagagagctagaaagaaccatatagagcaatctgatccagtgctctcacttcccagatgaaaggaccaaggtccagaaaaaacatgatgtgcatgaggtcacaaaagttggtcggaaaagctggagctactggtcggaaagccaaggctacatttcagtcacctcatgcttggtccagagctctttgcacagctggaccctttaaacttaacctcaataaactcatatgagggtagtgctcataaccacagtccatacactcaaagtgaactgctatgtcatattcttctggtgtaacacctcagaatagtttctagaaaattaagctcttagccattcatgaaatcttcatttactaatttctaccatccatcggataacatcatgaagtctctttatcccaaatctgatcgacctgactgtaggactgtgtaccttaataaaccctagtagtttgagggattggaggcttacaaaagaaataaaggaaaaagctgattttaatttgaagtcaagccagcatgttgcattgctctctaactcagaagtgaccccaaacaaaaggaattatcgatgtgttgtctgtcttcacacattcctaacttgctagtcttccacgaagatcttccatgaagaagcttaaattttcctacgtagtttgagttttatgtttctttccattaaagtttccagccgttcatagacatatttagtttggcagaaggtagtggtgactcacggaatgaagaaatttgaaggcaaagctactgaaaatggatctaatttctttttggggtaatttgggagcgagcaattgataatttgtctaattttcctggtttcatcagctgccacactgccaaatatatgttccatatggatgctttgttattcctgaaacatataacaaatttcagctgcgactttatctaatatggtcaaagggtaagactattgttggctcattttctcattgtttttggctggacaccctcaatcaatggctattgagtgaaaaaacaggatcatattgaaaccattttcagcatgttgcttcctatggatccaaccatttcactgtgagtttgtcaagcacagcaaatgttctctattaaagggatgactgtgttctcaacatggatgcgactgccagttaattgcattcaccttataattccagtctctcaatttggtgtagagatggttttggctctccaaagattccttcttttctgctgattcttacctcctagtatggaacagatatttgaggatgaattttgagaagatcaatgacacacatacaataagcatcatttcaggcttcccttaagttagacagtctgtgggccctgagtcatatgaatcataagacttgtgaaaggtattagtgccacaaatctggctggcatttctgtagattatcggtgctttgcatgcaattatgaaaatctctcttaccagataagtcagatgggggttcagtaacattgcacaaaagcatcatgatgtgtaagctaaagacaaagaaaggcttacttctggctggttctgaagtagacactggccacttagtgttttaaagtcattcagtggatgattggtttcaatgaatataaatgattttgatctccctccccaacacacatatcaaaaacaacagtaataataaagaacagaaaagtctatctcttagaaaaaccagatttgaaaactggctagggaaagtgttttgtggcaagaaacaatctcttgtatctcttgtttacaacgggctaattggtttgattaacaaattgtctaaggggaatgtatcaatgttgcttaggaaaaacaaagcttagtgtgtgaaaatacacatagacatagagtcttgctactcaaagaaacctgagggctttttagaaatgcagagtcaggggccctgaccccaaaccaattaaatcaaaatctgcattttaacccgatacccacaggatttggatgcgtgttaaggtttgagaagccccatctagagaatggcaggaagtaagaggtacttgctaattcgtggctcacatttgataagacagagtacaaaaagatcaactgtcactgcagatttcaaaaatgatgttaaggtcaaacctgcttgtggccattaacaatatatatgctgattcactggtatttggtccagattccctcaagttggtggaacctttcctcagaggaatgatagaactgctccaaggataaccccatggcctgaccttctgtgaactggaaattggaacttctaattgctgtagctgcaatttccaagcccatcactggggccaggaactgagccccagtccttaagatcttgccagtttctttttcaatagttacatttttcaagaacagccaagcaagagtgcttcaaaaaaagaaaaaaatctaattgcattaagtggacgaatgtgtgttttactcatatcaaatttcatcttttgttatgctcagccagattctaatattatttcttatgggtctgagttaattagttctatgagggttcccactgggattttagagaaatggttttaaggtaagaaaagtctattttggtcacctatcagaaggtgaagggtaaactttaaaactgcttttcaaagagatacagctggcttcgggtctttacgagggtcattctgaaactcaagttccccagcctgagcccattaatgaaggtcattaatgaaggccttgatatctgaagggtgtgcttcttcaaagggacattgtcccacagcagggcaggtaaagtgagagaggaccagtttttaacttgtatttcttgaaatgacaataaaaagaaaggggggcctttggattggagacttagaaaatcttggatttactcagaactctaccactaaataacttggtagatttgattattaatcccctgggtctcaaaacctgttgccattgaaacaatgatacgtaaatgaaccaagacattccacctttgaaatgtgataattgtgatctctcttcccagtttggcagggaaaaaaagtcactaatatagttttcacattgttttcacacatcttttacttgaactttaagaacatgccacttcttgtctatattcttgacaaggataagatagtattggacttagaccaaaactatatatttgatttgtttagatttaatgcatattattttaatacagtgatatccctgactcattggcactctacccattgaattaatgttgacaagataatctctaataccttttccagaatgtttactgctgttcatgaaaatctctaaaatcccttaagaaatctgacggatatggagattattgtttgtttctttgttagtattctctcattccttttgctgggtgctttagtaaaatgtatggaagtaaaattatagctctgcccaatttaattgtagaatcatcagctgggcacctgctctgtgtttagcaatacccaagggagaatgatgccatcccttcaaagaggtttctttgtggggggacccatgaaattccaatcatacaactgcaggcttgagtcagatgggaatagttctcccctatggtatcccagtccacaccatctattgagtgtcttctggttagccaaaactaatgatgaaagaaatgagtaaagcacagctctatgcacatggaattgatattctagagcaatgtcacaaaacgtttccactcccaccccacctgcatctagtccacagacatgttttgtttggtccacccaatatgtatttgttttaattttggaaatataaaaatcaagagattataagcaaaaacaaaagattaacaacttctcttatgaaaaaaatggtgcaatccagcatggctgagcctgcattcttgagtggcagtttttggtcacccttttatgtgaagtgtgtgcccttgcaggcttaatttattcattatatacctatctggctcagcatacattgacctatgccactcctgctccaaatatgcaagatctcgttggatattaactatacgcttgtctattttattacgttcaagacatatctattgcctttgttctatcacatagttaccagactaactgctgctggtttatataaataagacacaaacctcatctttatagaactgtatagccctccccaaacagagcaagggtacagctgagctagaatttaaaagacaatcaagtcattctggtgaaggaagaaggcagattttaaaaactgaacattcaaaaatttagacatcatcaaagggatatttcctcaagagcaagtggagtttttagccggtgaccttgtaaagcaggaaaggccaggttcccagccaatgcaatggatgggttgcacaatcaccctaagtgttgagcacagtggagaccatcaacccaactcttcagacaaaacaagctgtagccttacagtttgttttgcaccgagatccataacagctgttacctatttactggaagatccttccagtcccatcactatttagatcctcctcatcgcccaccaaaactattgcaacagcctcctccatgatcgtgctgtgtgcaagactgcttgaggccagccgtcccacccatgagattaatctttccaaagcaattcttatcactttatcccttttctaaacaacatccagggaccattcatggctatgtaaattgagtgagtccaaactccccaatttgacagtaaggcattttacgtaaggtctctatctgactttcttaatgtatccctacagcagagctcacaaactggcaatctgtaagttgtatccagtcctcataagtgtttttgtgtagtgaatacagtgtttttactaaaatttgaattatctgtcagtatttactaaatgactctccacttcatattggcacatgctttctgctttaccaaaaaccccccaccactctctattgccttgctctggtctacttcacttgcctgcatgacttgctgtagtcattgagacattgacttgattgactcaccaagtttacaaatgaccccctacatattccaacatccgacctatgtgacttattaccacctattttattttcctggactttcctctcttcttctctcaaatgtcacctcctctgtaaaatcttctaccagatgtcaaccctctttcctctgagagagagaagcaataatattactcttacagcactttgtttttggtttttttttttttttttggtcagtgttcctaccatctgcttaactataagctctgcaaaggtgagggctatgttttattaatctctgtaagttcccacttactccctcatacactgcactatccatgtctgcatggaattaattgttattcgtttttatgtggccttacaggcctagattagttatgtgtgcctttaggaaggcagtaactcatttgaaatgtagacatggctgagtcggaaggcctccatggacttttcggtattttcaagtacagagtgagaagtgctgtatctaaaggaaactactaagggaatttaggtaaacagaacatgatcctttttgttggaagctggctgtgatctccagattaaaacactattgcatgcctcatgaggagcatcagcaaatcctttagtatgcacaacttgtgttagaattgcaggagtcagtctattcctgggggctgggctgagataatgaattgagtcaatgccaggtagagcacaaatacgctagaaaaaatgaaacagaaagaactccgtatgctgcattcaaaagtgtcaatttctaaagtttctgaataactagaaaggggctcgcattcctgtttgccctgcagaaggattgtcaacaagttacaagattatagaatcaaatctcaggcaccagaaatggatccaacttagtgaattttgactggaatgaccagttgcaaaatattgaccaagaagaagaaagtcattatttttcaatgtcattaaattcagcaatgttttatggataactgtgtacctagaattgtgctagaaaccaaggggaagctgaaacgaaaaagccagagcagaaaactaacgttcatgaacacccatcatgctcccaaaaagtaacatacaaatctgccttaaggttaccttcaatctggttaagaaaacaattcttacccatatgtcagaataatcatcataaacctatagaattaaagtaagtaataatgtataaaaataacatttttttctcttattcttcctggatatggcagatctcaaaatatgtttactgaatttccaaaagaatacaaaaaattttcatccttctctctatatatacagtcttgtgaaatcgtccactaaagtttaaaagtaggtggaatttacaccttcatgtactctctgtctgcctgggtccttggctaggtagaggcatggttgtgttctatagactgagagaggccagaaatactgggcaaacaagccgctttgactttgagttgatgaaaagcttaggaaaaaatccctccttttgtagagctgccaggccagtctttccaactcaagttcaatgatgcgtcaaaattctacctggagtcatgaggttcccctcccatcttatcctctgtatcccccggtccagataggatttgatgcagataacatgggcactgttggttgcttttcttttagcatgaggattcctcaaaacagagttttgttaataaattaagcagaatttgagtgaatttaagcagagtttgagaatttaagtgaatgtctgggtatatttgaataatatttattttgctatcagcatgacaacattggatatcaaaaagagttctgaatatgaggtgaggagacctggacaccctgaaaagccttgaattcgctggttggctgggttctgtcaggcaattctctcccttgtcaaatgggtacagtcagccctgcctgcctacccaaagcagtttttttagtaccaggagagataatacctgtggaattgccacaaaattcttagaaaatcaggacccgctaccagtttccagaggtaatttgagtgaagtgttgttagaattgagggagggctaggctagagtacatcctgaagttgaaagtgggttagccaagatgcattcatgccccttcctttggaacgtggggactgtcattcctttttgggtcatgtatgatttctgtggactggaattacaagggcaaatgtaggaattgctgtaatattggtcagtacttttcacattccgccatcccatgagtagggataagaggttaattaaatacatctctcgggcagcagaaatgatcaaggctgtccctggaacacagttgcttcaaaaagtaggcttttgtttcagggaagatctcccacagagaagcatggaacgccaaagagaactataaataggactatcatttatgtcaattataaatagatttgttcccttttgattagaagattaatgctagctgaaactctgtagttgagcagaaatgagggaaaaactcctgacaaaatattattacatgctaacagttagatttgataccttttcctccctgaagtattttctctgattttccctaaatgaagactttcttctcgtttgaatttatgtccagtttagtctttgaagtgcgtttgttcatacttcttagctcctcaggatctctagattagacaatacacacacacacacacacacacacacacacacacacacacacaccttttttaaatggaaaaaattgaataagttgaatgtccgtgttaggaatttaaaagggggcaaaactttctcctcagatgctcctaagatggccactacgccctcctccaaaattctgctttctgtgagggagatgttttaccaaattaccatgtacatatggttccttagcaacccatattaacactgagcataatgaccaaagagataaaggaaaagatcagtagaggaagggccataagccatcgctgctgagcacctgcctgatatggagccatattttttcattctccaggaagcgatatccaatgggatcccaactctttacatatggttaaccaacttcttgtccttgattgtgttcatgacttgtctcttcccagggccagagagagaaatggcaacttcccatccaagctgactgccaggttcaacctgggaggagagattgcagggtgcctcagtcctctactggacatactagaatgctggtctcttccctgctaggatgacaggatggggaattttgcctgagtctgcccaacttgcctcatggaggcttttgatttcagctactgcaaactaagcattaaggaaaggggtgcaggtagagactggaagagagggtagatgcaatgagtggagacctctgtgtggaactcctcccccacttgaaatgccctattctggtttcgctgtgagatatttcaaaatgaacttaacttgtcaactgaaaatgtactgcctgacctgagatttctggaaaaacatgaatcagaggtttggaaagtctgggttctaactcataaagaaatatattgaatatttataaagatataacattcttagaactgtttctgtgtgtgacctctctcttccaagtggcattgctcaacagcccagctctcatcagaaggctgacattatgctgttgtgcaacttgcagccatagcaatgtcactttgttaactgcacttgctgtgcattcaactattgagaagccaaacagctttaagtttgagtcagaagttctaggcaggatcattcttgtgaaacctgaacccttagttcttctaaaaagtcaaaatacatttggatcttgcaaatcgagaatgtcagagccaatattttcctctttaatcaaaacccaggaatggcacggtgggtggctggggccatgtcctcccttcttccctttcccttcccccacacttccagccaagattctccaggcttgagagagctgatgtggaaaagcagctctggcccttgtgtgttcagccctgaacctctctgccaagcaccacattaatggtggacactaacgcattgtgatatagaggcatgagcctgaaatcaccaatttgtccccagactgataggtaaacagcaaataggaaagccttcttcttccctctcatccctgcattcccaaatatttggggctctatccaacagcctggatctgcagcaaacatttgcctctgactcaattgaccccttcatggcgaatcttacatccacattggataactctactggctcaatctatgaacaattttcaaaattgaggaaataaggcccttttccattcttaaataggctggcctaaatattcttgggagcttcatggagagtgtcatgccctggcttattcgcaaaggtggcaatggccttcagactcagctaagacaaacattggcacatgcaggtggccatcagatgttaatgtttatcttgttcctctgtattgctgttatctttcagggaaatctaggaatagcagaaagatgaatctttccttccccatggggcatgtacttccttctagggagtaggaagagaaaaccctctcattccctagacctcatgagttactctggagggttggtagtagccatggttaatggcaagcttcagaagggaagagcttccaaaaccttgccatgatgcctgtgaagtgctgtgagagtactcatgtttctctggaagtcacatcatgtgtttaaggtaggccttgtacagggaggattttgatagatggaaaaattctggacacagaaactaactcaatagaagagcacatagacagcaaagtaaggagtatgtttgcaggtgcatgagacatccagccagttgtttgggtgttaggctagtgcagagcagtgcaagataagcccagaaagataggttggcacatctatattgaagaattataatagctagcactttccaagctcttatatgcatgacactgttttaagcacttacatgtattaactcactgaatcaccaaacaactctgtgaaataggtactatcattatcttcactttacaagtgaggacactgagacacagagaagtacagaatgtgattaaaggcacatagattctaagtgcaacgaatccagggttttaactcaggcagcctactcaagcacgcatggtacctgacaaccttgacagcatgctctatagagcatacatttattctttgcttcttcttccatccccacatccctagccatggaaatgctgagtaacttttaaggccaaactcatctctttcctagcaatgcctcttccaacttcatcataagagaaacttatctttccctgttagaggcctctctttttttgtacatacagtaattttcccaaccttacttatattagagttaagaatgtgttcatctgtgaacttcttcagacaagaattggcatcatattcctctgtatgtcctcagaatctgggacagtgatttgcatgtagaaagtgctcaattaacattgcctgagtataattgaataccggaggccactaactgaggcctgaagaaaagtttcctaatcctaccatacctctttaagatcatctttccaaattcaaaacaaagcaaaacaaacaaacaaatgccaagccctatagggaactctcccactcctgaaaacctacatcctataaaaaacactttggaaaagcacaatgtagaccctcctaggccacacacctaacacattattccagctttagccttgcttgactgtaaaagaatgctaatggcagcagtgcttctaaaggcaaaagcacagccacacatgaatgatgtatctcactaagaactgtggggttccaggatttctgagaagactcctttcattctgataaagttctcagcttctcgacccccaaatcctaactccctgaggaagattcaaaaacacccaatttaattaaagcctttttttttctcatattgaagtcacaagttttcacagggtgcaacgtgttgctaacccagcaatttccagacaaggctgctcagcaaagcaggtgctgttttctttttagggcccatgtccttaaattgctttgctgctcagatgtctcaaaggtccaagtttctctggcagattccagcccaagcgctcctctttgacccagctctttctggctcagaagacttctttttcccataggtgcagttagccaataagaagagaatgtcttatctttttaaaaagtacacttccaatgtcttcattagttatcttcaaactcagagggtcaataatcacagcaagaggagcaccatgccttctggaaggatgtcaaataagcatgctgaatggcctacagttttgtaattggcaagacccccctaacacagattgagtgttacagatctgcaaagttcagtgctaaaatatgattgattagtgtgcaaatatttactgagcatctattttatgacaggctctataacagatgctagggatatgacatttgtatgagtccattctcacactgctataaagaactgtccaagactgggtaatttataaagaaaagaggtttaattgactcacagttccacatggcagcagaggcctcaggaaacttatcatggcagaagaagtagacatatctttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtcttgatcttctaacctcgtgatccacccgcctcggcctcccaaagtgctgggattacaggcgtgagccaccgcgcccggccgaagtagacatatcttacatggtggcaggtgagagagtgtgaagagggaagagccccttctaaaaccattagatcgcatgagaactcactcaccatcatgagaacagcatgggggaaaccacccccatgctccaatcacctcccaccaggtccctccctccacacatgggaattacagttcaagatgagatttgggtggggacacagccaaaccctgtcaacactgaaccaaactgacagggttcctgcctcagatgcttagaggttagccagaaaggtgaacatggccagtgccaaacaatagcaaggaagggagagatccctgtgcactggaatcatctgagcggtgagctatacagtatattcctcaagttttctttccttcccaatggttggaatatctttctcatcgatctcccatcttcttttcactttctcttcttttcatcatctacagcatgcattgttacacacccactgttacaaaaactggtattagatttgttgtggcaagaaagcctcactgtccacaggcctacatcttagcaccttgatcttgagcttctagaagttctggcttcctggaagttcattacttactctgcgtaaacaaatgaaatagagagcaataaaatgcgctcagtaattctcacattatttgtttgagatatactgaaattatctacagaaaggagagcaatactctcttatccttgaagatcaaatgcatcaaagagttacaggttttgataaaaacttcattgatgaacttaattcctatccaggagtcaattggtctacgtagaagagtcctaagaatagaaaagctacactaggtgtgcagaaccattcttgaaattctgtatatgaaactgtgactcacttgatataactttagagtgtatgttttgacacctgcttattttcttaccagtagcctttctggttttccaaaatctttctccttgttatccactgacaccatcagactaacctactataacaggttaacagactaagcaactataactaatctactataaagatcttttaaagcttcttcaaggctgaacctctgtgactctgcattcctagatcccaaatcctatcttcaattaacagaggtttaggagaaatgacccaagatccttcctctgaaaacccgcccaaagtattattgaaatcttattcaaattggaaagaatgatttaaaactagagacagagatggaagtatattattgtattgacaaacagcatgtagatattgagaaaatgaaattaaatgtagcaagagaacttatttaagtctcccaaatgagtttgaaagaaaggcaaatgtgccctgtatctgtatttgccaacacagaaagagtaataataatcatctccagattagatgatgaaggccttagccttcagatggaaggcgaagaagagattgaaaaatctggaaatgcagcattttatcaagtcgaatttagtcccagagcaattgggcatccatttgtctccaagtggagtagtgtacgatggctgtttccattcgtggcagagagctgctggggccatcggagcaagagatgcttcacaaagaaagtggaaagcagcgccaaaaggcaaatacaattcctgtcacatccaaaatagttcatttagctctttatgctactctcttactctttgtcatggagcaatttctaggagagtcgcataaaagtagggagatttttagctttgagcagcaaataagtgaactgggcaaggagagcatgaaatttagtgaggaaaaagaaaaagaatgacaggggaataatataaaaaccctgggaagaaagcacttcccctgtagaaaatctactatatgaaaagtcactcctctaaaacagatatactcaggatggattttctccattcggaagagtccatcactttaataaaacacttttgaagtcttcatctcgtaacctcacgtttaacatgtctgagcacttcttgagaactcgccctctctctatgctactggatgagacgaaaggagaatccgtgagcccggtgttctttggaggcctctctacctacgcacatttgtgcttcacttctgccaagtgaatataatatgacaaggcttagaaagcccaggtgatccagagggcaagagtttgtgtcaagaatagaggtagaagaaccatcgaattatagggctgtaaaagaccttgaattcataaaatccctccacagagaaggggttaggattcaaccctagaggaatgtcagcacaggcctctctcaggatgtcccttctctgacatcctgagagaggcctgtgctgacattcctctagttggggggcgggatggggaacaaataactttactgccttcctgttctgcaaacagaaaaccgtagcaatggggtatcataccaatttttcattattattatactttaagttctgggaaacgtgcagaatgtgcaggtttcttacatagctatacatgtgccattgtggtttactgcacccatcaagccgtcacctacattaggtatttctcttaatgctatcccttcccttgcccccaccccccgactggccccactgtgtgatgttcccctccctgtgtccatgtgttctcattgttcaactcacacttatgagtgagaaaatgtggtgtttggttttccgttcctgtgttagtttgctgagaatggttttcagcttcatccatgtcccttcaaggaacacgaattcatcccttttcatggctgcatagtattctatggtgtatatgtgccacattttcttcttccagtctatcactgatgggcatttgggttggttccaagtctttcctattgtgaatagtgctgcaataaacatatatgtgcatgtgtctttatagtagaataatttataatcctttgggtatatacccagtaatgggattgctgggtcaaatggtatttctggttctagatccttgagaaatcgccacaccgtcttccacaatggttgaactaatttacactctcaccaacagtgaaaaagcatttctatttctccacatcctctccagcatctgttgtttcctgactttttaatgatcaccattctaactggcatgagatggtatctcattgtggttttgatttgcatttctctaatgaccagtgatgatgagcttttttttcatgtccgatggctgcatatacgtcttcttttgagaagtgtctgttcataccctttgcccactttctgatgagatttttttttttttttttttttttttttattatactctaagttttagggtacatgtgcacattgtgcaagttagttacatatgtatacatgtgccatgctggtacgctgcacccactaatgtgtcatctagcattaggtatatctcccaatgctatccctcccccctccccccaccccaccacagtccccagagtgtgatattccccttcctgtgtccatgtgatctcattgttcaattcccacctatgagtcagaatatgcggtgtttggttttttgttcttgcgatagtttactgagaatgatggtttccaatttcatccatgtccctacaaaggacatgaactcatcattttttatggctgcatagtattccatggtgtatgtgtgccacattttcttaatccagtctatcattgttggacatttgggttggttccaagtctttgctattgtgaatagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatatcatactgagtgggcaaaagctggaagcactccctttgaaaaccagcacaggacaagaatgccccctctccccactcctattcaacacagcattggaagttctggccagggcaatcaggaaagagaaagaaatagttttcaaataggaagaaaggaagtcaaattgtctctgtttgcagatgacatgattgtatatttagaaaaccccatcatctcagccccaaatctccttaagctgataagcaacttcagcaaagtctcaggatgcaaaatcaatgtggaaaaatcacaagcattcttatacaccaataacagacaaacagagagccaaatcatgagtgaactccattcacaattgctacaaagagaataaaatacctaggaatccaacttacaagggatgtgaaggacctcttcaaggagaactacaaaccactgctcaaggtaatcagagaggacacaaacaaatggaaaaacattccatgctcatggataggaagaatcaatatcatgaaaatggccatactgcccaaagtaatttatagattcaatgctattcccatcaaggtaccattgactttcttcacagaattagaaaaaaccactttaaatttcatatggaaccaaaaaagagcccggatagccaagacaatcctaagcaaaaggaacaaagctggaggcatcacgctacctgacttcaaactatactacaagtctacggtaaccaaaacagcatggtactggtacctaaacagatatatcgaccaatggaacagaacagaggcctcagaaataacgctacacatctacaaccacctgaactttgacaaaccggacaaaaacaagcaatggggaaaggattccctatttaataaatgatgttggggtatcataccaatttatgagatggtcatttggctcttgagtggaggccacctctcagtgactcagcaaaatttgtcctctgcacggtccttgtatcttgtaccacctgaggcaatcaagtatattctgctttatatcatagttatttatgagttaacgcatctccttactgggtcccaaattccttgaaggttgcaactttgccttgcctattcattttcacatactacgcggcacttagggcagtgctttcaatgtagcaggtaaccaattgttttgcttgcttttaaagtagttgtttttaaattgacttgagcttagttctgcaagaagactagatgagatatgattttgtcatcataaatttaaaatgtccttaatattttcttaatatttaatctataaagagtattcctggcacatagtagacagtaaataactttgttgaatgaacttacgcgtaaatacatcaatgactgactgctcatggagggtgccccctttttgcccatgaagttgaggtggtattgggagaatgctttcatttcctgatcctaactctcctgttgcagtctagtattgtcaatacaaaggtgtcatcattaccgttaatcccaaattgatgtaatctgaacttttgctctgtgtaattacagatatggggtacatttcctagaaaagaactgccctggacaaaactgttaggtagaaaaaaaaaaaaggaaattgggtgtcttttttccatattgtcaagagcagagaggacctcactctgccccctccctcttgactcctcacacccaatagcagcaccaatgcctgccacagaattatgagcacttcagccgggcgtggtggctcatgcctgtaatctcagcactttgggaggctgaggcaggcggatcacttgaggtcaggagttcgagaccagcctggccaacatggtgaaaccccatctttactaaaatacaacaattagccagacatggtggcaggcacctgtaatctcagctatttaggaggttgaggcaggagaatcacttgaaccccgggaggcagaggttgcagttagccaagattgtgtatcattacattccagcctaggtgacagagtgagacgctgtctcaaaaaataaataaataaataaataaaaataaaaagttacaggcacctcaaggttgcctgttttttgcctactgttgcttcagttatgtactctcagtgatctgttaccttcctttccagaaactctgtgtaaatatatcttaattcaatgaacaaagccataatggagacattggaggcattagtagccagccagtgatctgttgttttgttcattcaagaggaggttatcatgaaaatactctgtgagaaacagagttccaggattacactggcttaaacaatatggaagtttgtttctcttatgtagtagtcccaagatacatagttcagggctgctgaaccatctgctgtgcaaagtagctctatgccacaaaatcttcaagacccagcaatttctagatttctatttcaccatcccagcatggtggccctcatctgcaggggccaagatggctgctggaggttcaacattatacccatgctctagccaataggaagatagaaaaagcaaaggatgcattttggttgtcttttaatgaaggatcccagaagctttcatgtgacactttcacttatatttcatttcctagaacttgaacacatagccacacagagttctaagttaggctggaaaatacagttagctgaaaattagggtttctattactgcagaaagagggaaaatagctattgggaaattactaggaatctctgccaaagacgctatccctgagctccttacgttctaccacttgagtgccccaaatcaagacactacaaaatgaaaggttgatctagtgtcagccagatctagatgccagtcctattagcatcacttaatgagctttgtgatctctgagccattttccatgctatcaaaaacagcaataacacctccctattaggttcctgtaggatgatataagataaccagtggtgcctagcacagtgcctggcatatatggtagatacttagtcaacatttatttttaccattctttctgcatataagactggctcagctccacagtttatatcaacttgggcacaaaaacattaacaaagttcctggcggccatatttcttgagcaattttatactctatccattagccagatgtgttagagcaaatgagcggctgctcaaaagaatgtctttatcctcacttgcctttttttcctgttattgttggatggtgccaaacaagacagaagcaattaataaacttgtcagtatcataagagatgacaattagaatcagcagagcttaaaaaggagcctgaaatcataggggttgaggtagtggggtttttaaaatgcaaagagcatgccttttcacttcactctgtttatcaggccaagcaaactaaagtgaaaagtcactgtggaaaaaggtgaagaaaaaggtacctattttgcatcacccactatgtcatatcaagtaaatgaattaaaatcccatgtcaagtactgggctttattccccatggtttcacaccaagtttctcttagaagatactctaagatgcactaagctttcccattcacttctgtctaggcaggaagattctactcaagttaagaagcagtgttgccagatgcagtggctcactcctgaaattccagcaatttgagaggccaaggcaggaaaattgcttgagctgaggagttcgagaccagcctgagcagcatagtgagaccctgtctctacaaataatcaaaaattaaccagacatggtaatgcatgcctgcagtcccaactactcagaaggctgaggtgggaggatctcttgagcctgagaggttgacgctgtagtgagccacaattgcaccactgcactccagcctgggcaacagtgcaaaaccctgtctcaaaaaaaaaaaagaagaagaagaagaagaagaagaagaagaagaagaagaagaagaagaagaagaagaagaagaagaagcagcagcagcagcagtgtaatagaatgacttagtgctcagaaagtcttgagtttggatcctggtttgggcatttaataagtgagtggcctgagacaaataaataaacttttctatggctcaatattttcaactgtaaagtgaagatgataacagtgtccatctcataggattgttgtaaaaggtaaatgatacagcatatgtataaaccagatgcactcaggttttccagtctccttgggtcacgcttttctccaatatctacataaaataacctgcaaccccttttcacattccatgggaagcccatcctctgcccacgagctctgaagatttggggtatcatgcttctctcaagttatttcactctatagcctgcttcccaaatatggcccactcccacttgtcattcctgaaaccattattctatgttccctgccccctttgcttcagctcatctaaagggcaggaaaacgctggaagcaggagagtcatgagtgcctgaaattttgcaggagcagcaggcagtaagagtgggaggacctgagatctatgatagtgaaagacatgatgcaatatattgcctgcctggttaaaggagtagaaaggagtcaaagatgactgtaacattttgagtctgagtaagcaagaagataatggtgcagataccagcaagtccagaggaggatttgactttgttgacttgactttggttgacattgactttggtcaatggcaaagattgactttggtttcagagacactgatgtataatagagcttttagaaaataattcccatgagtcactagggtgcctgtccaaagtgcagtgaagggactgcatagaagaagaggcttggagatttccttgtacaggggatagctgaagcatattccccaacacaatattaaatttgtaaattacctttaaaaatagaaagaaaattgccattttagagtctcaaaaggactgagcaccatctaattacatcacaaatgatctcccaaaaaactcattcctttagaccaggagatgagtttctattcattattatttttgtagctaaaatttcaaatcacagaatcataatatattgcagtttgtttaagccttaaaatgttcctggcccaaatgcctcacttaaatacggggaaactgacatgctgaagagtctgagtgacctatccttgttcactcaagttgaataatgctgccagaaattctactgttagaatttctgctctcccttgctcattttttcacctgcagtccagctaccaaagataggattttagacattctatctacatttaaaatgttccttctaactgcagcggaaacacaggtagcaaggagacagtgtagaataaggagccagaggcctggattttagtcccgtggaaaaagaaccagccgcactacctggagagaatcatttggtcttccaagttctcagtttcctgatttgagtagcaaggagatgggtctggattcgctctgaaatgtcttgcagctctgacattccatgattcttggagaaatcggctatctccaactgaatccacatcttccaatcccacacaagatggagaagcaggcccatcccagtatttggggaggcccatcaggaccaaagctgtcctctctctgtgggggctggagaagggaagcagctgaggcaacacaatcagtttccttcccattcagaagagaacaattgagctcctcccaggggaagccatgcggatttggacagtgtggggtctgtcttatgacaggaatggaggatttctgtagaatggggatgcttagcggccgtaagaatcaaagatggaaggaaagccaagaggtccttaggtccggtcccttgcctctagctaagccttccaaggcagatggttgtcatcctacatttaaagatctccagagtagcaattgctcagcttcccacagcgcctggggtcagcaagtttccccttataatcaagaaattcttcccgatgtttaagtggaaatgcttccaatgtggcccgagtctgtttacccttgtctagtcctcagaagagatgaggaataatcttctgtgtaataatcactcttcttatgcctggtgctggtgattaagtcacttcttagccttttcttttttgggctagatcttaacttcattttccacccagttaatcttttttttttttttttccttctcctagctggatcttttccaggttctccaaatgagccttaaaataggagaatgaaatctgagttcccactctaattaaaacctcagcaatgccaagttttgtggaaagattactctctaggctttcgtttcataattctctacatacacccgcctcatattacaatttgttgtagtactttcctgctcactcagggcccacagctattttgttatagtacttgtctctgccagatggagcccatttttgtctattttaaacatctttctgtttttaatgacttctcgtttctaaattgttaaaggtctccttaaattcaaatcctaccttctaatgtttctttacctgacttagtgccatctgaaaaacattctagtccattactcatcattgaggaaggaaactcaattttgtatcaatccgagaagggcctgaatagcactcatttctcccaatactcacaagcatgctttgagcatgaaaaaaaatgcaggccaccccttctccattcatttattcatgaaacatcttttgaacagggtagacactggacacacagtgatgaacagtttctgtatccattcactaatgtgttcctacatgtgtacaaaatgtactccttaagcacttactctgtgtaaaaccgttgcaagtgttgtggctacagcagtgaatagggaataaaaggctactggcttcatagatcccacattccaatgggtatgggggaggacagagaaaaattacaagtcaagcaacaaataaacaagaccatgtcaaatttgataaacgttttgaaagaaataataggatgatgaacctgaggatggtactgcctttgatggattggatgggggaggtccctctcagagggagaccctgaagacctttcagtttagcagagttatgttattctgaaccaatcccataaagcaaacccacttccctcatgttttcttctgacagacccagcactaactttttctggggtgttcacggtttataatgccttgttactcagtaattgtttacattcccaaaggactctctcatgttctttaattgaaagaagagataaaagaaggaatttaagtatacaggcgcctttgttcctcaggaagttaatggacattcctggaaaatgagagtccggtggtctattgtgtggagaaagtggacttcagtaccatgaaacagatttcttcactgtggaacttgaataggctgttcctcgaccatcttgaataggctggtgaactttaagactctgcaaaataagataacgtttacagccgtttcctaagctttttgcacggaacttcttgaacaactctttggtgaatgctgagctgaaaagatctcttggatccttaggtgtcctttgacataggatttggcatttgggatgtgattccaaatcaccagcagccaatgtgcaggccagtcgtcgatgtctctgaagagtgtgatagaaagaagaccgcagaggaaggcagggagtccttcctgactttgcctcagcttctcttgtgaccctggtcacgtgtgaactatgcttctttagttttctcagatcatggaatcttctgagaatcttctgagtgtctaaatgtcctctttccaggaaaatccacaaacatacataattatacatcatgcagagggttgatatgcctcctaccaaaatgcatctctgaactggaggatttctaaggatctgtctgtccagtgtgaaagttcaaataggtttctgctctggtcatattgacctcttggtgttttggtttgtatgcttgcttttaattgacacataataattgtaaataattatggggtacacatgatgttctgatacatgcatacattgtgtaaaagtctaacagggtatttagcatatcgatcacctcatgcctttatcatttctttgtggtgagaacattcaatatcctcttttttagctattttgaaatatacaatacgatattgttaaccagagtcaccctattgtgcaatagaacaccagaaattattcctcttgtctaactgtaactttgtacccattgaacagtttctatctccccacctaactaatgctccgcagcctctagtgaccactattctactctctacttctattagattaacttatttagattccatatacaagtgagatcatatagtatttgtcttttgacattagtttggacaagaccccaaaagcaaaagcaacaaaagcaaaaatagacaaatgggattacatcaaactaaaaagcttctgcacagcaaaggaacaattaacagagtgaaaaatcaatcttggtccatgtttttgattagcttgtgtgctccttgggacaaaaccaagcatcctaccacctctcaagcttccttcagccttcaccacacaagtggtgctaatatgtgtttctgcacctgtgccaggttcctctgcagagtcccgaggtggccgttgcatgagagactgctagggaggccagggagacccctccacacagaggtaccagccagccctggggatgccccgttgacttctcaatgagtgaatgaggtcatttttcctctgtcttttccagaaatagattcgttgagaaggcatatgctgaaatgacctagcaaggcagcaggaaggaagtgactagaaagagaatcattaaaaacccaacttcttatttaaaggaaaatggaaacaggggcctggaggaatgctctaattgggaagccagcagtggcccctgccttccctcccagtgctcccaatatggatttcctgcctttgggcactgttggatttaaagctatgaaagcctcatacacagtctcatcagaagggctcagaaaagaaacagagcttcatgtgccttcttcctgccacttatgtatggaatcagttggattaattaaccctgtttcctcagtgagattgattctatcactcgctcgagaaattctgatgattaggtgtaacctaactgataaataaaaaattataattttttttttgcaaaattaaatgtcctctgctttgtataattactgtggttctatgggcaatcatcagtggtatattcccttccaccctcctttgccacaaattttgaatgatccatgaaaagatattttgatgatgtggtactgaaggtgccccaaacccacactgcctttttggcttctctccattaccctaggaggttatagggcaaaggcataggaaggataggtttgggttcctgggaagtctgtcttctgagctgaattttacaattgagcaagttggcttgactggccatctgacaatctggaaagcttaaaaataaattgaactcagtatttagaaaaggcagctttcaatatcagaagactagcttgtgtttctcgctttccatttggcgggggaatctgtgaaggctctaatttcctttcctgagacctggcttgttgtcttcaggtgctagctggaattcagaaggacacagactgtgcaaataaaaaactcagggaagggaaaaaggtcaacatgtgttttttgtttcagttcagtttgttactttgaagggttataatattttttccttctgttttgcaataaaactggttctgctactagactgacatatagatacctttattaggcaattatcacaagagatatgaaggctttctgtgtaagaaagtataagaggtctttcccaggactgcagttcttcccttctctccagtgccacaggacgtgatcgtatattatatacacacatattaggagttgatattgcacacaggcactggcatcatttgagaacttatggaaaatgcaagtgcttgagcaccaccccagtacctgttgaaacagcaactctaaaagtggggcctgttgatcgtgttttaataagccatccaggtgataaacatgcaggctcaagtttgaaaaccactagtatgtgttagttatcttgggcactacctgcttcaggaacccccacagaattatgggcctgaatttcatcctttcatgaggtttggggacaagtatgtgggtggagaagtcttgccatttgaaatcaaaggaacttccagattcataagccacttaaactctcagttttttcatttataaaagtgagaataattccattggcaccataaggttgttgaaatggctgatgcacaaaaggtatgtgaaaatgatttttgaactgccaggcactctctggaattagctatatggattgatgatgccaatacacattatggaccacaggcatgctgggggatgtggggagactgtgtaacctgcgtatcctgtgtcctcttctatattctgagcaccaagcccaggcagataatggccattcactgagtctttgctgagtaattttaactaatattgggtaagtgttcactcatgcatgcatcacaagcaccttgtgaggtgagtatgtgcctctttttggatgcaacctgagaggttaaggagcttcctcacatcacatagttagaaatggtatgctcaaggctcttctttaaaatggcatggtattaatacttgcatgtaacctatgcacttttcttgtgcactttaaaatcatctctggatcacttataacatctaatataatgtaaattctatgtaaacacctgttatactgtattttaaaaatgtgtattatttttaattgttatattgttatttttaattttcgttcaaatattttctatccatggttgtggacatgaaacctgcaaatacagagaagacatttatgcagccaaaaaatacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattacttatatacccaaatgattataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcagggacagaaaaccaaacaccgcatgttctcattcataggtgggaattgaacaatgagatcacatggtcacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaaagagagatgactgtacttttgaaatgccctctgaactcaaatgatgaaacaagtgaaatcaaaaaatttgtttttcaagtaaaaaaagaaatggtttagccagcatctgaacccaggcaatctcctccagagcctgtgttctaagcacttcaccacacaacgtcacaatcagttcttcataatgatgctaaggagggtggggtgagatgacattctgggagtgcttgctctgtgccacaagctgtctcaagctctctttgtgccttaactcacaaaaaccctgtagagggaaatgatgatcatcctcttttaacaagaaaggaaatggagacttgagactggccctggtgttaggtttcttctttccaaagtacaaatttcttctattgcttctctctttgtaccgtttgtgcacccaacttgtcaatccaccaatcagtgagcatttgtgaagtgtccaaatgcccagtgtagtgcttctaaacagagaaggatgagatgacagtgtctgccctcgagatgctcaaaatcaaataggaaagaataggccagtcttcacaaaacagaaaaaaaaggctaatatacagttaagagcttgtttatgatacataaagtaatcattttccatatttagaaggttaatgggaatgaggtcatcacacaagaattctcatgggggcctgaagaaattttgtgttgctagactgagacttcaacaatttctctgagcaattatccttgaactgttgagttcagcatccctgcattgcagtttcctttaagtttgttacagttaccctgattataaggagatagtgacctgttatcctgtttttttctgtgttgttaacttcttatccctggtactgagaatagcgtctagaattcagtaggtgctcaagtttacatgtgaccaaatgtttataaaaaggagaataataatgtggtgaaagaaggacaggagtgttcagccaaattttggattggatgagaaggcagattgtcagggatatcatgacccaaacaaaggtggagagacaccagattagggaggagccaggttctccagagaggacctgagttcagaaggagcacaggagcagagcctttgttatttaggatgcaaactctcccactcccatacactgaagtgtggtgctgtcttggcagctgtgtgttgaacctctctccctaccccagagaagaaacctcatacgtacttggtgattttctttttaagttttttatttttatttatttgtttatgtatttatgtatgtatgtatgtatgtatgtatgtatttttattatactttaagttttagggtacatgtgcacaacgtgcaggttagttacatatgtatacaagtacttggtgattttcaaagttgagagaccagagtcccttgtcatcaatttcattttccttggttttacttctacttagaaaacctttggatgccaaactcaagtcttggttacgccccatgtttccttcaaaggaaactgcactagtaattgaaaacagaaattggttcatttattctaactcacaggacacaggtaagatccctgtctgtgctccaccttggctgtctcttttctaatcccgggagaaaatctggatataattctctgctttgttgattaaattcctctggtccttatgcaaaattgtgggctttcatcaaaataggattgtctgataataccctttgactcagtaattccattccttggaatttattcttataaatgatctatgagtagtagaatgttatgtgtacaaagacatttattgctgcattagttaaaatgatgataaaactagaaatagcctaaatgcctagtaataggaaaatggttacagcaacaaatgatggcatatctactcagtaaaatattctgcagttttaaaattataattatgaaaactatatagcaatatgggaaacgcttacaatgtcatgttaagtgggaaaaaatacagtactgcattaaatttaggttatggctgtagctatgccaaaataatgtatgtatctggatgagaaacagaaacaattttgaaaaatgaagataaagtgatttgctgggatatcaagattatgggtaaaaacttctctatttcagtgtctgctaaagttgttataactttatgcaattcaagggtcttggcaggctatgaaacaaggctgactgccccatctgaaactgaaagggtcacaatgcactgggtaagatgtgagcatgcaagagctatgtcctaaactgcggaagtgcacagacttctctctcaagggaaaaagccatgcatggcattccttctggcattctctagaatacctaggataaaactctgtgcaactccatgtactcaaatcctggggttagtgggtccatttagatgccttcacccatattcttcattgatattagcatcatgtgcccacaagaatcccagtaaaggtatcaacttcagagttcttcatcaccagggaattctctcactttcaaggtgttcccgagtaaggtgacctggctttgcagcttactagatgtatgatttaggtcaaggtacttaaccttgctaagcctcagctttctaaaatgtaaaatggatgtagtaataatgctgcctccatgtagatactgcacatgtgtaaataagacaagaaaagtaatatttactatagtagcttagtaggaagcactcaataaagggaagctattggtagtgtattattgcaaacgccctgatttttctaaatgtcaaggagaaacttgtgtttaatggaatagttttcaacttcatttgattatatctttgggtcttgttatagtgccttctctctcagtagctaattagtatcctctaagtttgagtcttttcaagcgttcacgcttccatggaagtgttttctgcactgtgtttaaatcacgttagagaacttaactaagcttcaagcctagtagtgtggtatgtgtagttattctgacattcagggaaatgcagaagttcaggccagatagaaggctaagagaaagagaccccttggtgatgccacagatgactaacccagatgggggagatgagaaggctggggagctaagagccacagccagacacaagagaggaatttggtttgaaaagagagtattaagacatcaacagcctggaaagagaagtacaggctgatttgtgacctgttgagcaccaagaaaaaagatgtggcaaaagaaggcacagatgttctgaaaaatgcaaagaatttgtgatggctcagagtccaactgagggaaatgactgccaaaggcagatctcagtggaccgtgggagcactggctcgatgagaagacatgaggaggctaggacttcataactgacctttaccagagtgtcttcctgacccagagcaaggaagagagatgaagaggagaagatgaacaagtcgtttgagaagaaaaataaattagcaagtctttagaagtagattaaaatattcctgaaccagcagcctgctttttactaaaattcttttttttaagtcatcttcaatggcttgaacttacagttcagttaagaggatgtgtgtagctctgtctacattctctcatcagaactcctactactcagagtcaaaagcttcacttctttccttctatccttatcatatggaagctgctacaataccttgagggtcatttcattcgtcagcctaaaggttactaaatgtagcttttatataaacaggcatccagttaacatagtggagattacaaagaccatacccagcaggaggtcagtggattttgatattctcctttttcccaaagggaagaggcttcccattggggttacaaagtagcaggtacttggctggaaggctgagaagagagaatggaggctgccctgttgaaagactgtgtatcagaaaggaatgtttaaatcctgaacttaggccctcacttctgcttgagcagagcagagctacttatgcctaagtattggcataagtgatgcctccacacagctttctcaaacccagatgtgagacaaagagagcagacagaaggcaagtgtccagggaaataaaatggcccacaagcagttatcctggcccagtgtccctgcaccaaaggagcttccccagctgtgtgtcacattaggtctcacattgcgtattctcaaggaggccaactaattctgtaaccatggataggtcctgtgataaattggaaaatgacttctggggcaacagtctctagttctcagaaaggaaattcacagaagtgagcggttggccagaaggccaaaaggccattgcctcagagtggatcccaaagcagagtgatgtggccattcacagcatgtttgagtatgtaagaaaaaagaaaaataagaaagagtatgatttctcctgccaatatcataagctgagaatatttctctttgctgaattcagtaaaataaatcagagatttttctcgatggataattacatttgttaaaaagcatttaaggaggtttgggaatctgggcatgatgttggtcccagatgaaataaagatgagaacatgatttagcttggagacaaactgtaacttaaaccacacctctctttttctttttccttattcatagttcatttcttcaattcagaaaaatagttttcatgggggaggggattgggaggagtgcaatggctaaaaaacaggctcagtgaaggccagaagattactaagaaacctcttcagttgaccttgagtttgctgcaatatccaaagatatatggcattctaaaatacaataatttaaggaaggcatttacagtttcatggtcatgtttaagcaataatatattaagaataaaagggaaagaaataatagcagcaaaatcctgcagaaagaaaagaaataatggtctgatgagtccagattttatctgaaattcctgaaataatgttatcacaccctaaatgaaccattcagcctcagtctgcatacttgcttggtattttgaaaaaaaataatataataccacaacatgcttgagcactcttcgtatagacttttaaattttactgaacttagcagtaatttattttaccaaaaaaagaggatggcatttgaaaaactatgtttaatctttatcttctgattttatattctgggcagatgttgggtaccaatggcatagatgatgtcctgtctggaagcccattcatactatcagagataacatgtagttacggctagacatttccaaggaaactatgcatctgtccacctgaaaataagtgaatatcacacagagaactcatgtagcattgacagacaccaaggaaattagtgaaagaaaacattggcctatgttaaacactaggaaataaagcaaccttgtcaacaatattaacagtcctcctggggccgaaagagtcatttgtttaccttatgaagatgcggctttgtgaagaataaaagtaaaaggccatgcccaaggattattagaaagactcttctcatactaattctcatttctgagtgcccacagaagtgagggccatctctctttccttaggactccggttttcaaaatgtagtttgattctatcacctgcttcaaatgactctctaaagggctctttgtgccctaccttgagctggcttctgcaatccatatggatgggcttgtctccttcccctaatcaagcccaactccaaattagacattttccttcatcagactcaacactgatccctgctttccttaaattcagcttatacatcttgtttacatccaaaattaaatctaaaaaagagaaaactcttggttttctcatcaaacttctcttcactactatactcccctattattagctagaaacattaatatgccatatatatatatacacattattgattacaaagtgggtcgttcatgaccatctggatatttagggtcatctttttagaaggggtgcttgatattatctagcacatttggttgtttacatgagaaactgaatctcagagaatttgggtgacttgtgcatccacacagaggatttggggctgtaatccaatgttgttttcaatataccatattgccttgtttttattccctctctgcatatggcactgtgctaggtgctatagaaacattccccaggacctctcaatccaagaacaacactgttgatacaccagcatgaaagggacatcacacacaacccaactggcactcaagtctgcaccatgcagttatttatatcatgtaacaccaaaccatctcctcccactcgccctccctccttccctctctcctgtgttcaatctgtcgctgactctggctgctcccttctctgcgacagtgccaagagctgtttctgctgctgtagaggctgtcttccaacagtttactccctgatgcaggcccggatgcctctctttaaggagcgtccacctcccaacactctccctccagacacgccagactgccctggcagccgccaccccttcacctgccatcctggccatgtcactcccacccctgggacaaggtccagatgtgccctgagcaaaaaacaggtccctgagtgaggagactaatggggtgcagggcccctgagaacagagggcaggtgccaagttacaaagaaaaaaagaaatgaaagactttagagagaaactaaaaataaagagaatgtgttttaatatccctttggctgattcatctttctgtggcaccagaaagagggcgttaccctcgactcacgaatgccttatgttttgttacaaggcctctcttcccacatctgaaagagtaaaataacaataagagtgtaagtacaggagataatgctggtggcatagctacaatctccaagctggagccagtctcagcttacagttgtgtcagtctttctaaaaaaaagaaaaaaaaatgagacagctaaggcccacgtatgcgattcctcaacatcccttcttattctttctctggcagttttcatcttattcaggcatgggtccaagatggagtagtgattaagcggcctggtgacactgtatactgggtaactgcttattcccaaagcatggctggcaggagagggagccctggttttcagtcattccagggaggaaatgaaatgctaatacctagcctaccgtaaactccacagtggcataagccttgctcaaaagtacatcagtgaataaaaagaatgtcaaaggctgtcagtagcagaagaggaaaggaaataggaaaagaagagaacagaatgagatgagacatgaagtagagagagatgagagaaatactatgctgggtgaaagtgattgggaaaccatttctgaccatgtatttcaccacactcatcccaggccttgcagcattgttttgaaataagaagcattgatattaataccaaaaagccaatgattttaaccagtggattatttgggacaaatcaaaggtaacaaggggtcaagataagcccatacgccttatttgacttgattgaaagattcattctcatagtgtctattctagattaaaactattcagaccagtctatacaacataaagtttggacattctttcaagagaacagcctttcatttactttagtgaataacaatatctagaaaggccatctgcttcgaccaaactttggaaaggatgcatttttaagattaatggaggaagaggatacctgcccaactagctatgttaaccaattcaacaccataataataattgtcaacatttatatagtttaccatataccagccattgtgcaaaacactttgcatacattctcacttaatcttcatgccagtcctgggaggtactcttatatatcctttttacatatgaggacctgaatcttagaaggttgagtcctttgccaaatgaaagcttaacagtaaagaaacagtagaatccagactgtctggttccaaaacttgtgcttttagccacttcacatattgcttctgtcattggtatgacagatgtcacaggcagatcatactcaaattctgtaatatgttctaaataatacaaacaatataactagaaaatggtagctaacttatatagcaggccccactgaaataattcaaacataaaaatgacctcttggcatttgattatctttcaccttagacgttgataaaccaaaccattcccttaggacaatatttttctgtccagcaaagcatttctcttgccaaagtataattttgttggctacatctatctcctccaagccctggaatcagacctaagctagtaaattgtgctgtcctggcaagacgctcatcctccagggcattgtatcaggctaaagtaatacatcatgttgcttcccactctgtctgcccatttctccaaagagtcctaaaacagtaatgtttctgctttgaatctcttgctgttatcgcccctaggacttgcactttagcttcctggccttggaaaccaaggtgagctgaatagcattcttttcacacctgctcttgacttgggcttccaaaagaaaggaggctttcaacaaaggggcagccccatagaactctgcttcattccttttagactcagagaaacaaaaacattgacttgattgggtaacggaagactttggtcttttgggttatggggatttagtagctgagaaagagttgctgagtagtgagggtgggggcaggtcgtagagggccataattcctagaaaaagatgaccttgtccaattgagaggtagtgagaccagcaaacactggcaattaaaaattaacacaggccaaaagtgaaatcgatgcctaaatttgataggttttcaagaaaagtttatgacatgcagttcatagaaaagagaacattttctcagtgttcacttttaagatgccaaaggtcaatcttacttggaaagatccttccacagaaaagcagaaatgtacagggtctcctagcaaagtataaggcaggcaatagatatattagaaaatcttttttaaaaatcctaatttcaaaatgttttacagcagctttggtactacagtaattcacttaattccctaatatgtgtttgagtatatgtgtgtacatactcatgttattctaaacataaaaagatgtggccagttgacagtagtaaaagcttctttccatatctttactaagcacatgacaatgtataactcaataattgctttaattcaagttgtgatttcaatagacaaaaatttaaaggcaaaatattgactctcaaaaggttttcaagtaaatgcaaatcctatgaattctggaaatatcaaccattcaatgtattacattggggtcttggtaataatataatcacaattttccttatattagaaatttatgaaaggactcaagtcttccttataaagccatcagagatgtaggaaatattgggaggtgattctcccttttccacaaatgaaaatagtaattaaaatgctaaaatgaagactactttaagattattcatatcttatacaattttcctactagtatctcatgcaaaataatgcaaaccaaatgaatttatattaaataaggcggcccagggagaaaatcttgccctaaaaaactaaccgttccaagttattctaaattggcaatgtgtctggagttctgaaataaataactggtgtgaaaaacctaagtttccagattcttcagatcttaactgtaatatttggttgtgtaatcaatccttagttaatctaagtgaaatgcaggttcatttttattagctaataatttcatttgtgttttttatcagacatataattgaacattttctagaaatagcccttaaaatccaggttaattgtcttacctcttttttcctcctttcaaaaaaaaaaaaaaagggatcaactttggaacctcttcctgttagcaaatttctaaagaatagttttattccttagaactcaaagaataacaaatgtatatcttaagaactagttgcttcccaacttgaaaacgtttgcgtttttttattatttaaatactgactcttcaaatcaatgtcttccctttccaatgatagagttgaaatagttaaaataaaactttctcaagaagcaagatgggaagtttcaaaggaaattaaagctgaatgcattgttccaactgcattcccagaaatctataagaaacacaaacttatgcagcatcagtagaggaggtagtaccatttttgccagtgatgaacaaccagagtcctttgttctagaagtgatgaccccggttaaatctcagcattacacatttcccttcagagatggaggggagcgagttgcttgcatccattacaaaatgtgagactcagctaattggtgtggttttgatgatgccacagttctgcccaaaacccttgtaactagcaagtttgccctgaagattattgaattactccccgaccatgcattatttaaagggaagtgctgttattatagaagccagctgtttaaccattggaattctgtctgttggccaacttttaagatacagcagtacattgtgactaaacattatgtctagtcatggaggagtcaaagtctaggataggtggtggccaacttgtctggtaagcaatctttggtctacatgctatgaaacctttgaagcaaaactgacaaaataaatatataaatttttaatgtcaagactttgtcagcaagaaaaattatgtggaatgttatacatgcctattcattctaacagttgagtaagtgcatgaacacttcctcatgccagtacaacagaactgttggaccacaccttgctgtagaagggactataccaggcaccggtctttttttttttttttttttttttttttttcgtagcatcgagtaaggacaattaaaaagtgtttagagcatcttggggaacttcaaatagatagaaaacaacttttcaccttctaagttagaatatatttgcacctcttccttgaagtggtttccaaccatactgaatattgggcccaagccagttttctccttcatctcttcacttgttatagaatgtctggaatagaaaagaccatagcagtcatccactgtgttcaacataggaatcttctgctaggatctctgacagatgtttattacagcctttacttaactgtttcctgcaatggggagttcattacttttcattgaaatctgtcccatatgtaacacttgtaaattcaaattgttaggaatgcttttcttatattaagccaatatttgtttttcattcacctaccagctctgattctgcccactgggacagaattatacagcacctaatgaagagtttctcaaggcaaagataaaacaattagttccatctcatttaaaaattagtcgaaatgacaatagttataatttagaagtcattaaaaataactatctcaaataggaaaatgtcaaatactgaagccaattgttttattagctttctaataaattacattgtatcaggcctctacctgtagaccatagcagcaaatatctttattgtggttctggaaaaataaacaatatgtagcatttgaagatatggaacaaaactttgaccctcaactgtgatctttcaattggcgagaaatgagttttttgtttgttaaatattttgatgtagagccagaagaaatcaagcttacagggcacttcaaaagatgaattaaacttcaaaaggcaataggtaaacacttgttatattcatatattcccaatgacgtacaatgagtccattgtagacattatgagtagacaaagaaaaacatctctctaggattgtggtagctagagataattggtaattatatttatggcaaaatcgaagtctgtataccactatttcaacaatattttttaaaaaaacaaatgtagacataagataaactttctctatggaacattgcagaaaagtcctaaaattctctgtacctaaacccatcgatctacagactaaaaagcatgagctcagagtttagatgagcttagagtttgactgagtcatgtcaaattctgagctcatttaagcaaggtgataaaccagatgcctggtatttcctgttattttttttgctgtgatgatgatgactttctattttacaagaggaaatcgacatgtggtgagtttcatggttgtttacagtcaccaagaagtgaatatacaatcatagaaactctctctgccatcccaagatgaaggttaatgtcttcctcttatagcagacaaggagctccagcacctgtgggacctcagaagcagaattaagttagaggagcttgaaagggaaatactaaataggtcctggaatcccaaagcctgcccttgtctatcttcaaaggctaaccatgaattttgaaatcagttgtttctgagttggctaactttgaaagtttctggagctcttcctaccagcccacccccaaacatcaagttaccatttcataatcaacaaatgaatcccaattacatcccattaggaaatttatagtttcaacaaagggcaatcattacctgtaatgggcaaaagatacaatgatcacaaaataggccaagtcaccttttccttcctccccacccacaagagagaagccaaagggtatcagctgtgctttactggctagccacttagcaaaaagtacgtagaagtcctttgtggattacaaaggacagtgtaagcccatttgtgtctttcctctaatttatagttccaggaaaagattataaaaacaaaaaaacaaaaaaatattgtttacattgctcaggggacccgctgagacatggcttgccaggtcccagtccctcccaaatgccacagccattgggagtccacagggtctgcttcgagatctgcacagcagactctgcccagaaagaccacaaatgaaccctcactgagttactacctccagctgccctaagaatgacaataaacctgccttacagaaggaagcagccaccagggtcctgtgccaagcatcaggaaagcatttgggttcttagaggttgccatgaatgctggcccttccagcagggaggcagccaaactggtttggtagcaggccattaccatgggcctgatctcccccaatgagggagtgcaaaatacatgaggattctgactttccaaaccctatcctcaagtaatggtgtcattattacagaaacatagacttgtgatttaaaacgtaatgttttcttctgtcaggaattaagattgaatacatgtcagattaataaattggattcttctgtgcccgtgatttataaaatttcttccataaagcctgagcatccgtggagaagaccaggagagataagggaggagaagagaaagcaagtttctgtccctctgcccttgcctgagctagaacagaatcacatgaaagatggacatttcgttcactgtttcagtttggcagttactcaataagaaatagaattcattgttctggcctcttggggtggtaagagagggagccctactagattggtattgtaattagtttcaagtcccaagacttctgtacacggtcaatagtcacaatgcttcttcacaaaccacataggatcctggaaacggtactcgcagaaagctggctatgatttacttacgacttacactatatgtcaggtgctgtgctatgcattattcatacttgatttcatttaatcctcaaacaattcttacaaggaagatattattaactccattacataaatgggaaaactgaggcccagagagcttagtgacttttccagagtcatacaacagttctcctgggctcctcaatgaggcacttgggctttgcagcaagtagatctgagtttgcatcttgactccacgacttactgcatgaatgaccttcagcaagtctttgccacctctgagtctcagttttcacattagtaaaatgaggagccctttccaaacttaaaaactctttgatgttcaacctgactatatagtcaaagcagttaaacaaaaaggcaaacatgtgagctgtcctgcttataaaagcaatgcagcgttgccaacaagattaagaaaacaatgcatgatcttattttaatatttctatcatcctctgaagccaatatataagaaaagactaggattgggcatagacaagatccttgcctacaggttgcaaaacttggggagagttaccacaaatagcatggtgaatgagttagtgctaatgagtgtggtacagactccgggagacatactggcattcagaaagatacgtggggtcaggaatcattggggaagtttcaagaagaggttgagacattgcagaatatgtaggttgactagctgtggggagaggcaggagctgggtggaagactgaagaaagcagattgcaccctaacatgaggccactctgtttgatttgtgcagacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggtaagcccacctgggtgggatccagccatcctcaagtggtctctctcttgtgcatgtgggtgggccaagcagaaatcctgccccatagtctcctggcttacaagtcagaaaagctcctttgcaccaaagggatggattacatccccatctctttggtcactctgcattgcaaatttcccctcccaccgctatggacgatgtgatgattggaagatgttacaaaacagtggctaaacaaacatgggctttggtgtcagacaaaagtgaagtcctggctttctcacacaccagcttagagcccttggcaaataatgtgatgtacccaagcctcagtttcatcagtaacattgggataataataatatctaccacatcagtttgttgtcaaaattaagtagctcatgcatatactttgagatgcttttcacatgcctgcataaagtaattgttggaccatcgttaatgtctgccataattgcacttaataacaaagcttgtaacctttcaagttctgagattctacaatcttccaaagaaaataaaaggctaatgggaactattcaaaattcatattcagtagcaagcataattaaacatgaaacattaaaaatagaaatttctgtttggctataagaatgcctagacatttgtaatgatcaaaatctgcaggcatcattttctaagagctagactgtaaacaaacctcagaggtaccaactatgccatcagtagtacataaaacatctgatgcacatttagtcacttgatcgatttctcttgaatgagtgaacgaatgaacaaatgaatataagagattaaaattttagccattaagtagaaagaataagaactaaagagaaggtaaaggaggaaaaagagaaggcaaggaagttgagtaagggaagaaatagctctcgtttaagtattttggggactctgttgaaaaaagaaatgccaacatgtggttttaatctttggagctagaactaataatattgtgcaaaagcacaagatgagagatcaagaagttcaccatgacaccttcgctgcttcctggtcttaaacctcagctgaggctggaagaggaccatggtggcttattggagatgtgaccccagggagcccctctgaaggatggaaggggactgggcaagacccaacacacacagaacacagtagccactggccaggcaggaagcaaggatctcagaaaagacttttaggtgaatgtggcaggaaagcgtgcttgctggggcaaaggcagattcattctttctcttcccaggtgacccagcgcctcttggtttctaactggggagggggtaggtgtcaagagatgagtcccaaagttctggaatggtgggtcttgtgactgaggtctagacccctctccagcatgagtgctgtctcctgcatcatatggagcctgggcattctgagctcattcaaagggacaccatgggaaccacttgttctcaatgcaattatttttgtgatgtttacagtatcagcccccatctaccaacaagaacacgaagtctcagagaaggaaaggttggccaaagacacatccaggaggggaacagaaggaggggacagaagcaagtctgcagatcagaggaaagaagaaagagcagaggagggagattggaagtagaaatgctgaatgcagaggcaaaaaaggaaaatgaaggacaggaggattaaacagacagaggcaaggatgatgagagaggagcagacagcaagaatgaaaagcagaaaatacaatagaggaaatgaagaaaagtaggcctgctggagctagatgatgatgtgatggaaatagaagtaaccttttagagaatctcgctaagaaacatggagaaaacggaaaagaaaaatgtaatgccctagaaagcgcaaagaaagacagtggcaaaaatgaaaaaaaaaaataaaaattataaaagaggcaaaaaaagacacactattctctgcctctaaaacacaattaaataaaagaatttaaataaaaattaaggcttctatatgcatttttaaattttgtatgaatctgttatggaagaattgcctatgtcaatatatgttcagagttaaatattagccccaaatgctcagcaagactgaattgtgtcatagaagttcccagattcccttttcccgcaatgtcattggaggctgcatttcttagtcaagtccagggtttaggccaaagggcatccggtattgcctaaaaccctgtgaggtctgtgaggtaacttttgagaagaggtcactgcactcttcttcatcttttttgcactttggaatcagatataaaagatgtataagtttgctagggctgccataacaaagtatcataggctaggtagtttaaaccacagaaattgattttttcatagttctgggagttgaaagtccaaaatcaaagtatcagcccttgcaagggccttagagaaggctctgtcatgggctcctcccctcggcttgtaggtggcctccttcttctccccctgtgtcttcacttcatcttccctccatacatatctctgtgtctaaacatcctctgtgtgaaacaacaccagccaggttggatttgggcccaccccactgacctcattttaacttaattatctctgtaaagactctgtctccaaatacagtcatattttgacgtactgggagttaggacttcaacacatgaatttggacacaattcagccagtgacagaagacttctgatctctgatgataaccactgcattttgattacagctcctagaaaacactcccctccaccaccccaccacagatctatttttatatctgaaaccctgagtttctgctccatgagaaccccaggaacatactatgttagatctggaagaggcctcagaaatccccttattttgaagactaggacactgagatccagaagtgggtaaagatgtgcttgggttctaagctgctcttcttttggccaggagacaacagcacataatcaaagtgggtcaactgagaaagaattccagaaggaaaagagagggcagaaatgaagggagagaatgagagcaaaagtgctggatttccctgagggtgaagaaaagttaaatagaatcacagaattcagattttagagatcttctccttcagatcccttggtttaatcagtaggattggggtcttcatagataataaagcaaaaactctcgccatcctccaagttgtgaattagaagagctgagaaagggtacaagacggaagttctctaccaaacaaatggtgacattttggggtaagaatatgactaacccagaagtgaagcatttcatccaagtagtctattttgaagatgtcatggtataaaggaacctcctttctgcctggtcctccatgcctctgccatgctttttactccaggatcaccctttctagtggttcactgaaaacccaggattacttaaatatgatggacatgttcacggctcaatccaggaggaaaaggtcgaactgaaagcatgccaaagccccacatgggagccaagccactgctgctgtggttgcaaagtggatcctggcttatcagagcagagagaagccaggctcgtgccttagcccaagtggccagtcaccttattcaggagatactaagttctccagctaagacatccatgctttgggaccagctgcagacagaagccaattcctactacaaccatcaccttagagtagcatatagacacagatggctcttcaaaggaccacagttccatggaataactaagaattcatgtcctgtggaaaggtttgaataaactataattatacccaatcataaatttcattcaagaagaactaaagcaaaggcaaagacagagagaagaaggaaggaaggagggagggagggagggaaggaaggaaggaaggaaggaaggaaggaaggaaggaaggaaggaaggaaggaaagggaaggaagaacaaaaagactttctagttaaagaatgcttaactagcaaactatgtactataagacagttcttttcggaatgagttttatcaactctaaagcaattatcttgaatgcctacatgtgattactgaataatatgaaccaagaaaacagaaagaatctatattatctttccatttccttctttccagtatcaatacccaagcctctagtgatacatggcatataatgttggatggatggatggatggatggatggatggatggatggatggatgaatggatggttggatggacaaatgagtaacataggctgatgaatagtggtagaaagacacaccataaaaacaagtggcacttctgagatgaaatgattcctattctcctacacaagacagtgaggcaagtacagagtaaaaaaggaaaggcataggagctatgcttatacaagtattgtatgtttggaatttccttcgctggccaaattgaaattgttcaaggacctattgctacaggtggcaactggctaagaatttcatagtgaatattatacacctattactccccttaatgtttctttgaagtaagcagaatattaataatcatttaaaattccagtgtttcaacttcaattgtttcctagggcaaattgataattgtgtgtaaaactaattggaatatgtatggaataatcatcctgaaataaaattggtgaaaagtatttgttattgggcatctacaatgtgcaaacctctgtactaggcatgaacaagagttataagcattggagaggctaaaatatagtccttaaggctgggcacagtggctcatgcctgtaatcctagcaccttgggaggccaaggcgggcagattgcctgagctcaggagttcaagaccagcctgggcaacatagcgaaaccccatctctactaaaaatacaaaaaaattacctgggcatggtggcacgcacctgtaatcccagctactcaggaggctgaggcatgagaattccttgaacctgggaggcagaggttgcagcgagccgagatcctgccgctgcatcccagcttgggtgacagagtgagactctgtctcaaaaaaaaattaaataataaataaatagtaaaatacagtcattaagagtacaaaatgtagattcagactacctgggttcaaatcttggctcttacttgcattgtggctttgggcagatcatgtaacttatgtgtgcctcagtttcctcatctgttaaataggggcaacaactgaatctaccttattcagttgttgtgagggtttattgagattgtgtgtgtgtatgtgtgtgagtgtagtgtgtgcatgtgtgtgtctgtgcaaggagtgggaggtgtatattcagagacacatattacagcacttaaaatggtatctagcacttagtaagcattattcaagttttagttaacattattttacttacctctgaaaattggagctatgtgaaaaagaagttggtctcctgaagtagaagccagtcttgtgtcaccaaaaacttcaagcccaagcttgccaacgcttttccatgatgtggtagtagagtttcaagcatgtggtaggataagagaactcaatgacctaagaaccattccaacccagagaacccctggttctatgaataattccaacttaaataggtagcttggctctcccaagtgagagccattgcttctgtttccgggtcatataatgaactttcagaaaaccaccatttttctcaaccagttaaaattaagtgtaatacgtgctttcatttcatggtgcctggggaaaatttaattgtagtatgaactccagttattggtagtcttaagtaaaattgccaaaataaatagaaatgcaggatatttctgggctcacacagcttccgggacactttagtttcttgggctgccaatccagtgcctttcacaagcatttgatcttttttcaaacatctcttgaaaacaaacaaaacctcacacagcttctaatgtgtgcactgttcgaatgtaagggtggaaaaggaggcaaagaaatgagctcccaaagagcaattccccttctctcgcctccatcccttgacgacctccctcccactaaagggaaacattgttttcttaggtaataaattctgcaatttctcaagtccattaacatccactgggcaagatgagatctattctttttatttgcccataggaaaagaatagtgcttttttgcaatattcactagataacacagagttgacttttaatccaagggcaacattgatagtctctagttaaaggggaagccttcaggagcaatgaaaagattaatagttttagatgaagcagaatccaaatccctttttatgagttttgaaatatccagtttgtatgctcacctcaatacttaaagcccagttactgattcctttggcctaagcaagacaggtcaatttttaaagagggagtagctgaggttagcaaaaattctccaggtccacaaaacttccagacctgcaaggtgaaaatcagcttttctgtcatccctaaaggcctaactggaatcagaacttttccctgatgcccacatatttggaggtccttttttaatgggactccttaatgcctttagtgccatcccattttcatccagtgtccaaaagaaatgatttaaaaatataaacgtatgtttaaattccagaagagagaaatggagattgagaacaatagggaaatgatgagagctatgggaaaagaggtttatgagtccatgtctgattcttccagagagcccctaagaaagttcttatcataccaggaactcaattataactttcattgcctattgttagatgagtaacaggagctagaaaacattttggaaattcccatctttatttttttaactaatatgattatagttttaagaaccattggtcaagaagctaactttttaaaaagtggaagtatgatggttagaaataagaatgctaaaggtacatcaagctgattttaattctaaatgtccttggcagcaatttagaatctgtaataaactacaccaaacagttttgaggggaaggggattagtttctccccttccttcgtgtgtgtgtgtgcgcgtgtgtgtgtgtgcacctttgtgttctagcattgttgcacccattacagagctggggggaactattttccaaaattataggtgagaacagtttcttggattgtctttcagtgaaggtaaattcctctgtaaaaactaaccatcattcagtaaaaactgcaggattcctttgtcttctcaaaagcctgtttctcatcctaaattaaaaattattcaggaaatagagaggacattattggaggggtggaaataagttggttttctttttattgtatcttttgaggatccagggacttctaccatttcccatctaacatacagagaaggattctctaggtccctgtctatagactgcagtaactttcctatagaaccaatttgcaattttagaaatttctaggtctaattattgacccattacaaccaaaggtcaatgcatccagccaatcttccttctatcatcccctgcccttacttctattagggactgggattacaggcaaaacccatcaaatgcctcttctaccactttcccatttcttaaccattagcctctaacttcctctattcagtttctcatatgctttcatgcccattgggtcagataaaggaacattcatttatttgagtaggcatctgttatgatcactccggaaaaaagatgacaatgggttaccttgtcctcctgggcttctctaactgacatggtcaaaatgcccatatgaagataagatgttaagagcaagatttatgaaaagctgagtatgatggcagctcttgtctcataaaataactcgaaagttcccagtgaaagaccaagaaattttacatcaaacccaaaccggccaaatggtccaagcttccaagctgggatccatggctaaagtttctacaaaattctgggtacaatgtataaacattcacttggggctttctgtctagccagcaccaagaggtcaagtaatcaaggaccaactagccctgccatctgtgaaaatatgtgctattttcacggctttagttcacaattatggcaagacaaaagttccaaataattaggagcaagaccatggcaggttgacggttgagtaaggttctcaatcagccgacaattgtagagttggggatgtgcaatgtttatgtcatggtgtaagtatgtggcatgcttgactagcttgtgaggcactggaagactagaaggaatgaaaaatatgaatgaatcaataaatgcatagtataattactgttattttgtcagtattgttttacctaggtcactattgaatgctctgatttgtctctttataaataataatatgttttcttcttcaaaagaacactaggatgaaggtagaggtgcttttggcacaatgccacaattctgatttttttaaaactgtatgcatgcataaaatgttcttgagccattctctgccttggaatagcactggctggcattctgcatgtttacttttatatgctgaaggcccccatcaacctcaaacagaggcaaatcaatttaacttctcatagtgttattttgttcatcctaaaagttcaagagagccttccaaacttccaaaatttctctcaattcagtgaggaggaaaattcagaacacagcatttgaatgttctgcccagatttgtcacacacacaaggaatgagtgaaagagggcaacaccctttcctcctaaccctgtgaactcatcactattgcattgaaatgacaccaaaaggtaaaaaccctaggcctcacatctcccaagaacactgcaataggagttactgcatacaccagtttaagtaactctagcataaattgtatgtcagatgaaacaatggcattttggaggcttaagagaaaaagaataatcaaatccagtttttaggtactaatgtgctgaatctttagcacatagcagcaaaattgctagaatctggtgtttcactttttaaaataccacatttgaacctttcagcaattccaaaatcaactccctctgcgaaagataataagcttaaacattttttaaatttaaaaatgtaacacaaacaaacagctaagcaaacaagctgcccataaaatcaacagtctggggagccctgatcctgaagtattttacaacatccttcatgactattaaaggcaacataaacacctcttgtcagcaagggaaactacccttggcatttttttttctttgttccccaggcttttaaaccattttgatagagattttttacatcacaggcagaaatatttgaaatagagtcaggtggtagtctttaaaagagtaagaaagttgctaagtcaagataatcttggaataaagtcctctgattcctggggattcctagggatgccccagtcactagaaaacagagctgtaagtccactctcccagcactcaacggagctccggaaaccaaggagctagctactgtttccccacattcagccagagaaagggcagcactctagcatgcaaactgctttgacaatagtaacaattaaaaagtaaattaaaaagaatcataatagctgatattgattaggtacttgccctgtggcaagagctatagggaatcacctcatttaatcttcacatgaagcttgcagagtgagtaccacaattatcactattgtatagacaggaaaactcaggctgagtatggctaagtgtcttgccaacgtcttgggctaacaagcggtcaagcagaatccaaacccgagatagatagaccacagtgtgctaatcaagcactgcactctctcctgcatttcttagttgatatttaccatatacaatctgtcacttgtatgagatggcagggggttctgtgctatttgtccttgtagagaataccacaggaagaaagtaagcagccatgcaatatttgctgttgacctgaactccattccatcattcctgcaggaaattcgcatccattaaatgagcatttcctggtttgccactttgctcaaacactttgcttggatctggagaggatatagaagtgaaggaaatatgctacctgctctcaaggaacttatgttttagtggagagacaaacatgcagaatttactctacagaacatcaatgcttgagcaaatgtagacccagagagggctcttacagcacacaagccagaacagactgatggtgctaacaattaggttcaaggtttttctaaacagtagactctcctgcatacaactataccgcatgccaggtaaatgactgagggttattacatccaattataacaccactgtgatgtaggtgctcttaccccacactttcattttacagaagaggaaattgaggacagcacaatgtagtgattatcaaaggtcacacgactactgtgtgggagagctaggatttaaaccagatgcataagatgaggtcctccaagaaacagaagatgagaaggtgttaaatgagcaggggttttattagggggaattaatgtgtgaacagaaataggggaggataggcaaagccatcagattgcaaggcaagcctaaccccaagggaaggagagagagagagtagattggttggaaacatttttggtgggtctatggtctaaggaaagttcagcaaagtcatcatggagtttttgagccaaagttgggcaatacagttgcccaacaaatttctgtgtttctcagaaataggtctgcctcaatgtccccaccatacttggtcactggctcttgggaggggcctgccctgttccaatccactagagccaaagaagagccgttgtactggcagggggtgggggaattcctacaaccacataaaaagtggggtgaggtttccagaaaaaaacgtgatgctgggctaaccaaaactgtgtccagtaagtacatatccctcactctgttaaagaagcagccacataaacaaggagtacacgtttctcaaagtgtgcaccttgttctttggttttgaagtcacatcccaaagtgctgagtagatcgcatgaccctcgctttgcctggctgccagagaggaaaggctgatccaactctcctggaatttgaacttgtgattccctgaagtaaagagatatcaaagttgatactgagacatctaaatcatcctccaccatttcacatgtccccaggccaagccagcaaaattgctatagcacatccctttcaacaggtaaagggctgatatctgagccctctttccaatcatccactgctcttttcttctcattttgccctttttgggagcaggtcaatgctgagttagtactttatgctgtacaataagctgctgatattccatgctggacagaattttcccagtattttttatagagtgccaggcttttcctagacttcatgtcatacaatacttaacttgtttggagtgggtggagatggaaacatagtctattgaaaacatcactgcttcctccctgaagtttaaagagcctatttttatccttttagattctatctctcaggcaaaatctcataaagataagtggggaggaaaaaaagggggttataatacctagggagtttgcttttgctaattgaatactgtgctcctagacttctataaataccattacaaatgggtcccagcttgtggtaatactcaccctcctcattgagtcttctgtcccatggcacagcctttccctccaaactagcatctacccccatctggaagcatgggcagctcatgatattatcaactattgctattggaaagtgatttggacttgaaagcactagatattttttacctcttggggaggcagtttagcagagtggttaactggtgagctccagaatcagaaggaataggtccaaattccaaccactattacatctccatcataagaaattaggcaagttgtttatcctaagtttcagattccttaaagataaaacagtcaagacagtagtacttatccctgagagaagtataggaaacaagaaaatatatgcaatttacatacatactacaatccccagcacatgacaaatgttcaagtaatgggaactgttattattttagccctttgtctatcagtttgttcctctgtgacctcaagcacattactaaatgttagcgagcttcagcttgtacgtgggactgacaggaataacaccgcatcacctcatgtggtgattgtaaggattcagtgatattattttgtaaactgtaaagcctttgcaaatgttaagcaagattattattattgccgttgttattagtcctcagtgatctttttttttttttttttttttttttttttttttttttttggagacagagttttactctgtcgccaaggctggaatgcagtggcacaatctcagctcactgcaacctccgcctcctgggttcaagcaattttcctgcctcagcctcctgagtagctgaaactacaggcacacgccaccacaccaggctaattttttgtatttttagtagagacggggtttcaccatgttggccaggctggtctccagctcctgacctcaagtgatctgcccacctcggcctcccaaagtgctgggattacaggtgtgagccaccacacctggcacagtaatcttaattgaaaagtctgtggatagctttccaaaggaaagcttggagcttggataagaaccaagagataatgggagaaggtgaatggcctcttcagggccttttctagcaccctaaatatgcgtgtctgtccataatgggtaatcatatatatcacaaatcaaaccctccacaaacttatttcctaatgtgtttgttaacctttccttctaaagggtaaacttctttaaccaaccccagtgagctggaggatcaatgttttcttaatagtcttaccttcgttggtgtcaataggaaacagtatttactcactactgttttccttttaaaaatctgtctagttgcatactagaaacagtttcagctggtttgtttgtattggacaagctgctgaagtgaaaagtttttgcttgactgaatgtgagacagtttcataactcttcaagaagtgcaccaaaggtgggtgccagctctgatgacggctgcttctaacatgcctccacttgccgcccattgtcaagggtggctggcgtaattaagttaagacaatgagcaaagcaacagatgcaactgagacctagtccctgagtgcttttgttttgtcactgtcattgtctgcaacaaagaagtcacatgtgacagcctgggaagagagccaaatgcaaaccagacgatatcccagctggtttgaatggcctccaccgtgcacgtgtgtgcatgggaatcatgctacttggtacagcatctgcttcactcaagtgagtttcagcccatggctttgctgtgatgctgagacagacccagaagaaacagaccagggaatccctccgctcagactttacactttataccttgtgctttgagagaaaagaaaaagaatctctctattggagacaaaaaataggatgtatgtggttggtcaatctaacctcaattctttttgctatagccccccgctaatttaaagagtgaagcatagatggtatcttaatgttttcttgtagaaatttgggattaatttggcttgagaggaagaatggagattaaacgctttatgaggctttcttttaatttgttcccatttcattcctgaatattttcttagtttgggcattgcagatgtttaaagaacttcttattttgagctggtatgcctcttaaacagaaaaacaaaaggtaaaattcaaattagtgtgtttctccgcctgttaattaatttggttagtagttaggcagagagatggcatccttaataatatctattttgcgggtttgatcagctacagaccatcaacagtgttgattgagaattgaacaaaaacatttcaaggagtttgggaacattagtgatgctattctgtggccccatgtgtccttctctcatttttctagagaactcctataagaaagcagaacacggccaggcatgatggctcatgcctgtaatcccagcacttcaggaggctgaggcaggcagatcacctgaggtcaggagttcaagaccagcctggccaacatggtgaaaccctatctctattaaaaatacaaaaaattagctgggcatgatggcgcgtgcctgtaatcccagctacttgggaggctgaggcaggagaatcacttgaactgggaggcaaaggttgcagtgagcctagatcacaccactgcactccagcctgggtgacagagtgagactccaactcaaaaaaaagaaagaaagaaagaaagaaagcagaacccaatggaagattaagaacacacatttagcttacgcctgtaataccagcactttgggaggccaaggcgggtggatcacaaggtcagaagttcgagaccaacctggccaatatggtgaaaccccatctctactaaaaagtacaaaaattagccatgcatggtggcaggcgtctgtaatcccagctactacagaggctgaggcaggagaatcacttgaacccgggaggcagaggttgcagtgagctgagaacgcgccactgcactccagcctgggtgacagagcgagactccatctcaaaaaaaaaaaaacaacaaaaaaaaacaaaacacaagtttactgggaacttagcagtagatgctttgcaccacaacaaatgtatcttaagtggtcttttgtgatatttgagggaaagtgccagaatttaaaacaaatggcatttcaagttattctatacaaatgcccagtttctttctaccatctttttttcctttttgcagtggtcactgagctattttagtgaatgtttttacacaatgatgccatcttccttctactcagtcagtacaagatgttgaccatcgactcataaaacactagctacctttcatgaaggacttggtgataactctcatgttccaagtagaaccggaaaacatgtgtaagaaaacctgccgatccctatgggccttggccaataggtattattcccaaggggtggcagtttatctttttccccagccttcatattaaaacctctcaccttctccaggtctcaggtctgtgtaatctcaaatgtgctttagctcctcacaatattgtaactgtgtgggtgttcattaccttagccagaagacagtttacagattccaggtctcatggagagaacttttgtttttggttatgaacctcactgtataccaataattatccattacatccttctgtagagggctctctggctagagataaaaccaaaaaaagaagtacctcaggtttatgcatataaatgccagttcctccttgattttatttcaaaactcctgtctacatactttgcaatttaaatacattcaaggataaagtaataactgtaggaaaagtattataatataatgacttagttctgcacatcacaagggggtccctcatactcattcattcatttcactcattttacagatatttattgagcacctgcaataacctgcacactgctctagacactgggactataacagtaaacagacagatacatctctggtctcacagggcttctattctaagcaaaactcaatatccaggccgggtgcagtggctcatgcctggaatgccagcactttgggagaccaaggccaggcagatcacctgagcccactagttgaagaccagcctgggcaatatagcaaaaccccgtctctacaaaaaaaaaaaaaaaaaaaaaaaaattgtcaaggcatggtggcatgcgcctgtggtcccagctacttaggaggctgaggcaggaggattgtgtaagcctgggaggcagaggttgcagtgacctgagatggcactaccacactccagcctgggcaacagagtgagaccctgtccaaaaaaaaaaaaccctcactatccttaagataacatcattgcttgttgatgagtgaacgttaacaccaaattaggaacccaggacttttagtcttggcatggttactttccaataaagatgacaatactaagaagagaaaaatgatttaataatgataatagtggctaatacttatgtagtgcttaccatgtgccaggtctattgtaagtacttttatatatattaattatttaatctttgatcctataaggtagatattattgttaccctagtttatagatgaagaaacggaaacacaagagattgccactcatacaagtttacacagccagaaaatagaaaagctacgagttgagctcagcccagtatgtctatgattttacagactcaaaattaattataagatttcctaatcttcgatttctgaaactctgccttgctctagaggaaaacaagaaaaacaatgaaaaataaatgtctcttttttacaaaaattaaaacagaacaaactgcaataaaacaacagaggatgaatccagaatgtgattgattttttttcttactaggaaaggatctagaggccagaaggctggatttttcaggatctcctttcaatcaatgaatctgtgatagaagcagatgaatcaaatctcatctttgtgtgattataaagctgtctgtggtattcacgccaccaggggtacatagaagatgcctgagtgaggtttggcaaaagtactaagggcctgtccacctatacatgcccttctcaggaaaaccaaggttcaagctctctattagctcaactggtaaggcgtaagacatggaaggttgaggcccaatgttagaaatagatggatacataaaacttcatcaagttaatgtcactttttctcctttatttataggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaaccttgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcag

SEQ ID NO: 13395 - DNA, 29907 bp, Human
tcgcttgaatctgggagacagtggttgcagtgagccaagattgcaccactgcactccagcctgggcaactgaacgagactccatctcaaaaaaaaattaaatgtgaaggccaggcatggtggctcatgcctgtaatcctagcactttgggaggccgaggtgggtggatcacatgacgtcaggagttccagaccagcctggccaaaatggtgaaaccctgtctctactaaaatacaaaaattagccagccatggtggcaggcacctgtaatcccagctacttgggaggctgaggcaggagaatcacttgaacccgggaggcagaggttgcagtgagttgagatcctgccactgcactccagcctgggcaatagagcaagactccgtctccaaaaaaaaaagaaatgttaaaaatggttttaacactagcctctcccctttatttgcaccctaggacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctgaaagattccaggaaactgtagcttcctagctagtgtcatttaaccttaaatgcaatcaggaaagtagcaaacagaagtcaataaatatttttaaatgtcacagatcaaaattgtttccttcaaatggggtctgccaattcacaaccagatgacccattttaccctattcactgcagactgaatccagattctacacatacttatccccaccaagaccctcactctgtctccattggcctacttgttcatctttcactcattcgacaaatctttctgaggtaagagcgaggtgggacaaaaaaaaaaaagcataccaatgaaccagacacggtcttattaaagataatataggtttaaaaaaaaaacttggcacagtttcttagcacttaggcagcctttggtatttatgactactatcatcaccattaccaccatcattatcagtcattgtcatcagtggtcactgtcttctgtgagtttccaatctagtacaggatcatagttcagggctagagagatggcatggagtatctcaaatgccattcagaagggcctcaagctataaaagtgggaaggcatgacattagtttttaacatgagagttaaatgatcagaatgacaatataaggaaattaaactagcaacctggctgggcgtggtggctcacacctgtaaacccagcactttgggaggcccgggggcggggggtgggggtggatcacttaaggtcaggagtttgagaccagcctggccaacatggcaaaaccccatctctactaaaaatataaaaattagccgggcgtggcagtgcacgcctgtagtcccagctacttgggaggctgaggcaggagagtcgcttgaacccaggaggtggaggcttcagtgagccaaaatggtaccactgcactccagcctgggcaacagagaaagacttgtctcaataagtaaataaataaataatctggcaaccatttgtaggaatgaacaaagagggaaataattattacaacaactacagagactgccccctgaatgacgctttcctcagacattagaaggaaagagaaaaaaggaacactcatccagcatctggcttctgtcatcccagatgacacggaggcctaaattgggatgcttgccttatgagaagaaacattttaacggagtggtgggtggggtggggccctatttatgacacaagagagcaagcccctcccttcttgtaagagagtgctaggcacatagcctcctcctattcctaatcctcccaccaaagaaagaggcacagagttcattacttagtgggggccagctgtgatcggccaactgccagctgccttaaaaaggaagaccagtgatgctaggatggagtgaaacccaagaggaagtgccatcatgaggaatcaatgagagatctgtgaagagagagggctgggtgggagcccagaaggatagaacctggaagatcaatatctcccgtgagggaaataacaatggagccaggttctaagtcagtgtctaggtcagactggcaacctgaaccacaccagaggcctataaccccgctagagcctgggccagaaaagacacccatagcccagccagaatcgaagactctgcagggatccaatacccaacagaagcctgcttcaaaccaaagacccctcacccagcaggagacccctgcacaacatgatgctgaatcccagaaggaacctagagcccaacaaaaatctgcttcacaagaggaatttcttgccccacagaagcccgcaccacagcaatcaccttacatccaaagggtgctgctcactcaacaggaagctgcctcccagcagggacctgggctaggaaaagaatctataactcaacaggagccagcattgagacaaagacatgtagcccagccagggcctgggccaggagagccacctccagctcaacaagaagctgaatcaacacctgcggcccaggctaaacctggagccaaaagggagccatctgccccgactgaatctacgtcccaagagacacctgaacagtcagacaagcaaacaacgccagtccagggagccaaatccaagcagggatctttgacagagctgggatttctaacaaaacttcaggaactatccatacagcgatcagccctagagtggaaggcactttctgagtgggtcacagattctgagtcagaatcagatgtgggatcatcttcagacacagattctccagccacgatgggtggaatggtggcccagggagtgaagctaggcttcaaaggaaaatctggttataaagtgatgtcaggatacagtgggacgtcgccacatgagaaaaccagtgctcggaatcacagacactaccaggatacaggtgagtgtgaatctggaggaattgaagcctctcagggacagtcattcatttacttaaaaaatactaaaaacttacggtgtatcaggttagctctggtcatccttcaacaatcctgagataaagatcaacatccccattattaaaaaaaaaaaaaaaaaaaaaaaaggctgggcgcagtggctcacacctgtaatcccagcactttgggaggccgaggcagatggattgcttgaggccaggagttcaagaccagcctagccaagatggtgaaacaccgtctctactaaaaatacaaaaattagccaggcgtggtggcaggtgcctgtaatcccagctactcgggaggctgaggcagagaaacacttgaacccgggaggcaaaggttgcaatgagctgagatcgtgccactgcactccagcctgggtgacagagtaagactccatctcaaaaaaagaaaaaaacaaagtctcactctgtcgcccaggctggggtgcactggtatgatcatggctcactgcagcctcaaactcctgggctcaagcgatcctcatacctcagcctccggagtaggtgggactacaagtgcaccaccatgccccgctaatttttacattttccgtagagacgtggcctcgctatgttgcccaggctggtctcgaactcctggccccaagcaagcctcccacctcagcttcccaaagtgctgagattacaggcatgagccaccgagcacctggccaacatcctcattttagaaatgaggacatcaggtagaaaataaagaagtaagggttcttgcacagggccatgcagttaggaagtggcaaagtcaggatttgaagccggggtctttctcccctggaccaggctgcctccctatagaggatttggggaaaatcaaatcccagagtgggaaggcactctgagctagggaccaggagaccaggaaagcggccctcttgccagtgttcattcatccatccacagaaactgactgagcaccagctctggggtagacacgggcgtaagtcccagcaatacaatacaaagacggtaccttacccttctggagtttccaggcaggctaggcagaacattggggcatcaacagtctctcagtttaccaggtctgtcctcttctgccaggaagatacctgctccctgccaggctgcctccataggggactcagtccagccaggcggaagggccttgcgggttgtgttctcagcaaggaggagccgggagagaggtgcgggagccgccaaggtctcaggcaaggtcagggactgacggcaggaaagttgggggagcagcatcagaggataacgggcccaaggctctgggctcaccgcaggcactccctcgccttctccgcctcttcccggggcccagtgctgccccctgcctgcttcacaggagccccaggaagctccgatcttccttctctaggctcaaaacccctgccatggagaaggggggaatacaagttttatctatggaactggaggttacttgttgaagtcccctgatgtggggggaaaaaccaacgcagccctaatcctgaagctgagggtatctgtgaggccctggtccagagggcaggcaatggcggcccctccgcccagaggccagtctgtcttgtctctcccacagctgataagagagtaacgcgtttctcagcgccggggctgctgggtatgctttgagagggaaggaagaggggcggcaggcaaaggcagggattgaggcctgctctccccagtgctgaggatagaaagctgtttctccaggcctccagagcacagtctcaagggatgcccgccccacaccaccgcggcgggcgaggttgcctttcaggcggtccagaagcagttggctgtgtgcgtgtgagcaaggcggtccagaagcagttggctgtgtgcgtgtgagcaagcctcgagcctcctctgtttcccgccatttctcaagcatgcgtcgttccctctacctccgctcttgggccggcccgcggcctgaagctagtgcgcaggcgccgagcgttctcctaccaccatcccccaccctcattatcgggagcatggattagggggcggagacagagggagaaagatcccccaggaaaagcgcaataggagaactaggagacaggagagggaaagcggggctccctcctccaacggctctcaggcacagccacgcctccagcgctggcgccccgcctcgtctttgagttggcagaggacctggcccgcccccaccccaggcagaggctcagaggcgccccactttcccccttcaaaaggcgggccgggccgcgtgctagggcatccctccctgggaaggtgagtgggatggcgagactgagccagcacatgggaggcttcccagcacgtgggaagatcgggacttccctgctggggtgctccccgcggggctccgcactagtcctgcccgaaggacgcttttcgccacccccggggttgcctttttgttggccgcgagccctttaatgcgcggtagggggcggagccagatcttaaattctggcggttgggggcggagcacggcagcggagggagaccagaattggttagggagctggacccagagaagagcaagctcgggattgggtaataggggggcccgacagtagtgtgtagcgaggattggccctccgggcagggcctcgcggctggaattggcccccgcgggaggaccgcggggaattgatggagttggccgggggaacggagcccgccgaggccgctatggccccggcctcgaagaatgccaaagagggctcaaggagccacggtcgccggcggtggcgaaaagacaaggccaaaggtgagcgcgcggagaccggcagcagcccggaaggaacctcgtacatcctacggggcagtggggacagcgtggactggcccactgccacagggagttgggggggtccgcggactggcccattgccgcttgcggggacaacgggatgatccattgtgagaagggggtgatgtgacagccgagaggcccaccctggcacagggactagctgacgcccggatcggcttgggagcagagtccggaatgcgagcttcgtggaccagggttcccgctcggattccgtattcgctgtgtgaccaagggcaacggatgccctcagtgtttcccacctggggaatgcttcaagcgccgatgttcagggctccagcgctcttgagaggataagggggaaggaggttagcaggtgttactcaaagaggaagtctagcggtgagtcaaggagaggtaggaggaaggggtgcccatagtggagagtgcagcggggccagtaaagttcatcgcagtcccggcctcccacccggcaagtcagtccatccatccatccattcattgtcagtcaacccgcttcagccggctccactggggcctagccctgacccctaccctttccaggacaacgggccctggcttggcttcagacctccacacctgcctcagcaaaagggaaggcctcatttctctagggtgtcacattattttcaggtctcaaaaggcggaacaaaggctgacagaccaacagaaatgctgcaagcctcaggcaggggcaggtcctcagttacaagcatttatcaatcagcatggggacccgtgggaggttcccatgcaggaaggaaactaacaccacccctcagccccagggaccccaaactcattgcttcccctgccgtagaacacatcattagcccagaatagacctggagttggcttcagacacacgcaggctcagacaggctcagagggcagacggactggagcccaagggcactcgctgtcacagcaagacactgagcctcacaccagtatagcatacccagaggcagtacagactgtagttaagaaacgtgggcgtcggagatccggttcctcaggctgggagctgtgatgttctgggcaggagactccctctttccctgcctcagctttctgagctctaaaatgggtatgatgataggagtacctccttttgtgaggttagaatgaatgtagagcgtttggcacaggcacgcagcaaaccctcaggagaagtgaaggttattgttactgttagtccccaccggacggtgaacatcctaaaagcagggctgtatctgccttgtttaccctgtatttctagagcctggtatgccaggcaaataggcactcaaatatttattggattaataagtgaaggaatgtgtgaactgtaacagagatcataataatcacgcttcccttagggttgtcatgaggagtcagaatccagttgggcagggctccctgcaaaacgagccattcacaaaggctcattcctgcaaactccaagatttgcctgtcatttcctgaagccccgccctcgtgccaggctttagataaattaatcagacctcactcctgcctcaagggcatctgggctggctggagcaatcctcgtcatcagtttcatcttgccagtaactggatgaggctagtgtccttaggatcaccccatttcccagatgacgacactggggctctgagggaccaaggccgcctgggcttccttacttggccagtgagggcaaagagatggctgcctcagcctcctcggggcagggagtttgtggacgcacaactgctgtgggcccaaacttgattctgggcccaagaggttccagtcacacagattcattcagcagacattcactgaacactgagctgtgccaggcctgggctgacagattcacagttgagctggggacacagatattactcagataagactatgattgtaaactgtgataaatacaacagagaaaaacaccctgggaagatagaattgagaggcttcccaaggaggcaatattggacccaagatggacaggcgttaagtgctgtgcagggggcaggcaggggaacagagaggacagtatggagaaagacccgaggcttgaggaaacactgagttacagtgcagagggagctcagccagggccaggaggaagaggaagaggaaacagggcaggcagtttaagagaggaggatggtagctgggtacagcggctcacacctgtaatcctggcactttgggaggccaaggtgggaggaccccttgagtccaggagtttgaggccagcgtgggcaacatagcgagaccccgtctctaccaaaaacacaaacattagccgggcatggtggggtgtacctgtagtcccagctacttgggaggctgaggtgggaggatcaattgagcccaggaggttgaggctgcagtgagctgtgatcgcaccactctactccagcctgggcaacaatgagactttgtctcaaaaagagagagagagaggaggatggtacctggcttgggaggccatgtgcaggattgggggctttatcctgaaagcaagggagggggtgttgaagggttggaagtgtgtgaacagatttgtgtgctaaaaagatcctgtggctgctatgtggacaacaaatcaaagagaacaaaatcagaaatatataaagatctgtcatagtcacccaggtaatgatgctaccgcctggaccagggaggaggcagtggaggtggggagaagggccaggttccagaggcctttagtaggcatagtgggcaggactaggggatggattgcatgggagttggggggtggggaggtggccaggatgacatcctgggttccagcttgagcaaatggggagaggtttgttctcaacacacacacagagaccaagacacgcacaagcatgtatatccattcatacataaacaaacacgcccacacaagctcacaggccaagagaaacagagacacagatacattcacaggcatacaaacattcataccttcaaatgtaccagtgccgacggacacaggccaggacacacgccagccatgacacatacctgcagaggtacatatgtacacgtgaaccccagacacactcacacccgaccagaaagcatatactttgaagcacagacagagggagcagcacacagaaacacagcagagatcagcagctctgccctggagctgccccctgctggccgtgtgaccccgggggttatgtcacctttctgtgcctcaattttgtcatctgccaaaagggatgataatggtctctccctcataggttgtggggcaggcgacatgagtcacttcacataaaacacataaagaaatctcatcacctcctttgagaatgaaaaaaaaaaaaaaaagaaaagaaatcccagcactttgggagaccaaggcaggaggattgcttgagcacaggagttcgagaccagtctaggcaacacagctagactcgatccctatttttaaattaaacacacacacgcacagagaaagagaccaggcacgcagaggctgttggtgcaacgtttgctcttttatgcacacactctcggggatccagccactcattgtccccacctgcatctgattccaggcttcctggcttcagaagcctttgcttcctcccaggccccacacctggcccttcctccatcccccatccacccccaccccacttccttccccaccgccctccttacccctgctcagtccccaggagtcggattcagctgtccagaaactcttcagggcaaagaaaggtccagtgcccagtcagtgggacaccacccaaagccaaatcccctctgccctacctctcccctagtccttacccacggccccagtgggcctacccctgccccagtgccctctgccagggattcctggcgagttgctggcaacctcagcatcccttcctgccagctccacccagcccagtcctcggggagccgcctggaacaggacaaagggcagagctctggagtccctagggcctgggtccagccccttccccactcctttgtgcagtcacttgttttgttggaaatgtcccctctcctcatctttttatttattttattttaatttttttgagacagagtttctgtcttgttgccgaggctggagtgcaatggtgtgatcttggctcaccgcaacctctgcctcccaggttcaagcgattctcctgcctcagcctcccgagtagctgggactacaggcacgcgccaccatgcccggctaattttgtatttttagtagagacagggtttctccatgttggccaggctggtctcgaactcccgatctcaggtgatccaccggcctcagcctcccaaagtggtgggattacaggtgtgagccacggcgcccggcccccactcctcatcttaaaagatccctaccggcatggatgctaccactttaccaaggggcggcagtgcaccaggcactgtccaaaggctgaataaaaaaggcaaaagtccctgccctcagggagtttacaatctagtgagggaatcagagagcaaacaatataaattcaggcatgtctcagagatatttggggttcaattccagaccacttgataaagtgagtcacacaaatttgttggtttcccagtgcatagaaaagttatgtttacactatcctgtagtctattaaagtgtacaacagcatatgtctaaaaataccatgtacatattttaatttttttttttctgtagagacggaatctcactatgttgcccaggctagtctcgaactcctagcctcaagtgagcctcctgctttgacctcccaaagtgccaggattacaagcatgagctaccacgcctggccccatactatgctaatgatcatctgagccttcagcaaatcctcatctttttgctggtggagggtcttgccccagtggtggtggctgctgactcacgagggtggtggttgtagaaagtggctgtggcagtttcttaaaataaggtaacaatgaacttttctgcttcgattcactcacaaaactgttctctgtaacatgtgatgctgtttgatagcatttggtccacagtagaactttcaaaattggggtcaggccaggcacggtggctcacacctataatcccagcactttgggaggccgaggtgggcaaatcacccaaggtcaggagtttgaggccagcctggccaacatggtaaaaccccgtctctactaaaaatactaaaattaaccaggcgcggtggcaggcacctgtagtcccagctactcaggaggctgaggtaggagaatcacttgaacctgggaggcggaggttgcggtgagctgagatcgcaccattgcactccagcctgggcaacaagagcgaaacttgtctcaaaaaaaaaaaaaaatgggggtcagtcctgtcaaagcctgctggtgctctatcagccaagtctatgtcatagtctaaatcctttgttgccattgttcctgctatcaaatgtatttctgtttttttatttttttatttattttttgtagagggggagggtctcactatgttacccaggttgatctcaaactggcctcaagctatcttcctgccttggcctcccaaagtgctgcgattataagtatgagccactgcacccagcctacaaaatgtatttctaaatgtatttctattttttattatttaataagacttagagctgggcatggtggcacatgcctgtaatcccagctattcaagaggctgaggcaggatgatcacttgaggtccagtgttcaagaccaggctaggcaacacagccctgtctcttaaaaaacacaaaaaattagccagatgcagtgactctcccagctactcaagaggccaaggcaggaggatctcttgaggcctggaattcaaaaccagcctaggcaatatagcaagactctgtctctaaaaacctggaaaaaaaaaaatgaaccaggcatagtggtgcccatctgtagtccccactactcaggaggctgaagtaggaggatcacttgagcccagaagttcaaggctgcagtgaggtatgatcgtgccactacactccagcccaggtgacacagcaagaatccatctctaaaactaaaaattttaaaaataagaataacaaataataagacttaaaagttgaaattggccgggcgcagtggctcacgcctgtaatcccagcattttgggaggccgaggcaggcgaatcacgaggtcaggagatcgagaccatcctagctaacatggtgaaaccccgtctctactaaaaatacaaaaaattagccaggtgtggtggcgggcgcctgtcgtcccagctactcaggaggctgaggcaggagaatggcgtgaacccgggaggcggagcttgcagtgagctgagattgcgccactgcactccaacctgggcgacagagcgagactccgtctcaaaaaaatataataataataacaaataacaagacttaaaagtcgaaattactccttggctggtgggctgcagaacagatcatgtgttagcgggcatgaaaacacattaatctactccaccagggccctttggtaaccacatgcattgtcattgagaaatattttgttgttttctgtgcagtccgtctcaacagtgggcttgaaatattcagtaaaccatgctgtaaacagacgtgctgtcatccaggctttgttccatttaagagcataggcagagtacatttggcgtaatcctgagggccctagaatttctggaatgataaatgaacaccggcttcaactgagtcaccagctgcattagcccctaacaagggggtcagcctggccttgaagctttggcgcccaggcactgacctcccctccagctaggaaagtcctggatggcatcttcttccaatacctggtggttttatctacactgaaaatatgttgcttaatgtagccgtcttcatcaatgatcttagctagatcttctgcataacttgctgcggctcctccagcagcacttgctacatcaccttgcacttttttttttgagacaaagtttcactcttgttgctcaggctggagtgcaatggcacgatctcggctcactgcaaccaccgcctcccaggttcaagtgattctcctgcctcagcctcccaagtagctgggattacaggcatgcgccaccacgcccggcttcttttttgtattttaagttgagatggggtttctccatgttggtcaggctggtttcaaactcccgacctcaggtgatccacctgcctcagcctcccaaagtgctgggattacaatcgtgagccacgatgcccggccgtcaccctgcacttttatgttacagagatgccttctttccttaaatctcatgaatccacctctgctagcttccaaccttttttctgcagcttcctcacctctctcacccttcaaagaattgaagagggatagggcttcgcttgggattaggctttggcttaaggaaatgtggctggtttgaccttctatccagaccgttcagactttctccatatccacaataagcctagttcactttttttttttttttccagacggagtctcactctgtcacccaggctggagtgcagtggcgcgatctcggctcactacaagctccgcttcccaggttcacgccattctcctgcctcagcctccctagtagctgggactacaggcacccaccaccacgcccggctgattttttgtatttttagtagagctggggtttcaccgtgttagccaggatggtcccgatctcctgacttcgtgatccgcccgcctcggcctcccaaagtgctgggattacaggcatgagccaccatgcccagctaagactggttcactttcttatcattcatgtgttcactggagtagcacttttaattactttcatgaatttttcctttgcattcacaacttagctaactggcagaagaggcctagtttttagcccgtttcagcactggacatgccttcctcactaagcttaatcacttctggcttttgatttaaaatgagagacataagactcttctttcacttgaacactttgaggtcattgtagggttgttaattggcctgatttctattttattttattctatttttcatctcatttcatttatttgagacagactctcgctctattttccaggctggagtacaatggtgtgatcttggctcactacaacctccacctcccgggttcaagcgattctcctgcctcagcctcccgagtagctgggattacaggcacacaccaccatgcccagctaatttttgtatttttagtagagatggggtttcagcatgttggccaggctggtctcaacctcctgacctcaagtgatccacctgcctcagcctcccaaagtgctgggattacaggcattagccaccgtgcccggcctcaatattgtatgtcttagggaatatggaggctcgagaagagagatgggggaaatggctggtcagtggagcagtcagaacacacacagcattaatcggtaaagttcgccctcttacgtggacatggttggtggtgcccccactcacaatagtaacaccagagatcattgatcacagatcatcataacaaatataataataatgaaaaagtgtgaaacactgtgaaaattaccagaatgtgacacagagacacaaagtgagcaactgctgtcagaaaaatggtgccaacagactggtttgacgcagggttgccacaaaccttcaatttgtaaaaaatgcagtatgtgcgaggcacagtgaagcaaggtattcctgtagtaaactgtatagtatgctagatggtgacaagtgccgcagagaaaaatcacccaatacaccatctcaggaaggccaagtgagcccacaaagcaaaccacatgcagaacatgccggccatggccccacttataaattatgtctcccaccctgagccagcagaacagccaagtgcagtttccagatgaggaaaacagactcatccagggtcgccagcaagggcttgggccatctttctttccttttcttttcttctttcctttctttctttccttcctttcctttctttctttcctttcttttctgacagagtctcgctttatcgccaggctggagtacagtggcgtgatctcagctcactgcaacctctgcctcctgggttcaagtgattctcctgtctcagcctcccaatagtggggactacaggcatccaccaccataccgctaatttttgtatttttagtagagacggggtttcagcatgttggccaggatggtctcgatctcctgacctcgtggcccacccacgtcggcctcccaacgtgctggcattataggcatgagccactgtgcctagcccacatcgtcccattttcacagctgcaagcctaacactgcctcctgaggcctctgtctatccatctgtctgccagccctggggaggggccgtcctctcctgagctaactagcccctctgccctcgctctgcttcttcatgccttccttcctgcttcatatatccactgagcacctgctatgtgccaggtcccatgataggccccagggccacctgggggatgacagtccgggacagaagattcacttccagccaagcaaatgaccctgaggcctcagagcccctcagtcacacaggcccctttcaaggccctaatcttttttgttttgttttaagacagagtctcgctctgtcacccaggctggagtgcagtggcacgatcttggctcagtgcaagctccgcgtcccaggttcacaccattctcctgcctccgcctcccgagtagctgggactacaggtgcccaccaccatgcccggctaatttttttgtatttttagtagagacggggtttcaccgtgttagccaggatggtcttgatctgctgacctcatgatccgcccgcctcggcctcccaaaatgctgggattacaggcgtgagccaccacgcctggcccaaggccctaatcttgtatttgtaattctgtatttcttcttcctaaagggccacaccccggtaccttataagtttcatggctccataaaacctagtcctgtcctgggggagatgaacaaacacgtaaacaaattataaagtgtcaaatggcaggatggaacagaactaaatatcatggcagaaaataacgggggcgtgcatatcttagctggggagaagcaactggggagtacctcttggaagtgacaagctgaggccagacaaggaatctgtggaatgacacgggtgaatgacatgggtgaggaatctctctctctgagcctctgtttccctgtgtgaggtggggatgccagtcacagcagggtgggctgagaggggtaagtggcaggtccaggttacccagtgtggtcacaccacccagtaggaccgacaggcagctcaggcccctagctgagcctggcactgcccttaatcggcttttgtccttccaggagggacaggcagggctggctacctcctctctccccccaacagctggggctggctgtgccagggccagactaggaggcgggagctgagatcactgggcctttggctccctgagtcctctctggggacagagagggcagcctggctgggtgagaggggacggtttgttcaggactggggctaggactcctgggtcctaaaggatgaaggggctgggggcctggactcctgggtctgagggaggaggggctgtgggtgtggactcctgggttctaaggcagaggagcctgtaacaggactaccagttgagctgagtctgggagcaggtggggggcagagcagggagctgagccctctactctgtttacagcacgtggtcctcactgatctttctgggtgggaggtggcttgtgcggctacaccctgggcaggccagccccgcccccgggtttattgccccaggctgctactggcacaagccacagaccagcagtcccagcccagggaagctcggaagatgcctaggaggggtgagtgtccagccagctgagagacgggaatggccgctgccaggccccaggacctagaagggaaaggaaataccttcttctaggggaacaggcaaggtgctgggctttgggagggaagtcactggagcagatggtagcattccaccaagggcagcttgttcaggacctgggtgacagggcatccaagaaacagggcagcctgaatggctgggaaaggatatcagaggaaagatcactggggactggaaagtgtggagatcagacgtagtccagggcaagttttgagatgtggcttccagagtcctagcggggagccccacataagtgtggctgtggacccagagagctgggtttacaaaagctctgccacttgcagtgcaactttaacctcctcacttaaaacctgagcctcagtttcctctcctgtaaaatggggatgctggcaataatagagatttgaacctaggtggtgtgggtcccagagggttagcacgctaaagcagcaaacacacagaaagctctcagcacgggacctgcacggatatgctcaaggtcgacaccagtgatgagtatcgctgttccaggcaggggagcagggccggccatgcaacccaggaccagtggacaagcctgaaggccaggggaccccactgggggagaagcaagactgagttttggggatctcacagagaaacagggagggaactgggatttggagggggttccacagccagacttgaaggatgaggaatgactcttcagtgaagtctagaattgtgaactcctgagttcagggagagctgcgcttggggaccagggtcccgagagatgggaatgggagggctggggctgaactctcccaaatgttgttggaggggaagggcctatgggtagcacttggggcctaagaaggaaagatgggatgggggacccggactcctgggtcctgagaatggggaccaactggaggtttagacttcttggaatctaggagaaggagtcttgggccccaggagaattcatggagacaggtgactagactcttgggttcctggaaggaagaaagaaggaccggcagcctcctggatcacaggagaggtgaatgagttagggaagcagagtcgtgtgggctcagggaatgtccggattcaggaggccagggcagcaagtttctgagtcccaaagaggtgatagcaggggctcctgggtcctgaagaggaagggcttggggcttggactcctgggtctgagggaggagggagctgagggcccaaactcctggctcccgaggagggacaaaggcactgggaactggggccccaaacttctgattcccagagacaagagggtgacctcttatgtctaagggaggaggaacctggggtcctgggcccctggaactgaaagaagacagcactgaggtttgaaggaggagtgggtaagctatggcccagactcctgggccccagctaagcaaggcttgatccagccccacctaacaggcctccccacctgcccacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccaggtgagccccctgccccgtgcccctctgggcccacaatgaaggcacctggtggcccctggcctggcctatagtatggtaaagtaaccagtggtcagcattatcggactcagcaaacagcaggtacagaaaggagaagttggctggagctcagacagagctgcaccaggggtctcaaactcatggtccctaggtcatatctgctaggtggtaagaaatgcaacttgcagagcttttttcaccaggatatccactactctctattgtcctacatgcaagagatgtattcactctttgttacctgtctggcccctgaagtcacttgagtttgagacccctcagggagggatctggagccatgtgaccctatagtcattctggccctctctgggcctccccgcacctcagcctccccctcccaccccacatctccaggcttcccttcaggctagcctatcctcagcaacccagcccaggcattcctggaaacctcccctcaccagggctgaacccacaagtattgatcagcccagctgggccagccagctcctccctgtgtcccagccgtgaccctagagtcatgagaaagagatcccggggctgcccaaaccagcatcccagccacaatagccaggcatcaggtgccctctggcctactgggcgcacagccaggggcagggcccagctctgccttggtgcagggcagtctcccctttaaaatgtccgtccccgggagggcagaggcctcccctgtcttggtcactgctccagcccagtgtctagcatgcagtaggaacttggccagtacagagtgaacagaagaacccgccaatcccttgccttggcctcctatggctccatttcctctaatcctgtgtccccattgtatttttttttttttttttttttgtattttgtttagtagagatggggtttcaccatgttggccaggctggtctcaaactcctgacctcaagtgatccacccaccttggcctcccaaagtactgggtttacaggcatgagccactgcacctggaccccactgtctttccttaactgcctgtctgctctgtcagacgctgtctctccctgcccccgtggtggccggctggtcctatgtctaggcctcagtctccctctctgactgtctttctgcctcaggtccctgtgcctggggggctgtctctggccatctccctgttcctgtcttccagctgcctcctctccccatccatcctctctctgactttcaggaagtccctgcaccatcctactccccacctcacagcctaccagtggcaccaccccgcactgggaatgaaatccaaattcctctgcccaggccctatatgagccccctttgcctctccaatgtcaccacctgcccctctccccactgctcactctgctccagccacactggccccctgactgtcgctacccaggtcaagcaccaagcatgagctcacctttttttttttttagagacagagtctcgctctgtcgcccaggctggagtgcagtggtgtgatctccactcactgcaacctctgcctcctgggttcaagcgattctcctgcctcagcctcctatgagctcacctttaagccttcatgctctctgttccctgtgcagggaacaccctcccctcgcttcagtcagatctctcctccgagacccgctaagtagcctgacccctagtcatcactggtgccctctccacctactgcctttttttttttccaaaccattcgtcattccttgtcatgatactgcgcgtggctttgcttatctgctgatcatttgttttccctttgagaacatcaggtccgtgaaccagccgagagctatgcccagcacacagtaggagctcatgaaacgtttactgaatgaatgtgtcttccccgcacatccctgtgcctcgctcctgccctgtccccatccctctcttgagcggtgggtgacgcagccgcgtctctccacagttcacgcctgccatccggccattcctgcagaccatctccattgggctggtgtccttcggggagcactacaaacgcaacgagacaggcctcagtgagtcccagccaggttctactcgcagcctactctcttggccctcctccccactcctgcccaagcagcctgacccactggggctccctgacaccccttctgacccctaggtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcggtgagggcctgttgcagatggggacactgaggcccagagactcatctgaggccacagtaggtctctgtggggctccaggcccagggatggcacacaaggggaaagactggggatcagagggagaggtgaagggcacccctgcaggcagaccttccctagcaccccttctgtcccctccctccagtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggtagggttccagcctcagccagggacagggacagagccgaggagcgtgggcagcccccaccttggcatccccatggaggggtgcagccctggccagctctccccaacctcacacaccgtctccctcctcacccccaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggtgagcctcaggcccccacagccacctgcgcctgctcccatcccacccagcttgctttaagctcctccagcctcagcctcacaccctctacctttctctccccccacacctcccagctcctgctcacccaggtcctgcccaatcttccacctcagccactttatcctctgtccccaactgtggcacccagactctccatctcctccacctccacttcccacccaccgtcctgtctccctgggcctctgtcgtccccctctgatagctccaggccctgctctcctgtcctaccagcctcctggcccacagtccagcttctctgacctccctcttcgaagatcaacatcttgggaggacactgaggcacagagcagagtgtggccatgccccagggcacagagcttgcagcccagcccctctgtactgaccctgaaccctgaccttccattcccgccctctgaggcccccctcctgcaacaggcctgagctcagctcccctttcccaccacctgccctccctgctcccaacctccagccccgacagactttcccagtgcttccctgggcctctccaggtcctgagtcatcctgaccctctgtctaccacatgagcccaaatctgtgcctcagtctgccagtctctaaaactgcagtctgctaggccttggagtgccccacaccccaccttggagagcccagttctcccagcttgagttcctccctgccctcctccccaggcctctgcccctgccaggttgtcaccaaccacccctctcccaaaccaggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgaggcccacaccctcagcagggaaacaggactgcatggatgtctgactcctgcagggacgggctggggaccaggactcctgtgactgaggaaggagaggccaggcagaggaatctaagactccttgtcccttttttttcgtgtgtgtgtgtgtgtgtgtgtgtgtgtgtgtgtgtgtgtgtgagagagagagagagacagacagacacaaggtgtcatgtcgctcaggctgagtgcagtggctcaaacacacctcactgcagccttgacctcccaggctgaagcaatcatcctgcctcagcttcccaagtagctggaactacaggcgtgcaccaccactaccacgcccagctaatttttgtgtttttcgctatgttgcccaggctggtcttgaactcctgggctcaagccatcctctcgccttggcctcccaaagtactgggactacaggcgtgagccactgcgcccagcctccttatcccttttgaagcgattggatattctcgggtccctgggaccacagatgcctgaagttctgggcgttaaaactgggcccagaaaggggaaaacaactcagctacccacatatattctgcaggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcaggtgagtgattcactcccgtcacatgcccagccagggtgggcaggagggacagcctagcacagcaaaagtcccagggaagatgctgggcatggtggttcagacctgcaatcccagcactttgggaggctgaggtgggcagatcacttgaggtcaggggttcaagatcagcctggtcaacatgacgaaaccctgtctctagtaaaagtacaaaaatattagccaggtgtggtggtgcacacctgtaatcccagcactttgggaggccaaggtgggcagatcacttgaggtcaggagttcgagaccagcctggccaatatggcaaaaccccttctctacaaaaaaataaattagcagggtatggtggagtacacctgtagtcccagctaccagagaggctgaagcatgagaaccgcttgaacctgggtagcagaggttgcagtgagccaagactgagcctctgtactccagcctgggtgacacagcgataccttgtctcaaaaaaaaaaatttaaaaaaagagtacgcttactgggctgtggtgaggtctgcctccaaccatttggccagtacaatatatggcacccagtaggtgctattagaagatgccagcacccctggtgtgtccattctgttccagtgaccctctgggccacaaagtacttaagtagttattctcacattgttttgcacctcaccttcgtagatttataaagacaagtaaggctgggtgtggtggcttacgcccataatcccaacactttgggaagccaaggcaggcggatcacttgaggtcaggagttcaagaccagcttggccaacatagtgaaaccccatctctattaaaaatacaaaaatgggccaggcgcaatggctcatacctgtaatcccagcactttgggaggccgaggcgggcagatcacgaggtcaggagtttgagaccagcctgaccaacatggtgaaaccccatccctactaaaaatacaaaaattagccgggcatggtggcatgcatctgtaatcccagctactcaggaggctgaggcaggagaatcacttgaacccaagagacgaggttgcagtgagccgagatcacgccactgcactcaagcctgggtaacagagtgagactgtctcaaaaaaaaaaaaaatacaaaaagtagctggacatggtggcatgcctgtaatcccagctactcaggaggctgtggcgggagaattgcttgaacccgggaggcagaggttacagtgagccgagatcgcaccactgcactccagcctgggcaacagagcaagactccatctcaaaaaaaaaaaaaaaaagtaaaaaactaaaactgtagcatcttggccctcatggtaggcagtgtgggtctgataaaatgaacagagctgaggccaagctgggcacgccaggtgggctggaagtgtatctttagcatcgtttgggcacttgcttgcctggtcacgtgaacggataaaactgaagaacacaaaggaaatgtggggaagcagatccatgtggctacaggtgccagacccctagaaatgtgatacaccctggagacttgttagctccctgtgaacagagcctcccttcaagccactgggcctgcttactattcaaatcattttgatccatttacaccttgtggtaagtgtaatcccagcactatgggaggccgaggcgagcggatcacttgaggccaggaattcgagaacagcctggccaacatggcgaaaccccatctctgctaaaaaaaaaacacaaaaattagccgggcatggtggcacatgcctatagtcccagctactcaggaagctgaggcacgagaatcacttgaacctgggaggtggaggttgcagtgagccatgttcttgccactgcactccagcctgggtgacagagcgagactttgtctcaaaaaaaaaaaaacaaaaaacgatatattatgatccccagtgggtagcggtacctaatcccacatcttatcccactgagtcctgccacctatgaaccaaggactattttcatttccttgatctagaagaaaaaataggttcctagaggtaaactgcacctaatcttcccagtctcacacacacacacacacacacacacacacacacacacacacacacacacatccttcactagaacacactgccccactgccaagacccccaccatgaccacctggggcatctggaactccacccatcccctaggcaagagtctggggaaacacagcctttcacagcgctccacaggcgactgcccttcccatggcattccctgccagccacacacacaaccaaactaacggagccaggcctatctgctctccctctctcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggtgagcgacagagggggccggtacaggtgcatttagagaagagcagggcacccggggaggagggggaccgggcacgggtacacctgggaaaaagagctccggagtggggagaaagggacaggcgtgtccccaggggagaacaatgccccgaacgaacgggaggaggacaagagtcagggctgcctccgttttactttgcaattttgagtaccaagagacaggatcagtggggcagccccttgggcttggagaatcaagagaaaaaaaaggtgggtttggcggggtggggagggagaggctggagagaggccggggatcgcagttaaagtcattctcccatccttcccacaactccccccattccctccattctctccccaactcctcacccaccatgtctcctgcctccgtccactccgtctgtatccgtatttcccgctccctttgttcatcaaacccctcctcgctctacccgaccccggtctgtctgtcccccaccctctctccacgtccctccccgctgtcccgtaggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcctctctcaaatacggtggggtgtttgcccaccagggggcagcatcggactcaagcggctgggaaccaagaaacctggaatgaggggtatgggggactggatttttgggaccagaagggagtggactccttggtaacccggacccacctcccctcggacttcatccaggtacactgccaggagatgctgggtcctcagctcctccccttgaagaccttcggttagctggactcaccctggtcccagggagaccaggctcagcatccatcagggggatataaaagttaaaaataatctctcgggtctcaaaggctccagtgacccaaacaccctacagaactggagcaaagttagcaggaaatcagaaacaaactggcgctcaaaatactgtaaatgcagccgggcacggaggttcacgcctgtaatcccagcactttgggaggcaagacaggaggatagcttgagtccaggggtttgagaccagcctgggcaacatagaccagtctctacaaaaacatttaaaaattagccgggcgtggtggcacactcctgcagtcctacctactcaggagggtgaggcaggaggatcacttaagcccaggagttcgaggttgcagtgagctatgatcgcaccactgcactccaacttgggcaagagtgggaccctgtttccaaaaaaacaaaaactggaaatgcaagctctgtccagctgtgacaatcaactcttggaccaactctctggccccttgtaagccctgagtttggagttgagatgatttatacccaagacatgccttcaaagggcttctgatcctggattcagagagggtggaagaacagacacaggctgtcacagtccccaggggttccacctgtggtagtcagggagggcttcacagaggtggtgatctgagcttgacactacaggatgaacaaaagtctgctaggaagaaaaaacatgccaggttgtgagagccagctggcagtgatcaaagctgccacctggctagaaaaagcttccacctgaccagaaggtcaggtgcaaagtggggaggggcgtgaggggcctggagtggtcagcaggagcagggcctgaagagcctggagtacgatttggactaaactggagggcagtggggagccacaggagcactttgagcaggaaagggccagggtcagctcagggcactgaaagatcctgctgggacactgggggatggacagaaaagggcaaaactggagtcctacaggccaaggaggatgcctgagctggggcaggagccgtaagggtagggagtgtaggtgtagcatcccagagccataaaaggtgggaaggacagcacctactgatgaggttacaggacagcaaggggacagagatgacacccaggtctggccatggaagcaggtggacagtgaagctgtctcttcaatgggaggaggctcaggtgtgtgtgtgacaggtgggacctgtggagggccattctggacatggtgagctggaaggtctcaggaagacaatccaggagacaacaagggtcagaagtgcagtctggggctgggtgtggtggctcacacctgtaatcccagcactttgggaggctgaggcgggtggatcacctgaggtcaggagttcaagactagcccagccaacatggtgaaacactgtctctactaaaaatacaaaaattagccaggtgtggtggtgcacgcctgtaatcccaactaactgagaggctgaggcaagagaatcgcttgaacctggaaggcagaagttgcagtcggccgagactgcaccactgcactccagtctgggcaatagaatgagactctgcctcaaaaaaaaaaaaaaatgcagtctaggtggaaccaagggactagaacctttccaggaagcctgggcaggtgggacaagcaacaagagggccaggacagagacagccctgaggatcacacccctagtaaaggggtgggcgggggt

SEQ ID NO: 13396 - DNA, 23219 bp, Human
atccacccgcctcggcctcccaaagtgctgggattacaggcgtgagccaccgcgcctggccttatttttttttaagatggagtctcactctgtcgccacactgaagtgcaatggtgcaatcttggctcattgcaacctctgcctcccgggttccagtgattctcctgcctcagcctccaagtagctgggactacaggcgcccacgaccacacctggctaattttttgtatttttagtagagacggggtttcaccatgttggccaggatggtctcaatctcttgacctcatgatccacccgcctcggcctcccaaagtgctgggattacaggcatgagccactgtgcccggcctatctagctgtaattttatatcctttaacacatctttccctgtccctcccttcctctacccttcccagcctctggtatgctctgttctactttttccttccatgagatcaactgtttttaggttccacatattagtaagaacatgtgatgtttaactttctgttcctagcccacttccattcatgttgccacatgtgacaggatttcattctcaagcccccaaaggcacctcactgggcctttgtttttttgttttgttttgtttttgcttttgtttttcaaacctctgggacagatggctccttctaaggcagcccatccccctggtggacagttctctccaatcttgacagaagtcctctggacaactcacgtcctctccctgggctcatcctgcaccgcatggagctgggcagcctggggacccgcagtgaacaggacctggggtgacttgaccttgaagcctggaggtcagagcccacatctgcccaggggtcagggccagctcacatcatgtagaccctggtcagcatccctggggcagcccttgacaaggctgcaggccttgtcttgccctccagggggagacattgcacacagacaacactcaggaaacattcccctggtcatgaacctggctttgctaaggaggtgaaggtagagcccactttccatcccttgctccaaaacacccttccaggccctcccatgtacctgctctgtcccttcctgggtcctctgaggaccctgttctgtgaggggtccctgtgcagctccccattccctcctggcaccacctgtggggaaggtgcggtgaccacaggacaatcagcctcgcagaggacagagaccacccaggatggtcagggagaacatggacaggccttgagcctcagctcaagggagggagggtccccctgaagtcttccccaaggacagtagagcccagagccacccacctccctctatcacagtcctctcttcccaggacacacaggacacctccccctccatatccgggagctgcagctccacctgagacccctggacttgggtctctgtccctgggttagaggccaggctggtgacactagagacagagggctggtccctccccagtcatcccccagtgagcccctttccatcccccagagccacctctgtcaccttcctgctgggtgtcttcctaccttcccagcacactgaagagcatggggagacctggcagctcactgtgttgcaaagaaaataattaccacatttggatatgccagggttctctgtgtgctgctgacagacccatagccaggacacaatagaggtcagtgctggagaggggggatcctcctcccctgatggggacagaggtctcatcagccttgattctcaaagtgtggtctgggaaaccaaaatgtagacagaaaggaaagagaaagtaaggacaaaggtaggaatgagaggagaggaaacagagcttcctggacaaaccccgccccagcacacatgatcagacaaagctctgggccccagggaggaggctcagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacaggtgaggggaggacaccctgggaaggggcggaaagagggcgcacagagaatggctagggtcctctggggaggatggagctctaagaggggacagagggcttctcttggagccaaataggagagaggacatgaaagggatagagatcataaaaggaaagtctcagtgatctgaaactgttagtgaataaacaatctcccattttttaccttttccaactgaatcatcaatgagcaataaatttcaaaaactgctgacaataatcacaatttaagtcagcgtgacaattaaggaaaacattttaaaaggggcattaaacagagccctgagccaccaacctcagatattggcaaataaaccccaggacatgaagagccctgggaatgctcactaactcatccacaggagtctgcagcctatcccaggcactggggtgcaaccaacatcacacaaatccctgccctcacggagctcacgctctcatgggtggggaagacagacaagcaaagagatctagaatgtgaggtcaggtgttgacaagagccctggagggaacagagcagaaaaaggtcagaaagggaatacccagggtctctaggggaggtgtcagggaaaggatctcccaagagcaccctgatgtgatcaagatctgagggcagtggggagggagccatgcggatccctggggaagggcattccagagaaatgacaaggtcagaggcactaagggaatgggagtcacactgctgaccttgacccagtaggacacacacacacacacacacacacacacacacacacacacacactccaaggtggaggggtgaagacacctgctcaggacccaaggccccatttttctaccctaatgcataggtcccaatattgactgatgctctctcctctctcctagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtataccgtgagtatttccccatgacctctgggtgttggggggttagttctacttcccacacatgggattgtcaggcctgggctgtgcctgtgtcctcctctgcattataccccatgttaaggtttgagcatctagtgcaggacacactatgggacagacatcaaaataccgaatgtcttactctggagtcctgatcctgcagacatttgcttcagaggaaggacaatctgatgtgggtaacttatcgaggggagaccagtctcaatctagccccccgggaccctcctggtgaacatgtccctaagaaagacccagtaggactcagtcagggtctggcctgaagggccttctgggatcctcacagacaagctcagccctgggaatcccctgctccaaaacactatcccaaggttctcaactcctggtgaccctgaggagcctgggccagggctagattgtggcctcctgggcagggctgactaggaacaagaatttgagctatccgagggctgtggctcctggagctggtaaccagccagggttcaggcactagagcctcatttgggcaaggatggagcctcatccttcaccttagtctcagcctggagaggacagatggacaagctccccaggccatcagccaactgccctgggggcttaggagatgccataggaagtttaccatccccaggaggaggaacagaggagacaggatgctcctgaaagctccttgtccaccagggatcaggctgagaggcactctcagggaatccaacaacaatagatgctgcggccgggagcggtggctcacgcctgtaatcccagtactttgggaggccgaggtggatggactatgaggtcaggagttcaagaccagcctgaccaacatggtgaaatgccgtctctactaaaaatacaaaaaaattagccgggcatggtggtgcgtgcctgtaatcccagctactcaggaggctgaggcaggagaattgcttgaacctgggaggcagaggttgcagtgagccaagatcacaccactgcaccctagcctgggtgacagagcgagactccatctcaaaaaaataaaataaaataagattgtttatttgggcagctcccctatgcagagctgaggtcaaataattataaatattttaaggttaattcacagaccacaagataagccaaaaccattaaccatttatactatttcactgaggggaaactgagccacatggcaataaatacagtcactatatcaaggtcacacagaccgtaactggaagatcagttacaggagatttgtcttcagccacagtcttaacctctcctctactccaggggccttatttggcatctgtggaccccaataccagagttggttcagttcctttcttcttaggcatctgcagcccagaggggagatcctggtctggggagtgagatcaaatggagaattaaccaagttttattctggaacttattcaacaattagagtcagtgtcagaaatgttcaggcctgggtcaggtgtggtggctcacacctgtaatcccagcactttgggatgccaaggtgggcggatcacttgaggtcaggagttcaagaccagcctggccaacatggtgaaaccccatctctactaaaaatacaaaaaaaattagtcgggcatggtggtgcgtgcctctaatcccagctacttgggatgctgaggtggtagaatcgcttgaacccaggaggcagaggttgcagtgagccaagatcatgtcactgtgctccagcctgggagacagagtgagactctatctcaaaaaaaaaaaaaaaaaatgttcaggcctatcccctcagacccacacctctgctccctggacttgaaatcctgtgtttcctgatgtgttggtgtcactcccacaggaggataaaggaaaggactttgctttctctcctcactcacaccctgcaccagccagggcccaatatgaaacacacactcagtagttctctcacgaatgaatgaatgattgaatgatccataacctctttagagactggatctggttgcagaatcctgggaggttcttgccatacctgctccccatccctccagagactgagacccatgttccatcccctgaccatctacccctaaagccaccccaagtaccatatttcatgtgactctggggctgctcggctgtgggaaggttttcagggctccctggtcttggttctgggacaccagaggctcctggttgctggggtctctaaggtcacttagcccccactgctcactgtcatgggcatctctgactctctctgctcctccatgtcctcattttcctctccttttatcccagctgaactgcacagtttcctccacccttaggcctttcccagacactccgtctaacaaggttgactgtcctgttcccttcccgctcacactgtggccaggcccacctcccaggcaataggaaaggcacagaaatgagcccagagcagccacccctgccaggtccatcataagccactgtccccacgtccctcagtgaggctgacatgtggaacaggccaggggacagggacgagcgactcctccatacactctctatactgactcaccaggggatcagaggcagaaggacaggtctgcagtccccaaagcccatgggctcatttcacccatttgactcctaactccatccctgttctgctgtgggctcacatcctctagtggttcctgggaccttccccaggtagagctagccaggcaggtgctgtctgatgggtttgctgcccattccacctacacctgtgtcctcatgatgacaccattgtcataaggtgggatctctcagacagggagatgcattagccactggtgtctcacttagactctgcccaatttggatgaatttggtcaaactctagttgtgtttcctgaggttgagagaaaaggaagaaagcatttcacatgactgttttgggttcctctttttacctgaatttccacaggaatttgtaacatagaactctttctaaatttactaacataacatacatcacttctcctcatatggcatcgtttctctcttaatgcaattgagaactctcagatatcctttctgacaagttctgtcttcctaacaggacccatgagtcccttctacccagggagtcactgatttcaaactgacttcagcatctttctttgatcataacatgatcctactggacttcagagcttggtttaagagtttatcacgctctctagagaatattcctcttattaattggtgttagatccagagtattaataacaattttcacaaatggaataatttaacttctcaaatttatatcccagatctaccaaacacacacggtccatgagggtcaggctttcagcaagttcatgctccttccgttccactagctggttattctgcatttgcaaaaaacccacatatttcagaaaagatccacagtgtcatcatctgctcttttcagggggaaaagggacattaaagaccaaagacaaggaacgtagatatgctgttaaatccaggcagcccctgcctgtcaccctcactcttttctagatcattccttggactctgctctatctttagggggtcactggctcaagtcagtcatcatcaaacacctgggaaaaactgccccaccttgtggttctgctgcctgacgactgagctaccttcaggcttgcccctggtgtcccctgttatttctgctgaaacatacagtcccaggccaggctgctcagtatcctcagggtttaaggacaataggaagtcccatcatcacccatctctaggatgtcctcagacagggaagctgcagagaaaacacacctagtggggcaaagtaggactgtgaagctggaagggacccagcacctgtatgttccaggtgaggacccacaggtgggtcaggcaggcatcagccagtcagggaaggaccagaagtgcctggggctgtgactcccagtcctcggtctgtccacgacccaacactgctgctcagttcacacttgagaaagtctgtgcttctctcacacagagcaggcggcctcacggtctctgagccctcagatcattgcacatctgtcttgtgaaacacacacttgccatgggcttttagggacttgggttggctgagaggtggggagatgccaactctgattgaaaaatgcccggacggaatcccagcactttgggaggccgaggcgggcagatcacgaggtcaggaggtcgagaccatcctggctaacagtgaccatcctggctaaaatacaaaaaactagccgggcatggtggcatgcacctgtagtcccagctactcaggaggctgaggcaggagaatcgcttgaacccgggaggaagaggttgcagtgagccaagatcgtgccactgcaccccagcctcagcaacaaagcgagactctgtctcaaaaaaaaaaagaaagaaagaaaaatgcccagccaggcacggtggctcaggcctgtaatcccagcactttgagaggccgaatcgggcggattgccagagctcaggagtttgagaccagcctgggcaacacggtgaaaccccgtcaggcatggtggcatgtgcctgtaatcccagctactcaggaagctgaggcaggagaattgcttgaatccaggaggtggaggttgcagtgagccgagatcgtgccattgcactccagcctgggtgacagagcgaggctccatctccaaaaaaaataaataaataagaaaagaaaaatgcctgtggaggaatcaaaggtgccacacagggcaatcttctctctgttttctgcatagcggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctgtgagtatcttctgttcctctgtggcccaggctgccagcccaaatccacgcagccagaggccaggcctctcagtccctctcaggtctaaggacgcagacccttaaccctggacacccaggctggccatgacttcctttccccaggcaaacctgggcagccccagcctgaaccaagaataggaggggagaggctgctcctgtcctgggaggctcagggtccacagcctgtgatgggagaaacaggtgaatgtctcagacccagactcagtggacacaatggaggtttggttaggacttcagggttgtgacttagtagagaggaacactgtggcccttctccagaccagcagcttccccttccctctgatgacatcacctgtggctttattctctttgctccagatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactggtaagtaattcctggagcatcaacactaagatctggggtacaagctttctggttttcaaataggagcagagaagaaattttcttttgcagcctgtatccaacaggcacaaacaagtccaaattctcccctgaaccctctcaattcatctgtgcagactctcttccctttgtttttctgatttctcacagctgaccttaggtccagcctggaatgtggggagggggttctctcagccccagaaagccccgtgtagcaggaggggcttcacagagggggaagcagaaagggtcctcaaggtcaatttgcttctgtcactaacatgtccctttctgtaacttcttggccttcttttacctattccatgagatataaggaatatgtgaggttttaaaacagactcacaatagttttccctaaatgagagaaggaaatgcccttcatcagggatgagcagctcagactctgctccctgctctactcccggcttgcccggtgattggctctgccctgaccccatgtggggtaggacgcaggtgtgtgcagaaggtgtccaggtggcctgtcatgaatccagctaaatcaagatggcagtcaatggctgggcgctgtggttcatgcctgtgatcccagtactttggaaggccgaggtgagaggatcacctgaggtcaggagttcgagaccagcctgaccaacatggcaaaactccatctctactaaaaatacaaaaaaaaaaatttagccaggcatggttgcacatgccactaggcatgccactagggaggctgaggcacaagaatcacttgaacctgggaggcagaggttgcaatgagccgagatggcaccactgcactccagcctggacaacacagagagactctgtctcaaaaactaaataaataaataaataaaggcagtcaacacctgagcctcccctgggtcaggctgcctccctgagcttgtcctggctctgaagtcaccagctgtatgaggctgtgggcacagcacatgggatagcacagagcacagcgagtgacccacacttggagaaatcgggagattcagccacaggggctctgcattggagagaatgggcaatgccaaacagcgtgtatttgtagagaaggtaagaatatcagccttttgttaacactgtgcctactctaggaatctccttcaccgtgatattctatccacagaccaggaagtaaaactcctctttacagtgggaaatccttcggattggaactccagatagtaaggtcatgaagactggatggggcatcatcattccctaaaaaattatttaatgaaaaaaaacactaccttcccttttgtatgtaaagtgacagtcacaggaaggatgcctgatcacagctccaggaaagggtcagtgggaggccaggcacagtggctcacgcctgtaatcccagcactttgggaggctgaggcgggtggatcatgaggtcaggagatcaagaccatcctggctaacatggtgaaaccccgtctctactaaaaatacaaaaaattagctgggcatggtggcacatgcctttagtcccagctactcgggaggctgaggcaggagaatggcttgaacccgggaggcagagcttgcagtgagctgagatcatgccactgcattccggcctgggtgacagagcgagactccgtctgaaaaaaaaaaaaaaaaagtcagtgggaaaaacattctacctgatgatgaggttgctcggtctgtgcgctgagaagaagattccaagtggagatatagagatatccagagggtcactctgagacgatctggggtcaggagggaggtgcagccctctccttacaattcatcacctgaacaaagacactcgaccttctgcagagggtcagggctatcccctggttggtgacctttgcacagctcactgtgggacctgagagctggctaaaatctcagggaaaggagcatagccctaggccccaggccccaaccctattctcagtaggttatctcagatactctgcttgtccacagagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactgtaagtgactcctcaccccttcctatatgtccctctaggattactctgtcaatggtgtgcaaaatggataaaactcacaggaggcagaatatcaatgaagagaccattatagcaaacagaattgcaaagtggttaagagctcagctcaggccgggcacagtggctcacgcctgtaatcccagcagtttgggaggccaaggcgggcggatcacgagggcaggagatcgagaccatcctggctaatatggtgaaaccccgtgtctactaaaaatacaaaaaaaaattagccgggcatggtggcgggcgcctgtagtcccagctactcgggaggctgaggcgggagaatggcgtgaacctgggaggcggagctttcagtgagccgagatggtgccactgcactccagtctaggcaacagagcaagactctgtctcaaaaaaaaaaaaaaaaaaagagctcaggctctgaatcaaatatacatatacttagttggttttttttggttggttgggtttttttgtttgttttgttgttttgagacagggtctcactctgtcacccaggctggagtgctgtggtgtgatcaaagctcactcccgcctcaatcccctgggttcaagcaatcctgccacctcagcctccagagtagctgggactacaggttgcagcaggatgcctggctaagtttttaagttttttttgtagagttggggtttcactgtgttgcccaggctggtctcaatctcctggtctcagcctcggcctcccaaagtgctgggattacaggaatgagccactctgcccaccccgtatttaactattctaagtacctctcatacagatggaagcatgcaatatttgtccttttgtgtctggcttacttcatttagcacaatgtcttcaagctccatctatgttgtagaatgtatcagaatttcattccttttggagactgaataatattatgctgtgtagatagatacatcacattttgcttatccactcatccatctatggacagttaggttgcttccaccttttggctattatgaataatgctattacaaacatgggtatacaaatatctgttcaaatccctgctttcagttcttttaaatagatactcagaagtggaattgctggatcaaatggtaatcctgtttaattttgaagaaccatcataccattttccacagtggctataccatttcacattcccaccagcaatgcactagagttccaatttctctacatcttcaaaaacatttgttgctttctggttttgttttgttttttataatggccatcctaatggttataaggtggtatatcattggagttttgatttgcacttccctaatgattagcaatatttagcatcttttcatgtgcttatttgccatttatcttctttggagaaatgtttattcaagtcctttgcccatgttttaattaggttgtttggggatttttggttgagttgcagtagttctttatatattttggatattaatcccttatcagatatatgattctcaaatattttctcccattctataagaagtcttttcacttttgtgataatgtgctttgatacacaaaagcttttaattttcattaagtccaatttctctacttcttctttcgttgcctatgcttttagtgtcatagccaagaaatcattgccaaattcaatgttccaaagttttcactctatcttccaagagctttatagttttagctcttacatttaggtcttttatgcattttgaattaatttttatatatggtgttacataaaggttcaatttcattcttttgcatggatatccagtttcttcaatgccatttgttgaaaagactatcctttccccactgaatgatcttggcacccttgtcaaaaaacatttggctatgtatgcaaacatttctttctgggctctatattttattccactggtttctatttctttttgccagtaccatactgttttgattactgtagcttttggattttgtttgtttgttttattgttgttgtttgggtttttttgttttgttttgtttttttgcttttctttgtagagatggcgtttcaccatgttgccaaggctggtctcaaactcctgagctcaagcaatccacccgcctccacctcccaaagtgctaagattacaggtgtgatgattaccatagctttgtaaaaaattttgaaaccaggaagtgtgagcccttcaactttgttctttttcaagattgctttggctatccatggtcccttcagagtctatataaattttagaatgaatttttctatttctgcaaaaaatattactggaattttgatagagattgcactgaatctgtagatcactttgggtagtactgtcatcttaacaatattaagtcttctaatccatgaaaatggggtgtcttttcaatttatgtcttatttaatttcttttggcaatgttttgtattttcagggtacaaatctttcacctctttggttaagtttatttctaagtatttttaaagctcttataaatagaatttttttcttaattttcctttgaattgttattagtatacaaaaatacaactgatttttgcatgtggattttgtatcctgccactttgctaaatttattattctaacagtttttttgtggaatctctagggttttctatatataagttagtgtattctgcaaacaggtataattttacttctttccaatctagatgctttttttttcttgcctaattgttctgtctaggtcttccaatactacattgaatagaaatggcaaaagcaggcatccttgtcttgttcttgatcttaaaggaaaagttttcaatctttcaccattgactatgatggtagctgggggttttcacatgtagcatttattatgttgagaatttccttctattcctagtttcagtgttttttagcatgaaagaatgttgaattttgtcaaatgcttttatcgactcattttcattactggttataggtctattcagattttctatttattcatgattctatcatggcaggttttgtgtttctaggaatttgttcatttcatccaggttatccaatttgttggcattcaattactcatagtactcttataatccttattatttctgcagaattagtagtaatgttttactttcatttctgactttagtaatttgaatcttctttctttcttagtcaatctaattaacagttgtcaattatagtgatcttttttgaagaacaacttttttttttcggtttgagacaggttctcactctgtcaccgaggctgatcatggctcaccacagcctcaacttcccgggttcaagcaatcctcctgcttcagcctcctgggtagctgaaactacagacaagcactaccacctccggctaatttttgtaattttttgtagagacagggtttcaccatcttgcccagctggtctcaaattcctgagctcaagtgatacacctgcctcagcctcccaaattgctgggattacagtcatacaccactgtacctggcctacagttataaatttctttcttgcacaagattcttaactactctgagcctcggattcctcaaccgaaaattgcactgtgaatgcctgctccatagtattgcacgggtttggggtttttgttttgtttttgagacagggtgtcactctgtcacccagactggagtgcagtggtgcaaacacagctcactgcagcctcaacctcctgggctcaagcaattccctcaccttagcctcctaagtagtacatactaccacatctggctaatttatttttatttttgttttcagagagacagaatctcaccatgttacccaggctggactcgaactcctgggctcaagcaatcctcccatctgtttcccaaagtgctgagattacaggtgtgagccaccacgcctggccccatagtgttattttaaagatttaatgtaataataaaccttcagcaaaacaccacacacagaggaaatgtttcataaatgttagctgctattactactactattatcattagccttgaaatcaggtagtcctagggtcaaatctcagatccacctctcactagccatctgactttaggtaagccttttaccactctaagcttccattttttcatgtttaaaatggaaataatgtctacctgacagcactattttatggatcaaataagatacatgtaaagcatttagcagcacagggcctggcacacaggaagtactccacaaaagtagctaacatagcattagtcaccagcctgagttgactggtgagggttaagccccaaatagttgcaacagatataaacaagaaataggctagacacagtggctcacacctgtaatcccaacatttgggaggccgaggctggaggatctcttgagcccaggaatccaagaccagcctaggcaatatagtggaaccctatctctacaaaaattatttttttttaattagccaggtgggtgggcgtggtggctcacgcctgtaatcccaacactttgggaggttgaggcaggcgggtcacctgaggtcgggagttcaagaccagcctgaccaggatggagaaaccccgtctctactaaaaatacaaaattagccaggcgtggtggcgcatgcctgtaatcccagcaattcaggaggctgaggtaggagaatcgcttgaacctgggaggcagaggttgcagtgagccgagatcacgccattgcactctagcctaggcaacaagagcaaaactcggtctcaaaaaaaaaaaaaagaaagaaaaaaattagccaggtgtggtggcatgtgcttatagtctcagctactgaggagactgaggtgggaggatcacttgatcccaagaggctacaatgagccatgattgtgccactgcactccagcctgggtgatagagtgagaacctgcctcaaaaaaaaaaaaaaaaaaaaagaagaagaagaaatagatgcaaaaggtattatttatatattatatatatatatatatatatatatatggagggagaagcattatacaagaaacccactgggacatggctatgatcaaatatgggaaagggggaaaaaaggaggtaaagcaaagtctcaagcctggtatgttagtttccatctactgagatacagtgaagatgggattaaacatacgagataatttattggggaaaatgcctgtgagggaaagtaaggcgagagtgagaggaacctcagaccatgatgcagatctgattcctgtggaagagaaagagaggaaggaagttttagattgaagtgcagtttttgtttgtttgttttttgagacagagtctcactctgttgcccaggcttgagtgcagtagtgtgatctcggctcactgaaacctctgccccccgggttcaagcgattctcctgcctcagcctctcaagtagctgggattataggcacctgccaccgcacccagctaaattttgtatttttagtagagatagggtttcaccatcttggccaggctggtcttgaactcctgacctcgtgatccaccctgcctcagcctcccaaagttctgggattacaggcgtcagccaccgcgcccggcctgcagtgcagttctaagagcatttctgcaaggctgacagggagtcctccagccattcacacttcagaataaaacagtcacacaaaactgggctagctttcatacccctgctgggagcctgtgggaagccagttctctatgcaaaagaggtggtgaattcagaatgcaccaactgccacaactgagacactgagaaaaagatgcaaccacgaaaaaggtggaaagttctaatcacatacaaaatagcaatcagcctttctcatatttcaaagccttaaaaatggctgagcgcagaaaagccagggtggaattggcagaagagagatcatcaacctagaaacatggtgactggggttgggcgcagtggctcacgcctataatccaagcactttgggaggccgaggcaggcggatcatgaggtcaggagttcaagaccagtctgaccaatatggtgaaaccccgtctctactaaaaaaatacagaaattagccaggtgtggtggcacgtgcctgtagtccagcctgaggcaggagaatcgcttgaacctgggaggcggaggttgcagtgagccaagatcatgctactgcactccagcctgagagacagagcaagactctgtctcaaaaaaaaaaaagaaaagaaaaaaagaaacatggtgattgaaaaaaaaaaattgcaaggatatagttagctaatcaccttccagcaaccttcccacaacgaaactgtattccttgaaggaacaattagaaactacttcattctgagagttgtttcccagcccccattgtaaaataatttcactttcatttcttctcctcttttctctccatgacagataatgctctaccacaagaaaatggcctctcacctggggccattgctggcattgtgattggagtagtggccctggttgctctgatagcagtagccctggcatgttttctgcatttcgggaagaccggcaggtatgatggcctttcctcttgttctgtttcctccaaggctgactgccatgcttgggagagggaaagaattctttgcctgtctctgggcctggatctcatactcctcccactaaactcctgcttctcggcactaattcccacaggtttcctcttccctggtcttcgtgctccctgtctcccattatctcttggacatgggtattccaatccccatctaatctagaggaagagactcaagtatgttcctctgtcccctagtcagggaaagcaaggtctaagaaggaaaacaaatgaaaaaatgaaagaagcagcaggagaaagcaagtcatgtgctctgttgaccacattggaagaggagggagaaatagcataggaagagaacctaagagaaagcaaaaacaaccaaagtcctcttgaacaataaatagagaaaaaaaaaaaagtatctaccccggaaaacaaaatgggaaaggttttaaggatagaagtaggcacagaagcagctgataaagaatgaaatgaaatgtgaacatccagcaaacaggaaaagagtaaacactagaagggattgtagttagactgaagaacgaggccctcagaagaaaggcagtatgaacatcaaggactctaaggaattacctgctcacagtgtccttcctaacttacggaacaaagatcctgtgcttgggaatagcagtcacagtttctgatatttatttagggcaagcgaccagcgtgatctcacagagcacaaaccctcagtctccaaccacagtaagtaaagccacttaccccagtgagaactggtatgttccaccacgtgccctcccctggcagggaatcctggattcccaaaccactccctcccttctgaattttcacagaaaggatctctatttcccaaccctaaggtggcataggtcttcccacccttcctagccacaggagtcccctgagacacatctgaggagagaggctcactctgcctaggccaggcaggcctgaggaagatcccatgtttccaggagccatttcctcagccttactccttccgcctcctgcctctattacggatgtgggcactctcccttggtgagactttccttatcttgtgggtgctgtgggtgctacaagtctcaatgcccctccttgccactggagcatgttgctgagaaacacatctgggcaaaaatcaaggccttgtgaactggtagaactcttcacaagtggattgtggcctcctgtggttctgcccctgccccctctctggtactaacatgctgggtctggaccatacactctgagggaagtaaattccttaactgatccttaaactccccaccctccaactgccacctccttcagctagaatcacctgaagtcagctttgcatttccatggatcgctaactcttcttttgcttctccagctcaggaccactccaatgacccacctaacaaggtaagcatagccggttttcatgggcttattttctcatggaaatgattctgtgtagaattgattattcatgaagacacaatgtaacatcaagtttgggttaatgttcctcagtgcaacaacaaagacgtatttgtaatcactcccatgagtctactttgcagcaagaacatgcattttggaattattcccatcctgtgtctgaatactggatgtgactcttagtagctctgtgacccttgtcaagtaacttaacctctttgatcatcagctttgtcatctgtaaaatgggcattctgcctacttcaaagagaagttgaagggattaaacgagataacctacaaagagcacccagcacaatggcctaaaaaaggaaggcactgaatcattctcactcccctaccttcagtctgatcctgctcttattgtcaaaaggataatttcaattttaatagatctgagatcctgttttttaataataattttatagaatttttcattttatggccaggcacagtggctcatgcctgtaatcccagcactttgggaggccaaggcaggtgaaacacaaggtcaggagatcgagaccattctggctaacatggtgaaaccccagctctactaaaaatacaaaaaaattagccagctgtggtggcgggcgcctgtagtcccagctacttgggaggctgaggcaggagaatggcgtgaacccaggaggtggagtttgcagtgagccaagattgcgccattgcgctccagcctgggcgacagagggaaactctgtctcaaaaaaaaaagaagttttcattttaccttttcaatagagcaaacatacatactgaaaagtgctaaatcataattatactttcacaatgtatgaactttcacaagttgaacacacccaggtaagcagcacccaaatcatgaaatactacatgacctccccttaaaaagagacccttccagccaggtgcagtggctcacacctgtaatcccagcactctgggaggccaaggcaggtggatcactagaagtcaggagttctaaaccagcctggccaacatagtgaaaccttgttctactaaaaatacaaaaaattagccgggcgtggtagtggatgcctgtaatcccagctacttgggaggctgagacaggagcatcgcttgaacccgggaggcagagcttgcagtgagccgagatcgtgccattgcactccagcctgggcgacagagcgagactccgtcgcaaaaaaaaaaaactctaccagtcacttccctccaaaggaggagtaaccactatcctgacttctaatgctccagattagtattgcttggttttgttcctatctaaaggagaaataaaacatatccttatatgtggcttcttcaacattgctttgtgagactcatccatattgtatgtatttgtggtttgctggttctcattgctgcattatcctatcccattgcatatataccataatttctctcttctaatgatcattcatcaggaggtcagcaagcagagaatgggtaacaacaaaagcccttctccagagctaaaatttcaaaatggtaacagcttgtggtgctgaatcacaccaggcaaggtgaggccctgccctgtgtcactgacttaactgatcattatttgtgcttttcagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcgacatgctgcctcatggttgatactaccttggacaatgtttttctctacaggcagaataaacaaattgttcaatggggagtcagagtaaaactcttttttttttttttttgagacagagtctcactgtgtcgcccaggctggagtgc

SEQ ID NO: 13397 - DNA, 25969 bp, Human
agacagagaggaaaattccaggatgaggtagtaagagagagaaagagaatgagagatatatggggaaggagggggacggaagatttgagagagacagagagagggagagagagaaagagaatgagagatatatggggaaggagggggacggaagatttgagagagacagagagagggagagagagaaagagaatgagagatatatggggaaggagggggacggaagatttgagagagacagagagagggagagagagagagagaaagagaaagagaggagatcttagtgatagtgagagagaaagagagattcagagatagagaggagatcccagagagagagagtgggagagagacagagataggcagatcccagagagagatattagagagacagagagagagacagagagaggttgaaacaggaaaagagacaggtagggagagatgtgagcatcccagaggagacagcttgagagatgaagatagagacacaatgacagagagagacagaccgaaagacggaaaaagacagagacagaaagtactgatccttgagacgccaactcagagggaaataagaacccagagagacagaaactcagccagacctggggagacacagccaagagatggagacagacatcatgcaaggcagagagacaaagaaccagagatcagagagagacaaaatcatagaaagacacatgcagagagacccagagactgggatcaggatagagaatgacagagacaacataaagagatcagagcgatagagagagagagagagctatcaagagagagaaacagccttgcaaagacagagatacagagatggagagataaagagacaggagacagagagatgatgaaacaaagcaataagaccaagagccaaaaacagacctggagatacacatcaagggagacagacagaggagaaagagatggagatacacgtggagacatagaaaagacagatacgaggccgggcacggtggctcacgcctgtaatcccagcactttgggaggccgagacgggcggatcacgaggtcaggagattgcgaccatcctggctaacacagtgaaaccctgtctctactaaaaatacaaaaaaatgagccgggcgtagtggcgggcgcctgtagtcccagctactcgggaggctgaggcaggagaatggcgtgaacctgggaggcggagcttgcagtgagctgagatcatgccactgcactccagcctaggcgactaagcgagactccgtctcaaaaaaaaaaaaaaaaaaaagacagatatgtaggaaggttggacagggccagggagagggaagaagagacagaagcagagttaaaatgtcacatagaggtggggcacggtggcttattcctataatcccaacagtttgggaggctaaagcaggaggatcgcttgagtccaggagttagagaccagcctgggcagtgtagtgagaccccatttctagaaaaaaattaaaaattagccgggcgtggtggcacacacctgtagtcccagctacacaggaggcggaggcgggaggatcacctgagcctcagaagtcgaggctgcagtgagctgtgattgctgcactccagcctgggcatcagagtgagacattgtttcaaaaaacgaaaacaaagtcacatagacacagaacacaaaaggggagagccccgcaaagatgggcacagaaacagagagagactgaaacacaggcagaagccagacagggaccttcggggacagagactcagagacacacagaaccagagacagggaagctgattgcagcagatgagactcacgaggcctgagagtcaccagaggcagaagggaggtgaagtcacccagaggctccgggagacacagggagaccccgagaggcagacagagaccccccacccagagatgcaggggcaccggccaggaggatagctggggcatggagggccggtgtcctcctggaaccccttctcgcccgcagtctggtggctctgacagctatcgtatcgccacctcgcaggacaagaaagatgacaaggactcacccaagaagaacaagggcaaggagcgccgggacctggatgacctcaagaaggaggtggctatggtaagcctcgccctctgcccgcacaccctcccagagaacctcgccagttcttggctggcctaggcactcaccgtctcccccaaactcctgttcctcagacagagcacaagatgtcagtggaagaggtctgccggaaatacaacacagactgtgtgcaggtgtggccaggctgtgggctgggaccctgggaactagggaggaggagctgggggctaggacccctgggtctgagggaggaggggctgtggctggtgtcttaagttctgggggtctggtgaaggcctggggtgccagggttgcccagggagggttctgtgtgagtcctctgtccctcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacgtgagtgcctggaccctgccctgtgcaaggctctgcacatttatttacggacaccgcaccccaacttcttcccatccctctaagcttttcacagcccactctccccctttttcccatctaactcacaatcacccagcaagagaaccagatcaaatacaaggcaaactgaggctcagaaaagccaggctacttgtccaaggccccacagcaggatgtgtgagccggggctctgtcccaaggctgtgtgacctcagcggccttgagaacagacaccagcaggtggtcatggcttgacagatacccagagtgagtgtcacatagagacccaggcacaccccgctgctgatacatcagggcccatccccataacacagggacacattcgagatgcagcctcagatcccatgcgcataacacagaccacacaccagccacacagagctgctcacctgggtaggcgtgtgtgcacacacacgcatgtgcacggagggtcaacgcagatgccacaccaggatgtggtttcaaacatggccacctaattcagaaacacagacacagactcagatatacactgacagagaaactcacacacacactgacacgcacacacacacacagcaatgcaggcataacctggtgacagagagacatgagagtcaggcacagagagtgtcctcagatgttcaaatctaaacagtcttagacataagctctcacagagaggcagagctggagacacagagacagagatccacacacagagaaccaaagaagctgccttgtagaatgtaaagtcaggcatgcagccagtcagacagacacatggacagacagccgcatcccagactcaacatgtgcaggaggacagacacacacacaaaacagatggacaagtcgggcatggtggctcacgcctgtcatcccagcaccttgggaggccaaggcaggagggtaacttgagaccaggagttccagtagcctgagtaacatacccagacagacccagcctctaaaaaaacacaaaacatagccgggcctggtggcgcacacctgtagtcctagctactccggaggctgaggagggaggattgcttgaatctgggaggttgaggctacagtgaactgagattgtgccactgtactccatcctaggcagcagagcgagaccctgtctcaaaaaaaaaaaaaaaaaaaatgccaggaaagatggctcacacctgtaatcccagcactttgggaggccaaggtgatagatcacaaggtcaggagatcaagaccatcctagccaacatggtgaagccccatctctactaaaaatacacaaaattagccaggtgtggtggcatgcacctgtagtcccagctactcaggaggctgaggcaggaggatcgcttgaaccaggaggcggagattgcagtgagccaagatcatgccattgcactccagcctgggcgacagagtgagactctgtctcaaaaaaaaaatcgacagacccttagattcaaacacaaccattacagaaagagggactcaagcacaaacaggggagactcagacacaccaaccctcataaccaacctagggtcagacacacaaatacagacccccactgacacaaagctcccttcccagactccaggcgagcagggactggtggagagtggcttgggcggcccctgatcaacatccccacatctccccacagctgtacctgggcatcgtgctggcggccgtggtgatcatcactggctgcttctcctactaccaggaggccaagagctccaagatcatggagtccttcaagaacatggtgccccaggtgaagggtgcccagcaaggggccagacgggggtgttagtgtatgggctgggggccgggcccagtgacccccaggcagagggagtctgggaggtgacattactccatcccacctcagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtgggcctgggcctagggcccggctttaccctccctcgggctgcccaggagctcaggcccagcccctcctccctcacactcaggagtccaggtcccaacccctcctccctcagacccaggagtccaggcccccaggccctcctccctcagacccaggagtttaggccctgggccacctcctcacccaacagtcaggagtccaggcccagccctcacctttcggagatccttagggaccctagaccttggccagcagcactgtgccttccccaccttcaagatcccagcctctggcctcccacacaccactcacccactgggcacccaggcttctagctgtgatctccaggcacacaggcttcagccccaagccctgtacacaaataccctcctgtcccaggccctggactgaaccctctctctgctgcacctacccccaggtggacaactcctccctgactggcgaatccgagccccagactcgctctcccgactgcacgcacgacaaccccttggagactcggaacatcaccttcttttccaccaactgtgtggaaggtgaggcgggtgcagagaagacacacagctggggcagacacagggatgtgtcccagggggtcaggcctccagaacctccctgagccaccccacctcagcctaacccctctggcctgcaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtaaggccaggctcctgggtctgggtggggagggcctgggggtctgggctcctgggtctgagggaggaggggctgggatcctggacccctgagtctgagggaggaggggctagaggcctggacccgtgtgtctgggggaggaggggctgggatctggacccctgggtccggagaaggggctgggggcctggatcacagtattcttgtgaaagacaacttgggcctgactcagagggcctcattaacaaagcaaacaatcaaagaaagaaacaaacaaaaatcttgagaaacactggcaagccgtaaagagccaacaatcctattgcaaaattaagaagtgcacgctcatgatgaaaagttgaagagtacatcaagttaaaaaataaaataatgaggctgggtgcactggctcacgctgtaatcccagcactttggggggccaaggcgggcagatcagctgaggtcaggagttcaagactagcctggccaacatggtgaaaccctgtctctactgaaaatacaaaattagtggggcgtggtggcacatgcctgtaatcccagctactcaggaggctgaggcaggagaatcgcttgaacctgggaggcggaggttgcagtgagccaagatcacgccattgcactccagcctgggtgacaagagtgaaactccatctcaaaaataaataaataaataaataaaataaaataataagcctggcgcagtggctcacgcctttaatcccaacagtttgggaggctgaggcaggaggaccgcttgaggtcaggagtttgagacaagcctggacaacatagtaagaacccatctctaccaaaaaatgtgaaggctgggcgcagtggctcatgcctgtagtcccaagactttgggaggccgaggcgggtggatcacctgaggtcaggagttcgagaccagactggccaacatggcaaaaccccatctctactaaaagtataaaaattagccaggcgtggtgatgggtgcctggaatcccagctactcaggaggctgagacaggagaatagcttgagcctaggaggcagagcttgcagtgagccgagatcgtgccacctcactccagcctgggcgacaaaagcgagattctgtctcaaaaaaaaaaaaaaaaaaaaaaaaatttttttaaattagccaggcgtggtggtacatgtctgtagttccagctatttgggaggctgacccgggaggttgaggctgtagtgggccatgattgaaccactgcactctagcctgtgtgacagagggagactccatctcaagaaaataataataataataattattataataataataattattattattatttttaaaaattttttctctggctgctttgctgccagcttcaccccagaagtccattctctgtgaggttccgcctgacagctgtgagcatattgactaaatgctgtcttcaaggtgcatggcagggactatcttagaaataccattctcctctttcattctttgacttaatgttttatgtgaagttttccatattagggccgggcagggtggctcacgcctgtaatcccagcactttgggaatccgaggtgggtggatcacttgaggtcaggagttcaagaccagcctggccaacatggcaaaaccccatctctactaaaaatacaaaaattagccaggcgtgatggtgggcgcctgtaatcccagctacttgggaggctgaggcacaagaattgcttgaacctgggaggtggaggttgcagtgagctgagatcgagccactgcactccagcctggacgacagagcaagactgtgtctcaaaaaaaaaaaaagtttactgttttccatattagcaatgttgaatgctaccctatgtcaaatggatttttatacgcaaaggattaagcatattgtgagcacatagtctgatgatttggggcaaactgaacacaatcacgtcagctgcaacgagactgcgtctccctgaagccccctcaagaccttatttagcccctgccccccaacccaagggtaacccctgatctggctgctaacagcatagattaactttgcctgtgttcaaacttcctattaacggaataattcagtatgaactcatttctggctctttttggctgaacatgtttttgacgttcacccatgcaggtgcaggcagcagtaatgtatttgtttttatcaatgttagtattccattgtccacaatttatcttttctgctgttagtggacatttgagtagtttgcagttttggacaattttttttttttttgagttggagtctcactctgttgcccaggctggagtgcagtgtcacgatttcggatcactgcaacctccacctcctgggttcaaggggttctcgtgcctcagcttcccaagtagctgggatgacaggagtgtaccatcatgccctgctaatttctgtatttttagtagggatggggtttcaccatgttagccaggctggtctcgaactcctgatctcaagtgatgcgcctacctcggcctcccaaagtgctgggattacaggcgtgagccactgcacctggctgttttgcactattatgcatgtggctgctatgagcattctagtccctgtctttgggtgtctctgccctgtttctattggtctgaattgggggtggcattgctgggtgctgcctcattcttttccaggccctcaggattctctgggggctgggcagctgggctgtggccctcgtgtcgctcatccaaccctgctgccgggcttgtccctgtaacttgcctgcccttgctcgtcctccaggtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcaggtgagcgcaggccccgggtgaggaccatgggggcctggctccaggagtccctggccctcacacatgcctcccccagggacctcatttgacaagagttcgcacacctgggtggccctgtctcacatcgctgggctctgcaatcgcgctgtcttcaagggtggtcaggacaacatccctgtgctcaaggtgggttcagctactggcctcacctcggccctgcctgtgtcctcccctcagctgtccctgttctgacaaccctttctccttgcagagggatgtggctggggatgcgtctgagtctgccctgctcaagtgcatcgagctgtcctctggctccgtgaagctgatgcgtgaacgcaacaagaaagtggctgagattcccttcaattccaccaacaaataccaggtactctgggctttccgggagagccagcctggacctcaggttccttatgacgcctgtaaagaggtgtcatagagccttgattttcccgtctgtaaaatgggaatgataatacccgcctggtggggagaggaacagggagagcttgagagtgggagccggatctctgttggagtgagacgctgaggagtaaagatcttcctgcaggccaggcgcggtggctcacacctttaacaccagaactttgggaggctgaggtggggggatcacttgaggccaggagttcgagacgagcctgggcaagatggcaaaaccccatctgtacgaaattttttttttaattagccaggtgtggtggtatgtgcctgtggtctcagcgatttgggagtctgaggcaggaggattgcctgagccggggaggttggggctgcagagagcctacatcacgcactgtactccagcctgggtgacagagcaagaccctgactcaaaaaaaaaaaaaaagttttcctacagcagagagtgggaacaagcaggagacctcttggggcagagcagcaactttaaattattcagcaaactttttttttttttgagacagagtttcgctctgtcacccaggctggagtgcagtggcgcgatctcagctcactgcaagctccacctcccgggttcacaccattctcctgcctcagcctccagaatagctgggactacaggcgcccgccaccatgcccagctaattttttgtatttttagtagagacggggtttcaccgtgttagccaggatggtctcgatctcctgacctcgtgatctgcccgcctcagcctcccaaagtgctgggattacaggcatgagccaccgcgcccggcctcagtaaacttttttttgagatggagtcttgctctgtcgcccaggctaaaaggcagtggtgtgatcttggctcactgcaacctctgtctctgggttcaagtgattctcatatctcagcctcccgagtagctggaattagaggcgtgcaccaccacacccagctagtttttgtatttttagtattgatggggtttcatcatgttggccaggctggtcttgaactcctgacctcaagtgatccacccacctcggcctcccaaagtgctgggattacaggcataagccatcatgcccggcccattcagtatacattttttgaccagccaccacatgttaggccctgttttgggtgctgggtgtacacacagtagtgagtgacatggtgaagtcacccctctctgagacttacgctctggttctagaagacagacaataacaaaggcatgaggaggtaatcgtagtggttgtggtgctgagggagggaaccctgcaggtgtctgggggaagagcgctccggtagcaggcacagcctgtgcaaaggcccagaggcgggagtgtgctgacgcatctgaacaccagccagccagccagtgcagaggggctgggagccagggagcgtggtgggggtggtgggtgctggccagatcctgtcaggccccacgggcatggagaggacttggctgtgactctgaggagcacacaagcctccagggggctctcagccaaagagagacaggagttgactcagagcttttaaaataactttattaagatataattaacataccatagctcgtccctctaagtgtataatttaatagttttagtatattcgcagatataggcagccatccacatagtcaattttagagcattttcatcacctccaaaaagaaaccccacatctctcagctgtcacccgccccctcctccccgacactcccagccctaagcaaccactaacctactttctgtccgtatggttttgcctattctggacatttcataaaaatggaagcatacagctgggtgtggtggctcacgcctgtaatcccagcactttgggagaccgaggcaggaggatcgcttgaactcaggagatggagaccagcgtgggcaacatagggagagcatgtctctataaaaaattagccaggcatggtggtgtggacctgtggtcccagctacgtgggagactgaagcgggaggatcgcatgagcctgggagatcaaggctgcagtgagctgtgatctcgccactgttctccagcctgggtgacagagtgagaccctgtcttaaaaaaaaaaaacagggtgggaggaggggagcacagacgtggtggcttatgcctgttatcccagcactttgagaggccgatgagggcagatcacttgaggccaggagttcaagaccagcctggccaacatggcaaaatcccgtctctactaaaaatacaaaagttagctgggtgtggtggtggtgcctgtaatcccaagctactccggaggctgaggcaggagaattgcttgaacccaggaggtggaggttgcagtgagctgagatcgtgccactgcactccagcctgggcaacagagcgagactctgtctcaaaaaaaaaagaaaaaagaaaaaaagaaaaagaaaaagaaatatatatccatgacatagacagagcggacaggaatgagcagaggtctctgtgagagagtgtgggggagccctggtgtgggcctatcctggcacccgtggctctggacaggggacaggatggggcagggagcttcctggtgtctgcgtggctcaggcacgccaccctctgatcggtccccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtgcgaggctgccgggcgggctctggggtccctggagggcaaggagggttgtgatgctgcccaaagcctgtctcagcccagggcctcccagaatatactgtaaatgaatgaatgaatgaatgaatggatggatgagaggggaaggtatcctaggaaatgaatgctgactggccgtcttgctgatggggagatggaatgcgggcgatgcagacatctaggggcatggggcggaggttccgaggctgggaccctcacaccccaacccttccctgccactaggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtgtggcttggggtggctgggggaggcaaagccaggcgtggggcgggagaggccatccctaaaaaacaatgcctgcaggtcatcatggtcaccggcgatcaccccatcacggccaaggccattgccaagggtgtgggcatcatctctgagggcaacgagactgtggaggacatcgccgcccggctcaacattcccgtcagccaggttaacccccggtgagccacccatcccagccagggccctggacatccctctagggtgttgacacagggggaccgcttccccccaacctccctctgcactgcctgtcccattctttctgggactcctccatggaccaggccctgggtctggccctccctccggtgtggggacattgcagccacagaggtagccaggcataggtttgcatcccagcctttattttattttatttatttatttatgtttttgagatggagtcttgctctgtcgcccaggctggagtgcagtggggcaacctcagctcactgcagcctccgcctcccgggttcaagcaattatctgcctcagcctcttgagtagctgggattacaggggccctccaccatgccccgctaattttttttttttttttgtatttttagtagagacgggggtttcactatgttggccaggctggtctcgaactcctgacctcaggtggtccacctgccttggcctcccaaagtgctgggattacaggcgtgagccactgcgcccggcctgcattccagcttataccgctcacaagctgtgtgacattgggcaagtcctttagcatccatgaacttcagtttgcccatctctaaaatgggctactaataattcctatctcagaggattcagtagaatccagtacttctgtgtctgtctctcttttttcctgtctgtctgtcattgtctctcttttctgttctgtttttctgacttcttcaactttcccatcctcatacctatctctgactctgccttccttcagcttgtccatttatctccgttcctctgaatccactgtgtcttggctgggcgcagtggctcacgcctgtaatcccagcattttgggaggccgaggtgggtggatcacttgaggtcaggagttcgagagcagcctggccaacatggcaaaaccccatctgcactaaaaattaaaaaaaaattagccaggcgtggtggtgggcacctgtaatcctatctactagggaggctgagacaggaaaatcacttgaacccaagaagcaaaggttgcagtgagccgagattgcgccactgcactccagcttgggtgacagagcgagactccatctcaaaaataaataaataaataataaataaataaataaataaatccactgccccaaagtccttcctcaggtctgcccgcacgccctgctgcagtagcccccttctcccctgcttctcccagaggcctcttcccccagcccctggtcctctggctctcctggttgtggggctggcccctctgtttctctgtctttcagggatcactttgccactcctcacacaccctgacctcagccatcgctctctctgctcttcccagggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacaggtgggctgcgctcccgcagaggaggggacggggccttgactcctgggtcctcactgaggccggggcctggtttcctgggtctgagggaggaggggctgggggtctggacccctgggtctgagagaggagggtctgggggcctggactcctgggtctgagggaggagggggctggggacctggacccttgggtctgagggagggggcctggacttctgggtatgagggaagaggggataggggcctgaactcctgggtctgagggaggagggggtgggggcctggacccttgggtctgagggaggaggggctgggggcctggacccctgggtctgagggaggagggtctgggggcctggactgctgagtctgagggagaaggaggctgggggcctggacctctgggtctgagggaggagggtctgggggtctggacccctgggtctgagggaggaaggtctggaggcctgaactcctaggtctgaggggaagaggaggttggggacctgaacttctaggtctgaaggaggagggggctggggtcctgggcttctggatctgagggaggggactctggggactggcctctgggtgtcatccttaccctctctccctccagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggtgagttggccaggggtggccctggagaccagggtcactaccggaggcctgagaccagcaaggggaactggccagggctgcagggggatgtgtggcagagaccacaggccccctggccctggaggagcctgagcctgtccttttctgtcttcctcccctgtggggtcgggagctcccctgggcaggactgagctgacacacttcagggtccctgcgtcatccagcccaggccccatctggtgggtgaagctgacttggaggctttttaaagatattctcagccaggggcggcagccacgcctgtaatcccagcactttggaaggctgaagcaggcagatcatgaggtcagaagatcgagaccatcctggctaacatggtgaaaccccgtctctactaaaaatacaaaaaattagccgggcattgtggcggttgcctgtagtcccagctactcgggaggctgaggcaggagaattgcttgaacccaggaggtggaggttgcagtgagctgagattgcgccacagcactccagcctgggggacagagcgagactccgtctcaaaaaaaaaaaaaaattctcaagcccaaccagggggaagccagggaccctgggggataccccctctgccagcctgggctgggggtcaagggagcttcccagagtggacagggatggctgagccaagtcaggggccatgctgtgacgtccacatagactagtgccagggagtcgcaggcagaggaaccggtacacaggcaaggcggtgtgaggggctgggtctgaggctggtgctgctgagccgacaggcaccacctcctgacaggcccagacaaggccacagaagggttggttcacattcagatttattttgatcatcaaattaattcatgataatcatagacaaatgcagaaaagcattcaggaaaaaagtagaatcacccgtaacctcgccatccagaaataatcacggttcatgccttggtggattttcttccaatttctctctcctatttgaaatgtctctggtgtaaaaagtagttcatggtaaaagagaattcaaacggcaaagccgagcccagagtaacagattaaatgtcctcagcccttgtctcctatatcccagaggaaaccatggttaacaccttcttatctcccaagagacatctttttttgggggctgggggcggggatagagtctcaatctgtcacccaggatggagtgcagtggcacaatcacggctaactgcagcctccacctccgggacttaatcgatcctcctgcctcaggcccctaagtagctgagactacaggtatgcaccatcacacctggctgatttttaagattttgtagagatggggtttcgccatgttgcccagactagtctttctttttttttgagacagagtcttgctctgtcacccaggctggagtacaggcatgcaatctcggcttactgtagcctccacctcctgggttcaagcaattctcctgcttcagcctcccgagtagctagaattacaggtgcatgccaccacaccaggctaatttttgtatttttagtagagatggggtttcaccatgttagccaggctggtcttgatctcctgacctgaagtgatccccgcaccttggcctcccaaagtgctgggattgcaggggtgagccacctcgcccagcgaggtcttcaactcctgggctcaagcaatcctcccaccttggcctcccaatttgctgggattacaggcatgagccaccacgcctggcctccccaagacatctatgcatacacagtacacacactgtctcagatacagccgtctgctccttccgaatcttgtgcatcatgctggaagcctgggaggcagctgtgagcagagcagacaccatccctgttctcacagggctggagagacagccttaaacaagttaacagatatgtaattacaaattgtgatatatgccccgaagaaagcaggccgctgtgatagataatagtgagggtcctgcccagatggggtggacagggaaggcctctctgaagtgagggaagaaatacctaacttccgtcaggggccaggcacgggggctcacgcctgtaatcccagcactttgggagaccaaggcgggaggatcgcttgagcccaggagttcaagacctgcctgtacaacaaattaagacctcaaagatcaaaaaattttaaaaattagcagggcgtggtgttgcacacctgtagtctcagagacttggggggctgaggcaggaggatcacttgagcctgggtggtcgaggctgccatgaaccatgatggtgccactgcactccagcctgggatagagcgagatccgagaccctgtctcaaacaaacaaacaaaataacttccaacgggggcattccagatatacccaaaagtaaagcaaaggcacagtgggcccctgcgcctccatcccacctgcagcggcagtcagcacacggcacaccttgtttcttccccaccacctggaacacacactggattatgctgatgcacatttgtcaccatttcatccataaatagtttaggatgagaaacccctagtttgtggagaagagcacaatgcagggaacgagaatatcaggtgggagcggcccaggcccttattgctatgcaagagacatcaaagcaatcaaagaagccacaccacaggcagcctgcttcaccttcccttccctccctccctcccttcctccctccctccgtccctgcctgcctgccttccttccttctttccttccttccttccttccttccttccttccttccttccttccttccttccttccccttccttccttccttccccctcccctcccctcccctttttttgatggagtcttgctctgttgccaggctggagtgcagtggcgtgatgttggctcactgcaacctccacctcccagcttcaagcgattcttctgcctcagcttcccacatagctggaactacaggcacacaccaccactcccagctaattttttgtgttttagtagagatggggtttcaccatgttggccaggatagtctcgatctcctgacctcgtgatccacccgcctcagcctcccaaagtgctgggattacaggtgtttgccaccgtgcccgcctgttctttcttaatgattgacctcattgttcatgggctaatctttttacttatttatttatttagagacaaggtctcactctgttgcccaggctggagcgcagtgctgcaatcatcagtcactgcaacctcgacctcctcaagtgatcctcccacctcagcctcccaagtagctgcgaccacaggctcgagccaccgtgcctgactaatgtttattttattttattttatttttttgagatggagtcttgctctgttgcccaggctggagtgcaatggcacaatcgcggctcactgcaacgtctgcctctgaggttcaaatgattctcctgcctcagcctcccaagtagctggggttacaggtgcccaccaccacgcccagctaatttttgtatttttagtagagatggggtttcatcatgttggccaggctggtcttgaactcttgatctcaggcaatcctcctgcttcggtctcccaaagtgttgggattacaggtgtgagccccagcgcctggcctggattaatctttattttgtttactttagacaacctgtactggttgaatatttattgagatatggcatgcatacagtgagttgggcatattatatctcattaaaatattcaaccagacagggtgtataaatttttacacatgtacacagccatgcaaccaccagaccccagtcaagatagaaaaccattccagccccccatttaggttttgtctgctctcttccagtctatatccctcctcctagacataaccattatcctgacttttagcccagagacgggtgctgagcctgctccagttggagttggatgctaagaatgcttttgtgtctggctcgtgtcactcagcacgggatccaaggtccagctgtggagttgtgtccgtagctcgccccttcttgctgtgtagtatttgactgcatggatgtaccgtggtttattcatccctcacctgttgatggacatggggttgactctggcttttggctctgatgagtggtgctatggtgaacattctcgtacttgcttttcgctgggcataaacagtcctcctctcttttgggtataaaacctaggagtcggattactcggtcggtggggtgggggatgtttgatagcaactccgaaaccatcttccaaagtggttatttcaagaatgtttccacaaaggcgatgtggttggatgtttatgtggaaaggtaggtgggtgaggggccaggtgtggagacttatgcctgtaatcccagcacttcgggaggctgagatggaatcacagcccagaaattagacaagcctaggaaaagtggtgagactctgtctctactaaaaatacaaaaattagctggacgtggtggcgcgtgactgtagtctcagctacatgggaggctgaggcaggaggatcacttgagcctgggagtcgaggttgcagtgagccgtgatcatgccactgcactgcagcctgggcaacagagtgagaccctgtcccaaaaagaaaataatggtgggtgggctggggggtagaaaaggacgctggacaggccgggcgcggtggctcacgcctgtaatcccagcacttcaggaggccgaggagggcagatcacgaggtcaggagattgagaccatgcaggctaacacagtgaaaccccgtctctaataaaaatacaaaaaaattagccgggcgtggtggcaggtgcctgtagtgccagctactcgggaggctgaggcaggagaatggcgtgaacccgggaggcggagcttgcagtgagccgagatcgcaccactgcactccagcctgggcaacacagcgagactctgtctcaaaaaaaaaaaaaaaaaaaaaaaggacgttggatgagggcagaggaggggcagagggagtggggctccctggcatgggcgcctgctctgagcctgcctgtgccacaggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtgagccctggcagccacccttggggcccaggagggtggagtcctcccctctccggctcacccggcctcctccgcctaggtccctgccatctcactggcgtacgaggctgccgaaagcgacatcatgaagagacagcccaggaacccgcggacggacaaattggtcaatgagagactcatcagcatggcctacgggcagattggtgaggcaccggggactccatctccttaccacccagtgccgggcctagagcagtgcctggcccaccgtgggtgcttgggaccctggcattgactcaggggagcagacgtgggcaggaccaaccagtgagctatctgaggggggggtctgcaccccatccttctccacctcctcctctctgctgttgatgtgtgcggatccccagaggagtggagcagccacccttgggggctgtcccagcaagcagagacttcatggcagtggttccaggcccagggaggtcattcctgcgtagggagctcaagctggggatcccccaagaattcatgatgtttaggtggcctaggtcaggtgagagaggggctccaggttatccctctgggagagccctctctccaaagcccctgtcccaggtggcccacccatctcagggcctcaccaccaagtgagacctcaggtcaccctctgggaaccaatgtccagataacagggccaggagggcatactcccctctccaaggaggcctccgggccctctgaggtgccctgggttggctgctggccccaatctgagcctctcctcggcttcctctctcctccttccaggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtgggtgagtagggcagggtgctgtgtctctgcccaccgtaagatccccggggtgagctgttccagccatgcatggccacttcctacgatggccccctcagtctcccatggcagcatcaaggcctttgctgggcacctggggcttcctggatgcccttggcccagcccatctggagccttgtgtcccactgctggagctctctgccctgccaggccttcttccccacctctgtctgtcccttcaaagcccagttgctgtctgtcctccttgggaggcccacagggtccttatcctcctccctggcccctggtggatggtgagatcaccattaacctttcttcttccttgtacgtctcctgactcctccctcgggactatgagcccgcagaaggaagacacacctgaggccctgaggaccccatgcaggatggggcggggcaaagagcaccggaacgtcggggtggcggctagggctgcagtgccactaactgacgtcccgtgccctggtcaccgctcctgcagacatacgagcagaggaaggtggtggagttcacctgccacacggccttctttgtgagcatcgttgtcgtccagtgggccgatctgatcatctgcaagacccggaggaactcggtcttccagcagggcatgaagtgagggccgggggcacatggtgactggacagccatctgtcctgtccgagtgtctgtctgtctgtgtacttcctcttgtgtccttgctttggttttttgttgttttgttgaggcagggtctcactctgtcacccagactggagttcagtggtgtaatcatagctcactgcagcctcgacctcctgggctcaagtgacccacccacctcagcctcctgagtagctgagactacaggtgtgcaccatcatatatggctaatttttatttatttatttagagacagagtcttgctctgttgcccaggctggagtgcagtggcacaatcttggctcactgcaacctccgcctcccgggttcaagcgattctcatgcctcagcctcccaagtagctgggattacaggtacgcaccaccaggctcggctaatttttcgtatttttagtagagtttcaccatgttgcccaggctggtctcaaactcctgagctcaggcaatcttcctgcctcagcctcccagagtgctaggattacaggtgtgagccaccatgcccagcccattttgggttttgccactgcactgattttctctcaaggggtcctgtgtgtcctagattctctctcagcctctgtgtgtgtggtggaggtgcccctggccttttctttttataccagtgcctctctgtgtctgtccctgtctctgtgtctgtttctgtccctgtctctgtgtctgtccctgtgtctgtctgtctgtccctgtctgtctctgtgtctgtccctgtctctgtgtctgtccctgtcttttgtctctttctgtgtcaccatcgctctgcctctatctttgtctctctctgtcggggcatgtctccccatctctgtctctccctatgtctctgcctctctgtctctgtgtctgtgctgctgtctctgggtgtctgcactgtgcctccccctgtctctgcggggtggcaggtgcagggtgggtgctctctgggcccagccctgcccttctgtgcctccaggaacaagatcctgatcttcgggctgtttgaggagacggccctggctgccttcctgtcctactgccccggcatggacgtggccctgcgcatgtaccctctcaagtgagtgccccgctgcccccagccctgcccacaccagcgcctgccatggagccttcccttagactcagcctgaacctcaggccccacctcccctggtgtccccactgcagtccccattctgatgcccccgagcctcccccataggctgctcccaccacggattactccgaagaccccaggccccagccccgcccagggcaccctccacctgtgagcacgaaggatcctgggagactgcccctctgcgtcccctccagtcccctgaaactctgcctctcgttagggccccgcactcaagccctcctgctctcccctctgcaggcccagctggtggttctgtgccttcccctacagtttcctcatcttcgtctacgacgaaatccgcaaactcatcctgcgcaggaacccagggggtgagggagctcggcaaggcagccgaggggggcggggggcagcagggtctcaggcagctggtcccaggctcccctcgccctgctggatggctctgccacctggttcccactcttctctctcttcccatctctccgggcacccactctgtcttctcacgggtctctgtctgtgtggtttccttgtctctctccctctctgtccctctctctgctgggcggctcgccttgcctgtctctctccatctcttactctgtctctttctttccttctttgtctctccaggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaagcggtgtgtgtgttgtgcctgctttccagacggggactgcggctgggacagcatcccctctgttggggcgcgctgccaggcgactctcgaaactgcaggaacttagcctggcactggcttggaagtcacggaatctcagagccatctaatcacggagttttcaactccacgaaagtcagagcagcttgaattcaccaggcgatggcattgtggaatcagaacaggggagagggagggaagcagacgtgggatggtgactgggagcctctcctataggagtaggacccaggggacacaatgacgatgatgatggtgatgacagtgattcactgagtgcctgctatgtgctctgcccacttttaagtgtgcattaaatgtgcacagagagaagaagtgatttgcacacagctaagaagagacaaatctgggatttgaaccaaggctgtccaaagttctaggtcactacgctattctctctttttattgagataaactttcatacagtgaagtgcacgcatcttaagggtatagctcaatgattttaaaaattgcatctgcaggccaagcgcggtggctcccgcctgtaatcccagcactttgggaggcccaggcgggcgggtcacttgaggtcaggagtacgagaccagcctggccaacatggcgaaaccccatctctacgaaaaatacaaaaaaaaaaaaaaaaaaaaaactgggcgcagtggctcacacctgtaatcccagcactttggaaggccgaggcgggcagatcacaaggccaggagatcgagactatcctggctaacatggtgaaaccccgtctccactaaaaattaaaaaaaaattagcctggcgtggcggcactcatctgtaatcccagctacttgggaggctgaggcaggagaatggcatgaacctgggaggcggagcttgcagtgagccaagatcccactactgcactccagcctgggtgacaaagcgagactccgtctcaaaaacaaaaaaacaaaaaaacaaaaaacttagctgggcatggtggtgcatgcctgtaatcccagctactcaggaggctgaagcaggagaattgcttgaacccgggaggcagaggttgcagtaatccgagatcatgccactgcactccagcctgggcaacagcgagaacccgtctcaaaaaaaaaaaaaaagttgcatctgcaaagctaccacccacatcaaggcatagaacctttccctccacccagaaagttcactggagcccctccagtcgcctcccctccagaggcaagagctgatctggtttctgttaccacacatcagttgtgcctgttcttgagcttcatacaaatgaaatcttacagcatgtgatctctgtgtctggctccttgttctcagcattatgtctataggagtcatccatattgtcacctgcatctgtggccccttccttttcatcccattgtgggactataacacaatttgtctattctcctgttgggggacttaggggtttccagtttggggctattacaattggtgctgctagggacaggaacatcctagtcatgtcttttttttttttttttttgaaatggagtcttgctttgtcacccaggttagagtgcagtggcaccatctcagctcactgcaaccttcacctcctgggttcaagcgattctcctgcctcagcctcccaagtagctgggattacaggcacctgccaacatgcccggctagtttttgtatttttattagagactgggttttgccatgttggccaggctggtctcaaactcctgacctcaagtgatccgcccaccaacatggtgaaacgccgtctctactaaaaatacaaaaactagctgggcgtggtggcatgtgcttgtaatcccagctactcacagggctgaggcaggagaatcactggaacctgggaggtggaggttgcagtgagcc

SEQ ID NO: 13398 - DNA, 45469 bp, Human
tgtggggttgtttcatctctcagggagcgtatacagccttccccggctccaggactgaactgcagacctggccgcactggaagtgggtggtccttctctgctggctctagggggctggaatggggtcacatccaaaagcgtgttcctgacgtggatgatgttgagtctgtccagggtggagcataagggtggctggtgaggttttgcccccccccataatgtcctatagccccatttccaagccccccaaaacaaatcctaactgaaaacaaagcttactgcgtaaatgtcgctttgagacaaggctccagtgtccactgctaccaggctgctgtcgggaagaccctcatgtatagaaatcctgtggccagttgctgtgtggtctgtggatctcctctgtgaaatggcctttacgatacgggatgttgtggagtgtagatgccgggaaacggtcacctctcgtgtgcatatatgagaactgccagtccttcctgttgtgcccacctgcttgcctgggtgtgtctgggtgcacagggcacgtgtgcagtcaggggagggcactcctgtagttgtgcctgtagtataccctttctgagtgtgcctgtgtgtgagtgggtgcgagtggccaggaagtatgcttgggcacatatgtgtagaagtgcccttgtgcccatgggtccatgtgagggagtagaggaggtatcagtatatgggagtgaccatcgtcagcagggagggctggtgttggggcctgtgcacatagatgtgttcatgcacgtgtgtgtgcacacgtgtgtgtgtgtgaagtgctggggttcatctgtagaaatacttgtgtgtgtgagggtgagtccaggcgtctgtgcatgcacctgtggtttagggggccccccagccacggggcgcaggatgtcctgcggggcccaggcgggcatgtggggtgtctggagacgccaggcagccccacagcctcagacctcgggcaccaagaggaagagggcagcggactcgggcgcgcctttgtctgagctgcggtgcgccgggagtcctgcgcctttgtgtgaccctcgcaggtgtgcgagcggaggtgttgggagggtgttggggaggggagcggagggaggggctcccttctccgcagccggccccgccctccggcccattggctgggcgctgccgccctctggcgggcacggagggaagcgctgaaatgggagcgccgcagcgcgaagagccagccggcagcccggggacctggtgctcccctccactggagccgcctcgggcgcccgcatttggccggcgacttattgtagccccaggccaagtccccgacccaccgtccccactaccactgcccacgggcaccacttcctcccaatggtggcacccaacagctcacctgcagataggcgcagggcttgcttgatcttaccctgccgcggcgtgcttttaagcttcaacgcttcttggctctgggcctttgggaaagctactgctcacctctctgatcctcagtcttttcatctgtaaaatggggcaaataagagtgaccaccacattggagatggcacctgtcaagagtgaggcacagggtcaggcatcggcaaagccctctctccaataagctgctggctagtgttttattgttgttactgctgtggacccaccttctctcccagacccccattccctgttccagacttgtttgcctccatgggggcgacagaagtcggggggcaactgttgcaggcacctcttggatcgcagccgtaggagtcggctcttccagcctgcttatcctctgccccactagcccccaccccccagcacacacacatgatttggggtgggccgggctgccggggcgggtctgtgggccagggtattttcccttctgaagggggcggaccggccctgtggtttcctccctgagtgacttccggcagggagggctcggcccccagagagggtggggagatgacacagttgttcccccagccctggcggggcgggcagcatggttcactccagcatgggggctccaggtaagggggctggtgcctgtgccactgctcagaggacaggcagcacatttaggtttgctctgcgggccctgcctgcccctcctcctcagctgtctccattgtccttctcctctgtactctagcaactccctctctcccatgccgggtccccgctaacccccacagctcctctttgccctctctttccacatcaggcaccggaacttccaacatcttctcttctctgttgccctgttccgaagggtctggggacgggagggagggagctgggtgttggtagcgggccctcatgtggagaaccagtggggtgggtgacatgggcaatccttggataagggctgcaaagggattggaatgccaagttgctggacttgggggatgtcattcccttttgagtgtgtgtgtgcacatctggtacaggtgtgcgtgtgcatgtgtgtgtgcagtagttctgagtgctctgagtgggactgctgtgtgcttgtgagtgtagggggctgttgtgtgtggcattgtggggtgatgattgcctggctcccttcttcacttcattcacctcagatgtcacctcctcagggcagccttccctgacctccccatctaaactggcactgatcctgtcactctcagtcccctcaccctgctttatcttttcttcacggcacgtatcactgctgggaatttcattatgtgtttgtttgtgtgcttattaaatgccttctccaccaaatgtcagttggctgagtgaacattgtgcaccaggcactgtacaaggtgatttatagctgttggctcatttagtagaatgtgtatatgtctgtatggtgatggctatcactcagcagtgttgatgggagtcttaaatgaggtaatacatgtagcatgcttagcacagtgcctggaacatggcaagcactcagcccttcatgcctgtttcatttgtggctgtgtaggcatgaccatgggcatgagtcttggtttggtggtgtgtgctgtcctatatgcgccattgtgtgcgggcacccgtgtgtcctccaccaacatgtatctattgagtagttctgtgttgggtgttggaagtacagtggaaagggtagctcaggtctgtcctcctggagctcccagtttattggagaagacagacctgtcaccaatgacagtacagacaggtcagggctgggatgggggaggtccaggcagagggatcagggctgggatgggggaggcccaggcagaggggtcagggctgggatgggggaggcccaggcagaagggtcagggctggggtggtgggcacaggcagaggtgtcggggtgggatggggggacaaaggtagaggggttggggctgggatgagggaggccccaagcagaggggtcagggctggggttggggaggctcaggcagaggggtcagggctgggatggggggacataggtagaggggttggggctgggatgggggaggcccaggcagaggggtcagggctgggatagggggacataggtagaggggttgggccaggacggggaggtattaggggatcgtaggagccctgaaaacatgtgatttagttggtagagtgtcaaggagggcttcctggaggaagggggtgtctgagcagggatatgaagaatgagtgggtatgagcaagcaaaggcggtgaggagaggggtgggatgaaaggaagactatttgcagggtgacatgtttatttgttgaggtgactgtgtatgcaactgtgtatatgtgtgtgtgtccatacagtgtagacacagagatccagggtgtctgctcccactgactcgttcctctctggggttaaatggggacctcagaggtgctgggcagtaggctaaaccctttacttgggatttctcacagaacagcccagtgtgggaagactggggtgaattttccctgcctggacatgaattaatacactgtgtggctgtgggcagatcactcaccctgcctggtctcagactccacacctgtgaactgggttcagaggtcagccctggccatcttccaggataaggtgactctgggtgtatgtgtgtgcacttgtgtttgtgtgtgtgactctgtgtgagcatgtgcatgtctgggtgtgtatctctggctggactgatgtgacttggtgtgagaacatgtgtaagtacatgtgtgcgtacacatgtctgagtctgtgagtgactgggtgtagtatgtagggggagggtgtatgtctgtgttcgactccgggtgtgtgagtttgtatactttttacgtgtgtctggctggctgtgtgtcactcagtgtgagagtgtgtgtgagtgcatgtgtgtacgcacgtttgggtgtgtgttttgcatatatgcccgtggcatcatgtctgggcatgtgtcgtatctgcaaacctgttcacattcctgtctggaatctgtgcacatctgtttcttgtattgtgttggccggggccttgcctggctgtggccatggggtgtgtactgttggcagctcttgcctgctgtcagcgcagctgtggggccacctctcttgttgtgtctgctgcctgtatctccatccctccctcctgacaactcagaaatgttcactcccttgaggccacccagggacagctgtggggtggggaggggtgaggtgctgcttctggggaggacgggggctcggccagctgggcccacagaggttcccggcagcaccaacctgcccacaggggctcccaggccatacccctaattgaagcaggctgcggaggcaggggacccaggggacaggacaagtggggccaggaggggtgaggggcagtccttgggccctctatatttagccccgttttcggtaagtgctaacgagaagctggcctaagtctgctaaaactggcggggggaaatgcagaggagaagtgaaagtccggggagggaggagtgggagggtggagaggaccaagagtcccaggcctggggcagtcgggcaagtgagtgtgagctcagggctgggcagccctggttgaggggtgtctgacctgaggaaggtgggattcaaggggcaacatggctccaaggggcctggtagggctatgcattgctttttctctttcagttcccctaaaatattacacattacctatgatgaggggtgggaatagccatacataaccaaccaatcttttgtgtgtgaatgaggctttgagaggggcttctgaaggtgccaggggatggagcacattagaatcaccaggagggggctgggtgcggtggctcatgcctgtaatcccagcactttggaatgctgaggtgggcggatcacttgaggtcaggagttcgagaccagcctgcccaacatggtgaaaccccgtctctaataaaaatacaaaaattagccgggcatggtgatgcatgcctgtaattgcagctactcgggaggctgaggcaggagaatcgcttgaacccaggaggcaaaggttgcagtgagctgagatcataccattgcactccagcctgggcgacagagtgagactctgtctaaaaaaaaaaaaagagaatcacctggaggggcttttaaatatctggatgcccaagtcacaccctgtaccactgaaatcagagtctagggtgggaacaggcatcaatatttttctagagttgagtgataggcgatgggcatctctgcctgggctcaggctgaggctgaggccgagccatttgatggaccctccaagtctatgattgctagtgccctggagtccctgttaaggcgtcatttggcttttagtccacggtggaaatggagctccctgttcattcctggtggaaatgatctgacccttctctcagattgagctctgacaggggaggtggaaagagaaaagacaaagggcagcagttggccattttgttgtgacccagccaagtgtggggcagggagtatgcagggatatgtaggagtggttgggataatttagggagaataagggtaacagaatggtgaaaaatttccctcaaaccactcttgtctttccagccacagtctctgcagaggaaatcataccttaaagatttaagttagggtttcttggggatgttgggtgacagtagagataggggtttgttttagacaggattgggccctggtcagttaggggattctttaatgcattcattcattccaaagacgtactcctaggcctgtgcagcaatgactccagcctgggctcctgaggagcccacagttggggtggaggtctctgcccaggatgatcaggatgtggtggagcacagtacagggtcagtgaagcccagaagagagagacactgaccatctggggaatcagagagtacttcacagaggaggtgacatttgagctggaccttaaagaggagcaagagtttgccagtagagaaggaaagggtcacccaagtgggagacgagcagaggcaaaggcctgggggagggagatcaggaccttggggccactgatccacatgtcttctgctggggagtgtttaggaacctgagatcagatctgcccttgaaaaattcctagtctgataggggagacatagtggggcccggctagctacagtcagcctctaagacagtgacaagggaaggtgctagggtatggggagctggagagagacctggctgggagctgggggcatcaaggtggtggtttcatagaaaacagagcttatggccgggcgtggtggctcacgcctgtaatcccagcattttgggaggctgaggtgggcagatcatgaggtcaggagattgagaccatcctggctaacacagtgaaaccccttctctactaaatatacaaaaattagccagtcgtagtggcgcgcacatgtaatcccagctatttgggagcctgaggcagggaattgcttcaacccaggagacctctggagcttgcagtgagccgagatcccaccactgcactccagcctggacaacacagcaagactccatctcaaaaaaaaagaaaagaaaacagagcttatgctgggttctgaaggatgagtccgggggtcgccaggtggacagattggggaacagtgttccagacagagggaacagcccatgccaaggcctcaggaaatgttttaaatggcaaagtgcaggcatggtggctcatggctgtaatcccagaactttgggaggccaaggcatgaggatcatttgagcccacgagtctgagaccagcctggacaacataaggagacccgtctctacaaaaaaaaaaaattttttttttaattagctggatgtggtggtgcacagctgtagtccctggatgtggtggtgcacacctgtagtcccagctactcaggaggctgggatgggaggatagcttgaccccaggaggtcgaggctgcagtgagccgtgattgtgccactgcattccagcctggccgacagagcaagactcttgtctcaaaatataaattaaataaaataaatagcagggagacagtaagacaagggtgagaagtagtaggaaacagagactgctaaagagagggacattcagcagttacaacccgttctgggcttgtgatgctggggacccagtgatgagtcagaccaggcctgtcgcattggtcttgtggggaaggaacctggacacagacagccacaactgggggctcagggatgggacagcaggagggcaggggctgtgagaggcttagtttgctagggcttccacatcaaagtaccacagactaggtggctgaaataagagaaattcattttcacaattacggaggctgtaagttaaagacgaggatgtcagcagggttggtctcttccaaggcctctctccttggcttgtggtccactggtcttctcctgggtcttcatatggtcttccctctgttcccatctgtgacctaattccctctttttcttctttttttttttttttgagatggagtcttgctctgtcactcaggctgtagtgcagtggcacgatctcggctgcctgcaacctctgcctcctgggttcaggtgattctcctacctcagcctcctgagtagctgggattacaggcacacactaccatgcccggctaatttttgtatttttagtaggggtaggatttcacattgttggttaggctggcctcaaactcctgaactggtgatctgcccacctcggcctcccaaagtgctgggattacaggcatgagccaccgcgcccgccccctcttcttataaggatgccagtcagattgtagtaaggtccaccctaatgaccttattttaccttaattacgtctttaaagaccctatctccaaatacaattacattttgaggtatcaggaattaggacttccgtgtatgaattttggtagatgcaacttagcccatagcagaggttaaggatgagtgtggactttctgggctggcagtggggtccgaggctgccctgttctgtggacgggagagggatgcccagctaggtgggagtgtagaacctgcacagcctgctgtcaagcagacccccaagcagggggagatgctcgacatgggtgaagagcactgtgcatgagctgcaagagaagagcagtacagggtggtgggccagcccctggaggccaggttgtttatttctccaggagatagggaggagccaggaaaggattgccctgaggcaatgtggagctccgctggagggacggaggccagaggaggctggggctgcagttttagggatgctaggaggggtgggatttaggaccgggttagagttagtggctgcctgaagtagggctaaggtctgggtgaactagagctaggatcaggcaggattcccgcctttactgctccaaagtcaggacacacttgctgcccagctcccttcttgtccttcttatatcttgtatcagtagccatttaatgccctgtccccagggccaggaaacaggacctgaactctggtagcgtcctgggcacccactccccacccccaccctcaacagtctacatctttttttttttttttgagacagagtcttgctctattatccaagctggagtgcagtggtacaatcacggctcactgtagcctcaatctcctgggctcgagcgaccttcccatctcagcctactgagtagctgggactgtaggtgcccaccaccatcatgtccggttaacttttttattttttggagagacggggatttcactatgttgcccaggctggtctcaaactcctagcctcaagtgatctacctgccttggtgcagtgtgcatcttaatgggactgtgtgctggcgttttgctttttagcttttaaatgttttcttgcttgttaaaacataacgtatatagagtaaagtgctcaaattttaagtgtatagcttgatgaatttttgcttatgtaaggaccctgtaaccaccaaacaagatcctttcttacctggtgcaggcttcctcatgccctttcccagtcagtacccccaaggtgctcactcatctgactgtgatcatctgctatcagcttgcccgtttttgaatttcctgtaattggaatcataaattatgtctgcctttgtgtttggcatctttcattcagcctcatgtctccaagcttcggccatgtgtatgaagcaggagtttgttctttttcattactgtggcatatttcattgtatggacataccacattttatttatccattcacctgttgacggccccttaggctgtttccagtttggggccattatgaaagactgcagaagaattctgcccatgtcctttgatgggcaggacacgtgtttcttttgggcagatgcccaggagtggacgtgctgcatcttagggagagggcatcttttcagcttttctgagtggtgcttgtatcaatttacactcccaccagcaatgcatgacctgtttttttaattaggaatttaaaactcaagcagcatttcacattgaataatactcaattgcaagatttctagacttttttttttttttacagttactgagttcttcctatttcttatcccttactttagctccattctttttttttttctttttttttttttttgagacagggtctcactctgtcacccaggctggagcgcagtggtgcagtcacagctcactgtagccttgacctcctggattcaagcgattctcctgcctcagcctccccaatagctgggactacaggtgcgtgccatcatgcccagctaatttttgtgtctttagtagagatggggtttctccatgttgcctaggctggtcttgaactcctgggttcaagagatctggctgcctcagtctcccaaagtgctgggattgcaggcgtgaaccactgtgcctggcttagctgtcttctttaagtatcttggtgcagagaacactagagttggacagctcctttagtaggagtggggtcatggtttaggcagggattttggagtgagttgtgggaagagtttggatcagggacaggatctcaggacagttgggagtcaaggtcagatgaaggacttgagccatctgggcacaacttgggattcaaggtgagtaagtggactaaggatgggtcaggctgaagcccagatttgtcctggggtctaggaccaggaagggttggattcagtttcaggatgagcttgggcgagggaactgttggagatgagatggctggaagtcaggactaggggacattagactagagtggatccgattagaagtaggagcccagcagtcatgaagaccaggggtccaatcagggcacatctgctgtcttgctgtgcttttggggaggtgacatcccttcgtggagcctcagtttcctcctctgtaaaacggggtaatattagcactaaccgctaatgtgagctgtgagtcatatctagctctatgcttggcactggtgagcactcgcctttctgtgaaaagtatcagagcgctttgaggacaggcatttgtctccgtgggtttatgtgcttgctgcctgccaccctcccttggccacctcctttcatttcctgggcctagggagctatagaatggggttgtattacaggggtggacttgagactgcagctggggctcaagcgtgaagtcccagatcaggtttagattggaggacaagctcaggggtagagccagatggagctgaggttacagaggatgaggttgggtctgctaggccggtgtgctaaacataggaagaaagtccaggtgggagtaagatgtggatggggaaagtggtggggtgggaagagggccagagggcggctgaatcacacatgctgagatctgacaactgcctcctttggggacgctgcagccccatcacatctctgaggccccactcagagtggaaaacatgtctcacccgaaacctggtagggcaggacgggagcctgggcggcccgccccaggaggaggcccaaggctgctctccctcctttgggacgtcaccagcctcctcctgggcagctgataccttctcacgaccaccttccatctcctgccctgccctttgctgcactgtgggtaacacccctgtgttactttctggagaggtgaaaggataaggcaagatcccccaaggcctaagtgctgtgtctcatcttgccagaggagggcagaggcccagaacggaggacatgtctcttgggaagagacacttccaaggtggctgggggtaaggggggaatttgggggaaaggcttggggagtgtggtggaatgggggcccgagagccctcctggattcccctccttcaccccacttccattcctcctctgtccccagaaataagaatgtctaagcccctggaggccgagaagcaaggtctggactccccatcagagcacacaggtgggtgggcagggagcaggggggcaggggtcaccgtgggcaggggaagtgggacagatgggaagagagctgggaggggacaggtgtggtgggggtggctgatgacaacacatcctttccctctctttgcagacaccgaaagaaatggaccagacactaatcatcaggttaggagggagtggataagcgggagggggtgggaaggaatggggagaggggttcagagggggctctgtgccgcctatggtaggagggcagggagcgggggtggtcagaagctgcttcactgcactattcccatccccttgctcctactttctctttgcagaacccccaaaataagacctccccattctccgtgtccccaactggccccagtacaaaggtaagcacctgtcagaacagccagggaagtgggcagcgcttggaagagggtcctcaggaggcctgcctcagtccaagggctgagagagcactgagccttggtaccttggtaacgaggttcctcccgccccttctcactcttgggctcccaccccaggcctgtgactcacgcaggctccttccccttccctagggggtgggggtggctagggaaatcccccccagagccccagggcgatgaacaacaggaagccaaaggcccgcccccatcccaacttccctgacccaacagaggcctgcaccaccgcctgtcccccaatatacacatttagcggccagctgaggtgggggtgggggggctggtaccagttgaggatagctgtaggaatgcaggagagaatgacagggaggccggaagcagccaggcagtgcaaattccacatccagatggggccctgtgcctggcattctgggcttcttggggttgcctgggctccagtctccaccctccagcctggtccaggggtagcaggcaggtccagaggcttgaaggtagcactggaggtgggggcagagaaggtgtgagcaggactccagaccctgaccagtggtggctgagggatggggtgggaggctgggaactgctccccaccctgctacagctttgctctgtgaccatgggaaagtcacttcccctctctgggcctctcagtttcctcttcagtatcattggtcaggggggagggggcagtcggatgggatggcctctgtggttgcctccatgtctggtgtacccccatgctaccatgagaggagaggataaaagtgctttgtgagcagatgtcctgcttctgtgctgagcgctttgaacggggtctaggggagacaggctctcgatcttgacctccttgaccctctgatggcaggtttggctattgccttagccctcagagcacagcgtgtatccattgcccccaccctgtcctcagttgaatcagatctttgcagtctgttctcaaactggcagcaggcttccttcttttggggatgccagtgggaccaagggaatgaaggtttctccctccccttcctggcctcgggctctgtccacaactcgccctgtacgccctgtttctctgggctttgcctctcaacttctctccatctcttctgtgtcagtctttccctaactgaagtgattcatgtgcttctgtcacagtctcaggcataagaccactgtgcgcaactatttacataataattttgttaattggctcaattttttaaaaaagcaccttattatggaaaatgtgaagtggatacagaaatagagagaaggttataatgaaaataaagcccctagatacccatcaatcagcttcaacaattaccaactcatgaactggcttgcttttcgacagctttttaaataaatgttttttaaatggaaatttcacaaatggaaaaccagaatcacttgccatggaaataaatatgatgattattaaaatttacccagagtctcttgtgtgccgaagggtctaaacctcagaggcctgttaaaaaagaggcttattaaaaagaggcttattaaaaaaggagattagggctgggcgcggtggctcatgcctgtattcccaacagtttgggagacaaagcgggcagatcacctgaggtcaggagcttgagaccagcctggccaacacggtgaaacttcgactctactaaaaatacaaaaattagccgggcatggtggtgagtgcctgtaatcccagctacttgggaggctgaggcattgtggagaattgcttgtgcccaggaggtagaggttgcagtgagccgagattgcaccactgcactccagcctgggcaacagagaaagactccagctcaaaaaaaaaaaaaaaaggagattaggccagatgcagtggctcaagcctgtagttctaacactttgggaggccaaggtgggtagatcgcttgagcccgggagttcaagaccagcctgggcaacatagtgagaccctgtctctacagaaaatacaaaaattagctgggtgtgcatgcctgtagtctcagctacttgagacagaggcaggaggatcgcttgagtctgggaagttgaggctgcagtgagtcctgatggtgccactgcactccagcttgggtgacagagcaagaccctgtctcaaaaaaaaaattaaaataaaagtggagattagctagtattggagagatggtaaagacattcaagcaccaatcagagactttaagataaccagaaacaatgaaaaaagcactgaaaagggaatagtgtgctcaccatggcattcaacattatttttttaaaactttttttttttgagacggagtctcgcactgtcacccgggctggagtgcaatggcatgatctcggctcattgcaacctccacctcctgggttcaagcgatttttgaggcggagtctcgctctgtcgcccaggctggagtgcgatggcaccatcttggctcactgcacctccacctcccggcttcaggtgattctcttgccttagcctcccaattagctgggattacaggtgtgtgccaccatgcctggctaatttttgtatttttagtagagatggggtttcaccatgttggccaggctggtctcgaactccagacctcaagtgatcctcccaccttggctcccaaagtgctgggattaaggggcgagccaccgcgctcagcctatttttaaaaaaactttgtattaaaatatgatacacattaaaaacacacatagatcttcaatgtatgactctgtgaactttcagaaacttagcacacccatgtcactagcaccagatcaagaagcagagcacgaccagccttccagaggcccttaatgcccctgccagggatagctgctaccctgacttctcatactcagtgtcatttcatgctgcatctctgcagcacttttttttttttaacctctctctctctcttttttttttaagagacggtgtcttgctctgttgcccaggctagtctcaaactcctggcctcaagcaatcctcctgcctcagcctcccaaaatgctgcgattacaggcatgaaccaccacacttggcctctgtagctcttaaactttctaatacttatattccataatttgggacatgccattcactgtctattatttggcctttccttggcctctgtttgtctctgtccacattccaaatatcacccccctgccaacacactgtgtcattttgcccaagttgctttctgtctctggacttccttttacaaaatggtgttgggctatcaggctgaaggataaactcactgtccactttaggcctgagggtgtgtgatccatcaggccatgccttctcccaccactgtgtgtgcttcagccaacaggcctttcagccaacaactgctgttgtctggctttttacctaggaatggaggaggccagggtggctctatgctggtctgttctgtgtgtatggtgcaaggtgtgtccatatcatattcagaaagacatggagaggcttggcagacctcaggagcggaggctgaagcctggtatttcctgggccacatctggcttgtccacagtgcaggacaaatgctgtgctttgcttattatgccagtatttttgttctagattttgaaaagagtggccagcaggagctgagtaggagccagataagatttccacttaggcaggcgctctctccagcccacctccatccacccctactcctgtcattcatttgtgcccatttctgtaagcatctgactttgtagcccaggttccaaggtggtggtttttcttagtacctgaaaaccttttcttccaacaaagtcttacttcattggacaaataagggatgtacctggctaggtgcagtggcttatgcctctaattccagcattttgggaggccaaggcaggaggatcgcttgagcctaggagttcaagaccagcctgggcaacatagtgataccctgtctctacagaaaaatttaaaaattagccaggtgtgtggtgggcacctgtagtctcagctgcttggaaagctgaggtgggaggattgcttgagcctgggaggtagaagctgcagtaagctgtgatcatgccactgcacttcagcttgggcaacagagtgagaccttgtctcaaaaacaaaaagaaaaaaaaagcaagagagatgtacctctgtgtgatacagatgaagggtgtgggacccagaagccacttatttgacctcccaggtgcccagtgggagtattttcctttttttttttcagaaatggggtttcaccatgttggccaggctggtttcaaactcctgaccccaagtgatccgcctgcctcgacctcccaaagtgctagggttacaggtatgagccaccgtgcccagccactcttttccattttacagacaggaaaactgactctcaggaggggaaaagtgctctgcaaaggcgacttctgtagggagtttgggtgcaggtgttgtgttagccctatctgattgatgaggaaactgaggccagaggagtggtttgaagctcccagcggtcagtgcaggaccacagactgcaccctcatgtccacaccccagtctgctcctcctgtgccagcctgattgccattgccacacacgtgccctctctttggttcacaggtgggcattctctctggcctccacttaacattctggggtcccggaccctgcctctctcccccccagatcaaggctgaagaccccagtggcgattcagccccagcagcacccctgccccctcagccggcccagcctcatctgccccaggcccaactcatgttgacgggcagccagctagctggggtaagtacttggggaaggatggggacgaggggacaaaccagccacccctcatctgttacagggctagtggatgaactgttccaccaaggccatggccactctctcacacctgcctcttgccctcttctgtcctctaggaggtcttgtccccttacttgcttggcttaggcactaacccctctctgccttctctgctcctcttcaaccccttgctccaattcctgctgtccccgacaccccgcagctcacggcactgatgccagctcagcagcagctcctcctgcagcaagcccaggcccagctcctggccgccgccgtgcagcagtccagtgccgccgctgccgctaacgccgctgccgccgccgccgccgcctccgcctcctcctctacttcctcctcctcctcctcctctgcctcctcctcgacctcacagcccccagcctcctctggggggggtgacctgccaccaccacagcctgccagccagccccctgggaccccacagctcaccttgtcccaacccatccagctcacagcacaggtaagggcagccactggggaccaggctccctgcagtgaaggacatgcagaaacagtgagtgtgtgggaaggggctgactggtccacatggactgttctgaccaccagccacatgccaggcagttcctagcaaccctaggaagctttggaagatgttgctgtcccatcttacagaggggtaaagtgaggctcacagggaggaatatcccacatcataatcctccctctggtggtgtgttgggggcagtgcttcctgtgcatctcgctgggagttcacagcctcctgggaggttgagattgttgtcctcaacatacaggtaaggaaaccaggagtcactctcgtgaatggtaccatgtgggtacaaaacaaaaggttaagaataagaatgagtgccctaccctcatcgtgtcccctggcttatccaacaagatgctctttcaaaaaaggggcccgtgatctatgaattaggaggttctccatcacctccctgactctggagcttttgctggtccatagttaatcatgaattagtggctgtctcagtttcctagggctgccgtaacataataccataaactgggtggcttaaggcaacagaaacatattgtctccaaccacaagtccaaactcaaggtatcggcagggccgtgctctctctgaagcctcccagggagaatctgtcattgcctcttctggcttccgatggtgctgtcaatccttggtgttccatagcttagtagatggctcactccaatctctgcctcctctgtcgtcacatggccatcttctctctgtgcacctgtctctgtattcaaatttttctttcttgtagggacactagtcattagtttagggcccaccccattgacctcattttaacttgattacatctgcaaccctatttccaaataaggtcacatttacaggtaccaggagtgagggcttccacatatctttttggggacacaatttaacccctaacagtggccaacagagttcccataaggacagccgggggagcagagtgggagctgagtaggcttcctcttccgaagggcagctgtctccagcccactcctgtccaccccttcccatgtcacccattcatgttgtctgtctggttttcacccattcatgttgtctgtctggttttcataagccttagagctgtggccaagtttcagggcagtgaaggtcgtgggaagccctacagcaaagccacctgtttaacttcccttagcctggcgtttccctcagtgactgctccacaaaaggcttttctctcactccgtccaaccacttccacagaaccctagatatagatgctgtccatgcagggagctgtccagccctggtaaggctgttcccttgttacagttcaccccaataatggcccgttccattattggccaatgctcccatttgggactttccttaacactgagctgataacctgcctccttagaacttccttccactgggcctggttctgtggagacactctgtaaactgggcgcatggctccgtgatggctcttgtagatgtagccttttttttttgagatgaggtcttgctttgctgcccaggctggagtgcagtggcggattatggctcactgcagcctcgacctctttgggctcaagtaatcctcccacctcagcctcctgagtagttgggactacaagtgcatgccaccacacccagctaatttttttatatatacatattttttgtagagacaggtttttgccatgttgcccaggctggtcttgaactcctgagctcaagcgatctgcccaccttggcttctcaaagtgcgggattataggcatgagccacggtgctcagcccagatgtagcctttcaatacctggctcttgaagtaacagtaactagtctgttgggtgccacctttcttccaggcaccatgccagtgatggcctctttgctcccatgaatcctccccacagctgaggctccaaggggtaaagtgacctgccccagattattctgtaagcatgagtgttagagccggcctggaagtccagggctctaaccacatgatccgcggctgctgcttttagctgtccttcacggaacatggtttctagcccctcccaccccggccaccagagactccagcagcaggtgttccatttgccttgtagcatagacagccctttactgagcaacgccaagggcttggggctcttcactggggctgagctcttttgcatctcagtggccctgctcttgttctctcttttcccgggaagtctgctcccttcctttacctggacagttcctcttcatctgagccccagcccaggagtccacacctctaggaagtcatgatgacttccctccccccagccgtgcctgaatctgctcgaggaaatatcagttgaaggaacaaagactagaggatagaaggcagaacagggcagcctagcgcagacccagccaggccaccatctctgtgagcagcagacattcttgcctatgcactcctagagccacctcccccagctccccagggacccagcagcagcaagctgagcctccaccacctgccgtatagcccaggccctgattgtcaagggctccttaaacccctcctcctttcctctcactcctccttccccagcttccctcagctctgatctttccctttctgtcttcaacaagtgcaaagctgggccaagtttgttttctgggaattctctctcacaaactgagttgccctttgacgtcatttctacaacagcacctcctatgggcactgtgctgggcccaggctgcagagggaccagctcttcctgacttacctacccactgctccagccttccccggctcctaggctcggatgtctctcccgggccgcatctcatgacctccaccccccagtccacttctcatgcctgctaagctctgatcctgcagtcattccacaaacatttcctggcctcctgtgtgtcaggccatggcaggaagctgaagacttaggagtgagtcacagccatccttgcccctgaggggctccccgtcctgcagtggagcaagcacatcagtgagccactaagaaatgtttcacttgaaagatactaagaagcccaggaaagagagtaaaaaacactcataaatgctatccctttgaaattatataaagtaccaaggaaaagccccccttccagccctctgatgtcagcttccaaagtaaatgctggttaaacagtttggcaggatccttccctgcaatctcctagcttgtacagacgaaggggcaattataatacagttctataatttgtctgtccattgctcagtgtgctgccttctgccgagggggctgtgtggatatttaccgaatcaatgagggatgttttgcggcagattttcaatcaaggataggagagatatctctccagggaagtatttcagaatgtctggggtaggggcaggcattgattgaaaacttacgttaacagttaaaacatcattttatattggagagtaggggggaaaatttcctattttcctaataggaccatggcaaataaagcttgacaaaatcttttaggctgctacgacctagcgagtgaaagtttcccaaagaaaccaactgagtgtgatgggaatgtgggaagagaaatgtgatgtgtgtctgagggaatcaggacccacatctgtccaggctttcaggaggaggtgggatctgaactcaggggaatgggaaggagtttgctgggaaggggcttccaggctgtgggaatggcaagtgcaaagtgagaaaacagggcaggctgtagccgcacaaatagggatggatgagctgggagggaggagccaaagcccaagtccaggtggctgaagaagactcaggaatatttggctcagatcactgaaaaggcctggtctggaatatcaggcccagctccaggggtctgtctccctgtttcattgtagggcaggtaaaatgggtgtcagcatttccagacttgtagctatcctgcccagggagataaaatacgtcccctgggccgggcagggtggctcaggcctgtaattccagcactctgggaggccgaggtgggcggatcgcttgaggtcaggagttcaagaccagtctggccaacatggtaaaaccccgtctctactaaaagtacaaaaattagccggccgtggtggcatgcgcctgtaatcctagctactcgggtggctgaggcaagagaattgcttgaacccaggaggtggaggctgcagtgagccaagatcgtgccactgcactccagcctgggcaacagagtgagactctgtctcaataaaataaacaaacaaaaacacgtcccctggctagatttgagcccttgccctcgaccccagagaaggcaaggtcagccctacctggacctcgtgacttgaggatgggaaagtgtaacccctgaaagagatgggttctgttgcttgaataagttgaagaaggggcagtgggtaccaggccaatcaaaactgcccacctggaggtgtgtggtcagttcatccacagggccttggagtccaggagcctggcccaggcatgccagttgctcccactggttcctgggttgggatctgctgttgcctgtctgtcctggaattttagcataaggtagcatgtgatgtaatatgcagtccatatgtaggtatttttttctccctgttgaatcattctccatttgtggtattctgccctgatcgccacaacttcctgggttccatgtcacagggccaaccactgggggtccagagaagaacccacactggagaacggccactcctctgcccctactcccatctttagagcttgccctagtggagtgactgtactaatcgactgcaggggataggagaatggactgcaggggataagagtagaaaagagagcccagtaggaagtccttgaaggcatacagatgggacatgagggtggcttgagccaggagggtgaggatggggatcctggttgctattttgtattgattggataggtcaaggatgactcctaggattttggcttcagcagctgggtggtaatgacgtggtttcctgagttggggaagatgggaggaatgggatgttttggaaggctggggtagagagccagcagtttcattttggacatgttagggtttgatgagtctattaatcatccacatgggaacatcaactaagcagatgcatatttgaggctgaagctcagcagagtatctgggcaggagctggaagttgttagttgtcaggaagagaatgaatttggccaggcacagtggcttatgcctataatcccaacactttaggaggccaaagcaggaggacggcttgaggcgagttcgagactagcctgggcaacatagagagaccctgtatcttaaaaaaaaaaaattaaccaggtgtggtgatgcatgcccatagcccccaagctacttgagaggctgaggcaggaggatcgcttgagcatgggaggtcaagatggcagtgagctatgattgcaccatgacactccagcccagaagatagagtaagaccctgtctccaaagaaagagagaaagaaagaaaaggaaagaaggatagatggacagatggaaggaaggaaggactcagccagattgggttcccaccctcaagagctcacattcaagtgtggtgacatgaggtgggcaatggtagcaaatgctcattttgagggatatgttgtaatttccaaaatgctttctagataatattactcaggcctcagaacaacccagtgaaaaagtagacattattatccccattttacagataagaaaactgaggccctgggagagaaatgactcagtcataatgactgccatttatgaaggaccaattaagtgaagaggaatcaggctaaacattctacacatattgtctcatttaattcctttaacagctccatgaagtaagacttattgtggtgtcacctgaggaaactgaggcttaaagagggtaaggaacggcctgaggtgtgtgaggggcagtcaggattctgggctccaaggcccaggtctctccataacaacttgcatcgtgatcctgtacagttaaggaggctggggcccagagggaaagtggcttcccccaggcacacagcaagaagcaggtgagagggctaaggctcaaacccccgagtttccaagctggaagggacccttgcaccccactagtctaaccttcccctaggttaggcgtttccttgttggtgttgttgccaggtggggattttcacccaggtggcttccatggcaggcacccactcccttcccaggcagtgcgtcccaccaccagacagactgagattactcagagtgtcagaaagcctgacctcattttaattttaagttttattttatttatgtagttattcatttttttagagacgaggtcttgctctatcaccatcataactcactgcagtgaggtgcagtggcgccatcataactcactgcaacctcaacctcctggctgaagcaatcctcccacctcagcctcccaagtagctgagactacaggcatgtaccatcatatctggataagtaaaaaaaaaaaaaaaaattgtggagatggggtttcactatgttgcccaactggtcttgaacttctggcctcaagtgatcctcccacctcagcctcccaaagtgcagggattataagcgtgagtcactgcatccagctgagttttattttatttttaagtagcaaataatcattgtatatatttatggagtaaaatatgatgttttgatacaggtatacattgtggaatgatcaaatcaggctaattagcatacttatcacctcaaatatttatcatttcttcgtggtgaaaacatttaaagtactcttcttgccagacacagtggcgcagtgtaatcccagctacttgggagtctgaagcgggaggatggcctgagcccaggagttcaaggctgcagtgagctataatcacgcactgcactccagcttgggtaacagagcaagaccctgtctcttaaaaaacaaaaactaaaactaaaactctgtctttgatattttgaaatatgcagtacattattagcagtagtcaccgtgcaatagaacaccagaatgtattcctgttatctcactgaaactgtgtccgttgtccgccttccctttccccatccatcctcccttcctcattttgaacacaatctatcacgatatagtttacatagttcccagaccccactccttcctgttctcccctactctggacttaacttgtcttagagagggaagatccagagctggtcacaatttgccatatcagggatggcaaaggaatgtcaactcatgcgccaacaccattccagtcatggtggctgccagagattgtgtggaggcctctaatgggggcgcgagaggccatgggggatgggccgtctggcctgtgcactggagtgaggtgcagcacctgggccgttgcagccggccggctctggggctcctcctcagtgaactcctcaagttcactgtcatggctttctcttctcccccaggtggaactgagccctggtaggaaagtgggcaattcacccatgtatcctgcaatccacatatcaacctttctgcccccagtcatagccaaagtcccagctatggcaaagtactgccagtctgtcctgaggtttcacctcattcattcattgaaaatgtattgatcacctatgaggctcctgcactgggagggtgatcaaaatacagcaatgagcaagaatcggtaccgtcccttctcagctttcacaggcatgctagctcttgtgctaggtttccttaaagcttagggacagagcagctgatctacaaaatatgccagccagggtcttttctctggcctgtctccacttactataccttctccaccctctgactggtgtgctctgactcggacgtaacacgccctcaagtggcttcagagggccatgctgccgctggattgtggagaaatggcgcctcctaccggcttaccctagtcctgagccaacttactgttcctgttcacccagaatcttgtcttctctcctttctttctttttttttctttgttttattttgagacagggtctctctgtgtcacccaagctggagtgcagtggcgtgaccatggctcactgcagccttgacctcccagggtcaggccatcctcccacctcagtctcccgagtagctgggactacaggcacgtgccaccatgcctggattttttgtagagaccccgtcatgttgcccaggctggtctggaactcctgggctcaagcaatccacctgtctcagcctcccaaagtgctggaactataggtgcgagccaccatgccccatcatctttctccccttctttcattcctttagttggcaaatatttagtgaatatcaccatgcccaagtgcctttctgggtgaggatatagcggggaatgaggtagataagtctgtgccctcttggagctgacacccgctgtagttggggagataggcaggaagcagataattgctatgaaggaaagaaaagagtgtaatagagagtgttggaggaaaaagaagacttcataagagtgtgtggccagagaaggcctctctagggagggggcgtttgatggagacttaaatgatgaggagggaccacctctgtgtagatctagaaagggtatagcaaaggtatgaggtggggacttctttgtggttcagtaacaggaaggagatcagtggggctggatcagagttagggagttagagttgtgtgaggcaaggaaggagaggtaagcgggggtggtgggcaggccatgcaggaccatagcctggatctggattataccacaaatgtgatgaaaatcagtagaggccttatggcttaatttatattttaaaacagggacttggactccatagaccacccctagaagagtctgtgcatagaattcagagtccatgaacttggatgggaaaaaaattacatctcaatttttactatcttctgaccaaaccatagcatgtccctctatcatgaatatagacaacagacaacagtagtattagcggtactgagactttgtcaccaagagaatgtacgcagattttcaaattctcttatagttgttgcagatctctcaaaacactgttttcactcatgattgctttgaaattacagtagtcatcagatctattgctggatcttgttacttagtgtgctaataaagaaacccataaatgattttatgaccactcaaaatatgtttgatgcctatatttttttaaattttaattaattaattttttttgagacggagtctcactctgttgctcgagctggagtgcagtggtgtgatctcagctcactgcaacctctgcctcctgggttcaagtgattctccttcctcagcctcccatgtagctgcaactacaggcgcccgccaccacacctggctaattttttttctgtatttttttggtagagatggggttccaccatgttggccaggctggtctcaaactcctgaactcaagtgattcgcccgccttggccttccaaaatgctgggattacaggcatgagccaccgcacccagccaaattttaattaatttattttattttattttgttttttggagacgggtgtctccctttgttgcctaggctgcagtgccatggtgtgatcatagcttactgccacctcaaactcctgggttcaagggatcctcccacctcagcatcctgagtagctgggaccacaggcatgcaccaccatgcctggctaattttccttctcctccttctccttctccttctcctcctgctcctcctcctcctccttctcctcctcctcctcttcctcctcctcctcctcttcctccttctcctcttcctccttcttgtttttttctttttgtagagacagggtcttgccatcttgcccaggctggtctcaaactcctgggctcaaaagattctcacatctagcctcccaaagtgctgggattataggcatgagccactgtgcccagccagtttttattttagattcagggatacatgtgtaggtatgttacaagggttatattgcatggatgctgaggtttggggtataattgttcctgtcacccagtagtgaacacagtacccagtaggaagtttttcagcctttgcccttctccctccctttggagtccctagtgatgatgactataattatgtgattgatttcatttgaaattctatatatctggctggacatggtggctcacacctgtgaccccagcactttgagaggacgaggtgggtggatcatctgaggtcgggagtttgagaccagcctagccaacatggtgaaaccccttctctactaaaaatacaaaaattagctgggcatgggcatggtgggtgcacctgtagcctcagctacttggaagtctgaggcaggataattgcttgaacccgggaggcagaggttgcagtgagccaagcaagactgagccactgtactccagccagggtgacagagggagactccatctcatctcaaaaaagaaagaaagagagagagagaagggaaagaaagaaaagaaagaaaaagaaagaaagaagaaagaaagaaagaaagaaagaaagaaagaaagaaagaaagaaagaaagaaagaaagaaaaaagaaagatcctatatatcatatgttatgtgtttttaattctgagaagagggcaataggtttttttttttttcagatgctgaagaattcagggcacaaaaacatttagacctctattgttttagacccctctctgcctgcctgggggcgaatggatggtctggggtagaaggatggtggtttggaccaggacagtcactgtggacaggaagagatgtagagggaactgggaagacttgcattgcagatggattggatggatggggagaggaagggaaggtgggattaaggctgacccctaagtctctggtctgagaaactagacagggatgtgattaaatgtttcccatctgaacttctcaccatgagaccttctgcaaactgggatgcactttccccattctttcctctcgctggtgattcagaacgaaacccacagacacctctctaggcttctggaggaaaggggaattttcattgagagtcatgctagggaggaacaggagttaacaaatactttaatcaacaagctaagggttataggaaatcagaaaaatgctggtaataagacttgatttctagtcttattcattagattcaattcagtgggcatttaatgggggcttaccaggttccgatatgagttagggatatacgaagaataagatatgcctctggtctgctagagtcagtctggcagaggaaaagtacacataagcaaatgcattgacttgggagacgtgtagcacagggcaggtgggtctcgttttgtggggccaaaagattatgcaacttggagtccctttgaaagaaaaagacaatgtttgaaacaaaaattaggtatggggccttgaaagggttcactgtaaatggggggccctgaagcataagtgttgcccgcttcacagttgatccacatctggagggaggtgaccatggaggtgttactgggctgggggtagctgggaaagggaaggcagggtggacattgtttcacaggatagagtgctaggacttcagaacccttaagctggattctgagatgattagcagcaagagttagagaggtcaggagcacaggagtacccagtccactgccatacacggaataagcagaggcacccccagggggtcagggaatagtgttcagctgtcgaaaagcagggatgttgatcagcagtgactgtttgggtgggtgggggtgagacactgggatatttatttactcagaccaggtacatgtttcaaatcccagaggtatgaatggatttacagcgtggccttctggtatggttttccagacatcaactatgcatacccaagcaaatatccagatatactctttttttgtgtgtgacacaaacagtaccacctcataccctctgttctgcctcttgagctttccactcaacaggacatcctgcagattgttccatgtcaggacacaaagagactcctcattcttgctggtgactgcatagtattccactgtagagctctgccctcattcatccaacccatcctgtcttgctgcatgctcagctaccttctactcttttgccagaatgccacttgctgctgggaatagccttctagagaggtcattttgcacctctctagaaggccattcccagccttctagagtgagaatagataaatttttagcagtagaatggctgagttgaaggctgtgtgcagttgtaattttgatagacattgccaaatcaccctctcaccagcatgtacaagaatgtgtgtttccccacactccccaatgtggtattacacactatttttatatttggtgatctgagaggtaaaaatgatatctcagtgcaattgcagtcgtgtttatcttattgcgagtgaatctgagtgtatttccatccagagctgttcacattaatttcactgggcactctccagacctgtctgtcagccacattactactgggttgtcagttttttacttatggatttgtaatcactacttttttcttcttctttaattatatagagttatttgcaaaatctctctttgtatattaaagaaatgagccccttctggcctgggcagggtggctcatgcctgtaatcccagctctttgggaggccgaggcaggcggatcacgaggtcaggagatcgagaccatcctggctaacacggtgaaacctcgtctctaataaaaatacaaaaaaattagccaggcgtggtggcgggcgcctgtagtcccagctacttgggaggctgaggcaggagaatggcgtgaacctgggaggcggagcttgcagtgagccgagatggtgccactgcactccagcctgggcaacagagtgagactccatctcaaaaaaaaaaaaaaaaaaaaaaagaaacgagccccttctgttgaattgcttatatattttcccagtttgttcacttcctggcacatcaaattggtctttaggaataatagcattgggaagaattgaggggcatgtgccaacccccacaatttcccagaaggaaaaaattgtaagtaacatgttatagctttcaactttacataaaatttgccaagtaaatgatgaagcatcagtcttggttcattaacatatctatgtggaacacctactgggtgccaggtgctgttctaggcactgaggatacagcagtgactgaaacagtcaagatcatgctctcatggagctgacgttccagtgagaggggcatgtcatgaatgagtaaacaggaggagcgatgcctggagatggtgttaagccttgtgagggagatgaaatggggtgataaggggaggccaggccaggggctggtatagactgggtggtcaaagagggcatctctgagagggtgactttgtgttaggatccaggcattagtgtcagaagtagaactgcccaggagagggaacggcatgtataaaggccctgaggcaggaacaagcttggtgcatttgaaaaaaaaaaacagaaaagggctaaatggctggagcacagccaaggagggatagggcagtgggagatgagcagggagatgaacacaggcctcagtataaagggacttgtaggcaggtgaggggttttgtttgcattgttgagggctatgagaagccattggattgtgtgtgtaaagcggttttgctttttctttcagaaatgtttaaacgtaaaagtagagagaattatgtcatgaaccccacatactcttcaccaagctcaatagatatcaacattttgcccttcctattggcaaataggatttcatctaaacccctcactttttttggtgggtggaggattggattttttttcccctccctctttccctacctcatccccccttttttccctttattttactttattttttactcaccactatacaaacaagatttttttttttttgagatgggggtctcactatgttgcccaggctggtcttgaactcctggcctcaagcagtcctcctgcctcaaccacccaaggtgctgggattacaggcacataccactgtgcctggccctgtcttaaaaaatacttttattaaaatataatgcatatataaaggtgcacaaatcataggtatacagctgtgagcacacccatggaactggtacccagatctagaaataatgtggccagctcccagaagccccctggtgtcccttttcagtctttactccccaaacttcaaccattagaatcgtacaggatgttctctgtcatgactagctctctcactgattatgtttgggaagtctacgttgtggcatgtaaccatgacttgtggactgctcattctcattgctgtagcttccactgaaacagtttctttacccattctactgttgtgcgcgcttgggctatcttcaagtcctgcctatttcaaatggtccacgtgaacattgtagtacatgtcttgtggtaaacacatacacatgtatggtgggttacatgcaggagtggagttgctgggtcctaagggtggtgtatgttcagctttcttttttttttttttttgagatggagtctcatactgttgcccgagctggagtgcagtggcgcaatctgaactcactgcaacctccgcctcccggcttcaagcgattctcctgcctcagcctcccaagcagctgggattacaggcacccaccaccatgcccagctaattttttgtgtttttagtagagacggggttccactatgttggccaggctggtctcaaactcctgacctcgtgatcctcccgcctcagcctcccaaagtgctgggattacaggcatgagccaccaagcccagccagttttcttagatagcgcctatattagtttgctagggctgccaaaacaaagaaccacaaactgggtgacttgaggtaaatatattgcctcacagttctgaggctggaagtcagaaatcaagctgtcagcagggttgtgagggaaggatctgtcccttctgagggctgtgatggagagatctgttccaggcctctctccttggcttgcacgtggctgtcttttccctgtgtctcttcacatcatcttcccgttatccatgtctatgtccaaatttgccctttttataaggacacaagtcatataggattagagcccaccctaatgacctcattttaacttgatcatctgccaaagaccctatctccaaatagggttaatctctgaggttctgggggttaggattccaacttacctttttggggggtggcagggagtggggggagacactgcaacctataacagtgctaaagagcttcccggagtggttgtactaatttacactatttgctggagtattttaaagctaattccagacatgaaatcatttgccttgggagtgttttttgtttgtttgttttgttgtgttttttgagacagagtcttgctctgtcacccaggctgcagtgcagagacacagtggcatgatctcagctcattgcaatctccgcctccgggttcaagcgattctcctgcctcagcctcctgagtagctgggactacaagtgtgtgccaccatgcctggctaattgtttgtatttttagtagagacagggtttcactgtgttagccaggatggtctcgatctcctgacctcgtgatccgcctggctcggcctcccaaattgctgggattacaggtgtgagccaccgtgcccagccaggagtgtttttaaaggaggaaagacctggtctggtttacaattttattatttatttatttatttttgagacagagtcttgctctgtcacccaggttggagtgaaggggcgtgatctcggctcactgcaacctatgcctcctaggttcaagcaattctcctgcatcagcctccggagtagctgggactacaggcgtgtaccaccacacctggctaattttgtatttttagtagagacgagattttgccatgttggccaggctggtgttaaacgcctggcctcaggtgtgtccgcctgcctcagcctcccaaattgctgggattacaggcatgagtcaccacacccggcctggcttacatttttaaatgattctatttgttctgcggaaatgttaaaacaaggaaaatatttcatcaagaaagaaagggtagccgggttcggtgactcacgcctgtaatcccagcactttgggaggccaaggcggacagatcacaaggtcaggagattgagaccatcctggctatcatggtgaaactgtctctactaaaaatacaaaaaattagctgggagtggtggcgggcacctgtagtcccagctacttgggaggctgaggtaggagaatggcgtgaacccaggaggcggagatttcagtgagccgagatcacaccactgcactccagcctgggcgacagagcgagactcaaaaaaaaaaaaaaaaaaaaaaaaaaaaaagaaagaaagggtaaataaagagtgagccctcccaggactgcccagttgggactctctggtaccccatggtagagagaagcctctgggtgcccttagctcagggatgccattcagagaccgagtggacgatccctcactgcccagtgccagatcgccatgtggagcagcttcctggtttcagcccctcaaggttcaggtgatgcagagaggatgaaacccagccaggactcaggctatctttctgtccaccccactccctgccaggacatacagcagctcctccagctccagcagctggtgcttgtgccaggccaccacctccagccacctgctcagttcctgctaccgcaggcccagcagagccagccaggtaaggcccccaccccagatggcctccctgacgcctccacagaacttcctcaccttcccctccccctcaccctgtgtatttccccttgtctttccaggcctgctaccgacaccaaatctattccagctacctcagcaaacccagggagctcttctgacctcccagccccgggccgggcttcccacacaggtgagactgtccattgagtgcaccaggccaggccagcagcaaggcctgctgaaagctgggtaaacgggggtgggggatgagtgagagtctcctttccatttgacccagccacactctgccagtgatttgctgtgagacctcaggcaagcccatctccctgtctgggtcagcctcttcctctatagaatgaggggagctggcccagacaagtggttcttaaccctttctagtacatgagctcctttgagaatatgatgaaagatttagatctgatccccattcccccaaaatgctcatgtgtaaaaacacacaaaattgcaaggggctgcaagcctttaggctgcaaatgcctcgggcctcttccagcactgcaacggaggattctctgaacaaggcattcgttaggtgattatttcacatccacttcccagactggagactgaaaacaaggcccacaggtgtcttttatttggtcattgtcaactaaattcccagaaagcaccacatttccagctcctcttgataaaccagaaaatctggcagggctgtacctgtgtctacgtggtggcttggcgcagtgagcagttggcctggccactggcaggagcagaggccccttagagagggtgccagctctccaggccaccttggcacctggaccccgaggcctttctttcagtttgctgcctgagttctagactttaatgataattttcactaccttttatgaatttcaaagtttttttctacccattttttatagccctttaaaaaaatatatgtgaactatttcagaaggactgactgaagagttagagactaatacaggtcttaactgcagttctgaaatcccaaatgctcagaaagtcaagttgttcttccaccattggcatgagaactcatttgactgcaaaacctgccctgccatgatataagccagtgtatgacttttctttgtccctcttggtatggcatttttgctgctgcaaaactgttactgtatctgattaaggagtaatattcttgaccctagtgggggtgggggccgggccacattatctatgatatacatcctatgtaggctttctttctttttgtttttttttttttttttgagatggagtctcgctctgttgcccaggctggagtgcattggctcaatatcagttcactgcaccctctgcctcccaggttcaagcgattctcctacctcagcctcccaagtagctgggattacaagcatgcgccaccacacccagctaatttttgtatttttaatagagatggggtttcaccatgttggccaggctggtctcgaactcctgacttcaggtgatccacctgcctcggcctcctaaagtgctcggattacaggcatgagccactgtgcctggctgcctatgtaggttttctgaaaactgaaacaggcacggtggtgcatgcctatagtctcagctacttgtgagcctgaggcaagaggatcacttgagcccaggagtttgaggccagcctgggcaacatagcaagactggtctctaaaacaacaacaacaacaaaacctgagaggggtgagagtgggtggatgatgagaaattacttaatgggtacaatgtacactgtttgggtgatggatacactaaaagcctacgcttcatcactacacaatacatttgtgtaacaaaattgcacttgtatcttttaacattttgttttttgtttgagacagggtcttactctgtcacccaggctggagtgcagtggtgtgatcacagcttactgcagcctcagcctcctgggctcaagtgaagcagtccccagccctcctgagttgctggtactacagtcacgccccacatgcttggttaatttttaaaatttttgtagagatagggtttcgccatgttgcccaggctagtctcaaattcctgtgctcaagcgatcctcccactttggcttcctaaagtattgggattacaggtgtgagccattgcactcggctgtccttaaatttataccaaaaaaaaaaaaaaaggcagggcgcagtggtcacccctgtaatcccagcactttgggaggccaaagcgggtggatcacctgaggtcgggagttcgagaccagcctgaccaacatgaagaaaccccatctctactaaaaatacaaaattagccgggtgtggtggcgtatgcctataatcccagctactcgggaggctgaggcaggagtatcacttgaacccaggaggcagaggttatggtgagccaagatcgcaccattgcattccagcctaggcaacaagggtgaaactccatctcaaaaaaaaaaaaaaaaaaaaaactgaaaaattcctaaacatctgccccagcattttggagaataatggataaaggacctgagcgacaaacatccctgtacccaccacctgcttcatatcctttattgttagggcaatgaagaatcccagatagagctgttgcttttttgtaaatctctctaattgccctcccagtccttttttttttttcttaacttttactttatttgcaatctactcattgcttaggacttaatttcttaagagctgttttagattcacagcaaaactgagtggaagatatagagatatcccatctatctctgcccctacacatgcacagcttcctgcatcatctacatccccaaccagagtggtacaagcgtaacaggtgatgaacctacattgacacatcactattacccaaagttcatagctgacattagggttcactcttggcattgtacagtccatgggtctgcacgacctactcatttttaacccgattctctcaacagccccactgggtagacagaacagcagtgattgttcccatcctgcagagggggaaagtgaggcctgggctaagcagtgatttggtggcagggccagtccctgattcccaggttgagatgaggatgaaccactgcctccagctccagggaaagagccctggcacaaaaagctggctgctccttctgggagttcgcaggcgtgaagggacagtgcagagagtcccaggcaatgaggaaacccatgtagggcagcagagtcggacctttaaagggattaacagtgcatgtggagggacctttaaagggattgacggtgcttgtggaggaaggcggggggagtctgcaggcggcggatggaacgcaggggcgaagagggcgggagggggactgtgcacccatcgctgagccccatcctggtcctccgccctgcatcccacccacctgcccaccccaccaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcaggtctggaggcaccttgcaggctgggcggtgggcgtgggggcgtggccagttgatagatgccgcgaggggcgtggccagtgggcgggcggagcgggcccagtgccggaaggccccaccctgacttcgggcccttccccgccccactggcccagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcaggtgggaccaggctggggttcccgcgtagggggcgggcagtggccgctggccgcgggaggccccttctcatgctcacgtctcccccggcgcacagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcggtgaggcccccctctcctgggtggccctcacctgaggggtggcgggcggtgggcctcgggctaacgagccctctgcctgcagaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtaccaagagcccgcctggggggtggggagaccacagagctccgcaggcacctgtgtgaagcccaccctacctggttgtccacagagcctagaacagagacaagaagagtcactcttggagacaggccatcacgtagatgggcacagttacacagggacggtttccagggaactgtggtcttacatgggggatacaagcacccctagatacacaccgacatagccagacacagagttatcacagtgccatagccacacaggaagggatatatgtccagggacgtggtccaggttagaacacacaggctcacaaccacacagaggcagggagaggcacttatttgccgttcggggaaattgtcacacccatgggtgtactctcaggtccacagctatacacaggcccacttgatatcagacacagctgggacatcctttatcccatccttttatttccatttctgggaagagctgtgatgctccagagaggagcccctgcccccatcggtgtgaaggaggcactgtctgaactgagttctaaaggacaagggagagttagccagccacaagaaggcaaagagccttcctggaccagtgtgtactaaggcctagaagccagggtgtgcccagcccaatttgagaaactccagtgcaatttagtgtggttggtgctgcagtttatatgaatgaggttggggaaggagtgggggcatgtaccccaagttttacagtgaagagctggaacttgaaccatgggcagtgaggaggtaaggagtggttttgagctggggaaggagagagtcacatttagtgaggtttctggggctgatgcaaaggtgagactggaggtggggtggccaagaaggaagctgatggtcccagaaaatcaagtaatatgacatctcaacaccccgatgcaaagatatgcatccatttagcctcgcactttagatctgctctttccctgcctgggtcactttgaacagtctctcctgcattgcttgccaaccccactggtaaaagggtggtgtttgcttgtccagggaaaagagttttagttttgcagaaccaacaatatcaggagcatgtggagcagccactcttccggtgcagtcacttcagacaggacacaaccctgcaaagactagccagatggggcggtgtcagaagagaggtggggagtgttctcaatggagaattagcccttcctgcttgtggctcaggatcagctagggcaagtgtgaagaaagcatgtggaataatacaaatgcagcattgtgccaaagccccctgcccccatcctgggacggaggagtggggtcctacagggagcatcacgggggctgctggcagacagtggctaaccacacctcctttcttctctcctcaggtcacaccccaagggggcgcggggaccttaccgttgtcccaagcttccagcagtctgagcacaacaggtcagggagggcagaaaatggtgaggggggactgggaggatgtggcacaggctggagcctgaggttcccaagtggctctgggtgtccatgggcctcaagactgggcctggggagtgtgggtgggggaatgggagagacagtgggaagagggtaggactcacccctcctctgcaggagcaactcagctttaatctgcttcacgatttcatatgagaaaagcatgggcctggtaaaaggtgaggcacttgagttttgtgcctggcctctgtcatttttaagctgtgtgaattcaagcacttattttatccttctaagcctcagtttttattaaattattatgaatgtgtaaaacataaaaagatataaatacatgtatgtaagagtgtatgtgtatgtacatatacacacatacatgcatacatacatagtcttgtatccagagttcccctccctcttcctgggacacggtaggtttatatgtatggttatacaccatatatataataataatataaaattcgctgggtgtggtggcttatgcctataatccctgctctttgggaggccaaggcatgtggatcacctgaggtcaggagttcgagaccagcctggccaacatggtaagccctgtctctactaaaaatacaaaaattagctgggcgtggtggcgtgtgtctgtaatcccagctactcgggaggctgaggcaggagaatcacttgaatccgggaggaggaggttgcagtgaactgagatcacaccactgcactctagcctggtgacagagtgagattccatctcaaaaaaaaaaaaaaaaaaaaaatatatatatatatatatacacacacacataatatatatatgcataatatatatacacataatatatatacacataaaacaacacgttgcccctccccaggctagaaaatagtaagtggagatttataaagtagtaagtgcttgcctggcactgtactaaactctttctaaactgcattgactgacttaattctcaaactcattttatgagatagggtctattattatccccattttccagacaagggatctgaaggtcagagaggttaaggcactcacccaagggcaccactgggatgagacagagccaggagtttctaccccagcagtctggctgagtctgggccctcagcccctgccaggttgcccatccctcagatgtggcagtgtgcctggcacccttcgcccctccccagcccctagagggagccatagggctttgtctcctgggcacccccgtttctagtcggtaaaaaagtggttcagggcagggagtgtagagtgccagggctcagcaggaagcacctgctctgacttccattgttatgacaggggtcaccatggcagaggcacagggaaatgactctgggaagagagggcagggaggtctaaggctgttctgactgaggagatgctgcgtgagctgggcgggaggacaagtaggagctgaccccaggttcctcagtgggggacgagtggaagctgaagaccccatctttctgtctctctctggcagttactaccttatcctcagctgtggggacgctccaccccagccggacagctggagggggtgggggcgggggctgggctgccccctcaattccatcccctctgtcactcccccacccccggccaccaccaacagcacaaaccccagccctcaaggcagccactcggctatcggcttgtcaggcctgaaccccagcacggggtaagtgggtgcacgtgggaagctgtggggagaagcagggtcgctgctgcttctagggtggggagcggcaccccagttatgttggcaggtccctgcccctgctaatgcctctgctttgcctcttgcagaagcacaatggtggggttgagctccgggctgagtccagccctcatgagcaacaaccctttggccactatccaaggtgcgtgctgcctcatgtcacacccatcgtcaccagccctatcctctggggcctcgagccctgccattgctgctccagccatgccatcctgcccctgctcactgcattgcttgcctcttcatacccatctcacctttggggaaggtgtgaggggtgctgatgggggtcagtgggaccgatggggagatggggggcactctgggcaggatgctggaaggcaaaggtctcccctggcccggcatgcccttagcccagcctctctctctccccgccagccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttt

SEQ ID NO: 13399 - DNA, 22786 bp, Human
gctggcctccactctgcccctccttacactgctgggtaggagagacggcggggctgggctcaggtaggtgttttttaagggaagggcccccagcagggcagctctgccgctccccagagaggtggccaccatgccctcctctcctgccgcctgctgcattcaagcaccacagccccggtggcccagcaagggaggctcatctctcacggttccagaggccggaagtcaaaagtcaaggctctggccaactctgttcctaggagggccctcttcctggcttcatgtgtcctcacgtggtagagggagagagaacggaagctctctggtgtctcaaataaaggcgctgatctgatcatgaggaccccaccttcatgatctcttctaactctaactactccccactgccccacctgccagtgccatcacattaggggacagaccttcaacataggagtttcgggaaacacagttcagtccgtaacacatgccttctctccagacagcgttcaggtgcagaatgcagccttctgaggccttgagatggaaaggacgcctcccttgagccactatccgccggtcactgggagctgggattgcagcttctgatgcagtggtgacagtggctgagacttggcagggttaaatattgaacacaagatggtccctatagcagcatgtggacacacgccttgctctgctcactgcacaggggctctccaagccatgctcactgcacatggagcctgggggaagagtggggatggtcagggctcccacccggctgctgcagaaacgttgcaaagggtggtgtcagggcctccgggtctctgcatggtaaaggcagcacactgggtcagaagctacattctcagctgtccctggatagaggaattgaggaaaaagggacctcagaccattgtatatgtgcccagttatataggggtgagatttgcctgctcagagctctaagtactgtggccagctgtgaaagtgtctgccagtttctcttggagagcacatgaaattcactgctttgaaatcggctcgctgctgttcctgtcccttctccctggaccctgctgaagggcctgctcagagccagtcacctcattcatatccagaaccccccacatgcttcagtcctgtctgtgcacccttccagaaaaaaaaagcagaggccttaggggtgattcttgtggtctcttccacggaaagatctttcctgcttagtaacagtggttcagtaaatatgccctggtttcatctgcatacgttgcattgagaataccttatggccgctctgtgttgtgtttagaattgtttatttggggtgcagggggatttcaggagcggattgggtagggagcatcacccttggggcctctgctgggctgtgttcattgatggctgcttcccggggccgagtcaccatgatgactgcccctgcgctgggatcagccactctgaacaagcagaggccgatttttccttttccgagccctgcagctagcagcatgaactgtacagtcctgcgctgtcctcctctttgactgtaatgaatggactggccaggtgctggagcacatttcgcaaacacccttacgcccctaagaagagcaggtgcaaacagccggccagaaaacactgcttgggctgtgtgtgcccagtgtgccaatgagacaagcacaaagtgggcacagaggccaaggagcaagcgctgctctgctctgttgggccaggaaagatgaaatgggtctgtcctcattagaacagcctggaagaaagaggattcccacttcccataaaattaccattgaacccatgtttcgcttgcttaagggacttttttgttcctcctctactttcaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaaggtgagcttctggggaacaggactgtggctaagggagaacgttgggattttcaagttgggatccaagaacttttctgctttaaagattgccagtttagcattcagatagttaaagtttagttctttaaacttcatcatggtaatagatttagccctggaatcatagtcacttgtcttattttttggttcccccttattagtgaaaccccttcttaatacagggtatgtttctttttacttgataaaattcggtgacagtgtggtagggagcttggtggtacagaaacccaggggaacagagagtgtggcaagtagatgaaatattgagaaccactagagaagaaaaaaggtagcttcggggagaggtcagcaaaccttttctccaaacagtctgatgggaaatatttgaagctttgcaggccgtataccatctctgtcacaactattcattgctgcctcgttgcatgaaagcatccatgaagttaagtcattaaatagccagagtcgtgtttccaagacaactttttttttgcagacagccccatttggccccagggccgtgctttaccaacccctgatctagaaggtggttctaaagtttaataaccctgggtctctgggtttctccagtggcctcgtaaaattgagttcatgagaaaacctatcttttggacaccaaggtgaatactagcaggtcattttcttcctgcacatctgccctaacctaggccacgttcagtctctctcacatgctcctttggggcttggcagttgcggtgacagcaccatcatcatcaatatcatcatcccttggctttctcttagctgttgaaactgtcttgcctggagcacagctgaaaagtaggaacttgactttgaccatttgtatcctcggccccagcctaaagtcagtgctaagtaaatgtttcttgaactaaactgctatcccccagataaagttgtaatcctctaccctgatgtacaaaaattatatgcactgtgtttatgtctgtctaattgagtagcttctccttcccctttatcccaaacatcttctccctgcctctgattgatgctggcatccctgggcattgctgtaaatgttctttaaaagaaacgtctagcccgtgtgagattttatttgtaagagagcaacagtgattgggtgttgccataaataactgaagcatttatttttcagattctgttaatggacattttgttttttactttatagcccaactcatcagagtcaaagctggaacttgtgagcataaattgtgtgatttgggcagagtgttaaagtgaggagggcagagtcttaaagtgaggtgaatttttaaaaatgtcagtgggctgggcgcggtggctcacgcctgtaatcccagcactttaggaggccgaggcaggcggatcacgaggtcaggagttcgagaccagcctggccaacatggtgaaaccccgtctctactaaaaatacaaaaaattagccaggcatggtggagcgtgcctgtaatcccagctactcaggaggctgaggcaggagaatcacttgaacccaggaggcagaggttgcagtgagccgagatcacaccactgcactctgagactctatataaaaaataataataataataatgacagtgctctggaggaaatattggctgttatccctaaaagaatccctaatttagaggaggaagacaaacaagacagccttgaacgtgaggaggaggacagcctcaaacatgaaggggagggtgttttgagaatctgaggtggacagaaccatgggatctctggccttgcccagagattctggggaatctacctccgaggcgccacatgtgacccaggcagtttgctagccagaagcttcacgcacatcccagtgatagacagacttcaaggtgggaatttatttcagccaaagtatctgccatgaaaccttctactctgatgaatgttttgcctgcagaagaacgtaggcagacggataggaaatgtattattcagtacattgaacttcctaacacccagggagatttttgtattaaaatcaaggtggctgtgaatctgggtaacactcctcagaattcattaagatagaattcgttagggattctctggcatttgatgggatggaagcccttccccagtgtccccagctgcttggtggcagttgactgatggagggcctcatctagaagggggaatcacacaacagtccacctccctagggttctggaaaggaagagtggggtgatttcccttggctaagcctgatcccttgagtgagatctgtgaccatttctcttccaaggagagtgctgggaattttaagtaaaaccattcttattcttcagttggataaaactgaatgataattctcattgatacattctaggctatgcacaaagcattcttgattgctttggtttcttaattttgaaactactgtaagggaattattctgagggagcataataaggacataacctttgagggattctagcaagattttgatggccggcaagctctatttaattttcatttagttttcatctttatgtgacatttccagtagattgtgtcaaggagataaaatggtttatattcctggagatcatgactagcaaaacagaaatgagagagaagagcttctgtatcctctggcctcagcctgacccacatcaattcttcccacctctccatgaaagccattttctttcacaggttttggttcactcccatctcatattaaataatttgttggttttatgatttttttagagcacaagggcacagccagggggaattcagacactgctttcaccaacaccaggatccaatagcatagattatggcttctctgtgtcgtttacgcatgcacgatgatcattcattccacaaatactcattgagtccccgctacgcgccaggccttgtacgaggcccagggatacaacagcaaacaaaacaggctctaatggtgctgataccctaatggggagatggaggctcctcctgcaaaagaaacacacatacacacacacatacacatatttcatatatatatacacatatatataatatatatataaaggatatatgtattttatatatattatatataatatatagtatatataatatatagtatatataatatatattatatataatatatagtatatataatatatattatatatactatatattatatataatatatatattatatatactatatattatatattatatatatattatatatagtatatatatattttatatatataatatataatatatatatacatatatataatatatatatatgaggtatgtagagaaggaaaaattcttagttcttggcttgggcccctataacaaaagacattaataagagaaaagcatgcaaacttacttaatatatgttatatgtatattacagatatataatttcttcataaggaaatgaagacttaaagaagtaattaaacctgagggatttgatgaggtgtggagagtcctggaaaaatgagatgggacaagaaaaagcataagcaagtgtcatgagctggaggacagcaaggcctgggcattgcagattccctgtgtccttggagataggatgctctgtcccccacatatagggagggcccctcccacttgagggtctatgacctgcttcagggggcaggcagggagtcctgcctgcacctgcggtttctcaaattcctccagcttaaaatatgtgtggtgctatattttggggtagcatgttctgaacctcatcaggtacatgatgtagtggttggtggtaagagctatggaaaaagataacattggggccaggagatgtctatttcacataacatcctgtgtgtcctcaagttgggtcaagcaatattatgacaagtgccttatctacgtctttgcattttgtcctctccaaagctcattgaggaaatacactttttgtccaccatgagtggagtcttaggctctggagatcacacagtttctaagggctccactcgagtctgggtttagtgatcccagagccgggttctctgagacacccagatagacgggcctgctgtaatttcacaggaggaggtaggtggggcttcaaggcccagggatgctcccagctaagcgcatctctgtaacccagttaatgtaaatgaatagaaactgtctacctgatttcctaacactttcccaaggaagtgtgattatttcctttcaaaggaaaaggaaactggcaggtgattttctggggtcgggggggcaatttgatagaatacgatgactgtggacttcatcacattagaaaagatgtaggtttagtttaactaaaaacggattcctttctttggtcatttgctttggcaacttaaaaaaaaaaaagaaagaaagaaagaaagaaacgtttcctttctttctttcaattgtttattacgggaagccagaatgtcagcagactccgtaagtgaggcagtttgggaggtgggggaggggagtcctggggagaagtatatgtgcttattttcttcagaaagagtgttcttcatcttctgaatatatcttctcatttaatcatatccattatttttcaaaacacaccacttgtttggctgacttatttttgctgtttcatttgccgtctacattggtaacatacagagttcaatggcaggagccatgaattaacttgattcactttttgaagggttggaatttttcagactgcttcaacacttgttcaatgatagtatgagctatgactaggcataatctctcattttcaaggtatgtagacagtctgttttcatgttgtgattttgaatgataatttaaaagaggttgggccaggcgcagtggctcacaccagtaatcccatcattttgggaggctgaggcgggaggatcacttgaggtcaggagtttgagaccagcctggtcaacatgatgaaaccccatttctactaaaaatacaaaaattagccaggcatggtggcacacacctgtaatctcagctactttggaggctgaggcaggagaatcacttgaatctgagcggctgaggttgcagtgagctgagatcatgtcaatacacgccagcctgggtggcggagtgagacactgtctcataaataaataaataaataagtaaaataagaataaaagaggttggaaggaactgacttcagaattcttactttatctgaggaaacagtttggtgaggaacaggttgagtttggaaatttaagaagcaggttgagggaagctttccatccagaggcagagcttggaatcagctcatacatgtcattgcgggagtttttggaatctgttcatttccagtccctgatcacatgcagtggtcacctaactcaccgtgtcaccgtgttttctaagttaatcacattcagtttctctttgtatctagtagcagttcttttaagaagaattttaacgttgcccaaaatgagatgtttagggcgtagggcatgttaaatattccattgcactgatttgcctttctgtgagtgatggagaggctcctctgtggtctttctgccggacataggctgtcgattttgaaggtgaccaagtagcaggaaccagttcgttggccaggtaaattacctactgaatttcactttggtttgtttctgttggtgacttgcctgggttattgtgcacctgtctgtttaccaccgtcctctctcctttgggaagctctccggacaccccgccggccttgccctcaccatctgttttctttgtgttttgcacagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggtgagtgctcagcaggtgcctgggcgttcaggggtgctgctcagcaaagcctttccgccttcccagtgcacatgggcgtgggccgtggtgtcgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcctgctgcctgagataggtgcggctcagcacagcctttcgccttcccaatatgcgtgggcgtgggccgtggtgttgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcccgctgcctgggatatacgtgtggggcttgaagtgtgcttgaagtggagatggggtttacgggggatcctggggggccccagacaacccaaggaccctgcaaagaagagcattccagttacttttcccaccgaatctgtgagctccaagagggtcccagaatggaccagatgcgggtgggggcagaaggcggcctgtgctctcgccattcagtttagatctcttgggagcagatgtggttcgttagattcccaacagggtctctgactccagagtcccacgaaccgctgccccaaagcctgtgttcattgtaatgtgagtttttcttgcctttgcttccttgaagcttctaacatctctgtattgtttccacttccccctctgtgttggtttgagttggggcgaggacagcatttgttttgccagcacaaccgtgaactggaatccaaagaaataaaagggggaagtaagcatcagactgtgggttacgccctggcccacgagccaaccggggagcatttgctcaacgctttcttagcactgctccccgcaggcagccccaccgtcagcagagctgggtcctggcggttaccttggctaggcttagccatatccgtgtcctggcatccccaggggtgtttgtggtggagagtccctgtggacttctccctgtgatagaacggagtccacccctatcctccggagaggggcgcattgctggtgttcattcctgtgggaaaaccctgtgaccttggcgtgtgccgctcttcctcgttcctctgagcccgcaggctttcttgcatcctagcttctgagaggcgtgcttcttggtgcccggcctttctgccacctccccggctcccctggattgagccctgtttgtctgggagagcccagagtgtcctgtagacacaggtgtgcaggcaagggtcacatgtggcacatacccggctcggctgcccatgttgagccaggagacagaagggacgcagcccggcaggagtggggcaggagtcgggtgagaccctctctgggtggcctgcagtcgtgtgcagtgccagaagcatggagccacgagattgcccaggggagggagatggaactggaagcggccgtcaggggggccaccttggcaaccaggaaatcactgcacttgggtggggaggaagcgaacaaacgcagcagggaagcctccgggcccccatgtggggtcacctgcagggaggggatggcctgcgtccctcccatcagccatcacccatgtgtgattcagagcacacctcctggctctccagaacctggtgccgggccgtggcctggtctcctcacgggtgcacccagcacagtggcagacaaagcgcctccatcccgtgagagcctctgtgcgggcggccccgagaccacagccgtggctgtgcatgctgtcgtggaacctgacagcattgctgagcccaggacactcacctcgacgttgcaccagaggtggaaaaatgacacaaccaggagtaccacaccagctgtggaaaataaccgccgagtaggtggcttttacactcattttcctgcttttttatctttttccaaaagacataaatgatcaaactctctcaattcgattggtgagcatctctgggaggggattttttggtgggcctccctgtccgctccagggaggggtgtgtcctctgtgcccgagtccttccgctacccagaaaggaggaagtgaaacttgcccttggccaggtcggctccctgaggcaaggttagattttgtggtgataaagtgaaactggttttgcagtgtccccacccgccccccacacctgtgtcagtcatcatcttggccaaacttatagaaaccacagacggatttctcccaggtcgtttattaggagaccctgaaaactggctgttctattccgcttgtcatcacagggctgccacgatttctgcggcctctgccaccgctttacctgcccctcccagagagtcacagccaggccaccccctgcctctcatttttagcatagctttcggtgtccttgttctgatgccttgggttggaaacagtgtttaaatgatggggaaaatgtgagagtttgagacagtcagtgtgcagggagatgggaaggaaaaaggagtcaaatgagacctgggttgttcctctctccactgcctttagaacggggtcagcctttgcccctgccccacaaagtcgtgtaagatctggccctacccatcccaaccctgggggccactgtgctctgtgcacccctgccctgaacacacccagctcgcccggcctccagctcctgcagatgctatgctgttcctcttcctggagctccctttcccagacctcctcatctccctcagctgccagctcaaatgccgtctctccaggacgtccttctctgcagccccgcgcactccatcatcctctgtctccatggtgtttcttgaatcagaagcggtttgttttggccaggcatggaggttcacacctgtaataccagcactttgggaggctgagacaggagaatcgcttgagcccgggaattcaagaccagcctgagcaacatagtgaggcttcatctctccaattttttttttttaaatcagccaggtgtgttggtgtgcacctgtagtcccagctacttgggaggctgaggtgggaggatcacttgagcccaggaggtcgaggctacactgagctatgatcgcagcactgcactccagcctggacaacagagtgaaaccctgtcttgaaaataaaggaagagaagaaaagaaacaagtttgtttatgttcttgtgcacttgtttctcattattactctaactgaacataggtcccatgagaggaagggccccggcacataagaatcactgaggtactagatggataagtgattgaatgaatgaatgatggatgaatgaatgaatgatgaatgaatgaatgaatgaatgcaggccttgggctgggctaagaatccaagcgggaggcattctcacgtggccataccatgcttctgttctgtggttccatttcctctttccattctttttgtgcctgtttttgatagagtccgtgtgtgaggcatccccgtacctctgcctgccccttcccagcagcatggctgtggctgcactcagagcacccctctgtcctggccacttctctcccaccagagcctctgtccgtgatggtgtcagctgaagaatgacaaggtttgttcatttggaaaggagagcctcattcctcataaagggttgcagcctgtgggtggctattctgacaggttgggaagcagagcctcctgccagaagccaaaaacagacacttcaagggaggggcaaaggcaacaagaatttatggatattggtggccaaatatacatattcaataagccgtagggggagtcatgagtatttatgaaaggagaaatgtgcacattcacatttaagccttgtgctccttcaggggtcccatgtacaaaaaatggtggcagtggcatgattcaagggtagggttttctttcagccccctgatgcgtcagaggcgaagcaggggacatgaaaccctcgctgtgcatcctctgtagactggccagaaacactgcgtggtcggtgggctcccgtcaggcaaagaggaggggcagcgtctggcagtggtagaggcctttgaaagggaacccagctttttaagaatcagaaaagtcattcagcagcgcccttttgatgcaagagactattcccaattctcgggatactgtcagcactcggcacatggtctctgttatggtggggaaggaaggggagtcagctggagatagccgtgggcagtggccatcagccatgggagcagaagcagcccacggtggcctcaggcccagggagaacttcctaaggggccagagtgagctgtcacaactggtcctggatccaccataagaacgaagccgtggggtgtggtgacctggagccgtcggtgatggctgtagcaggggcgttttggtcaagttgcgggaggtagggaaataggcgtgtcgggctctgtagagaagtttctatgagaaagggaaggagttgctgtgggatgcaaagcaagggagggtggttgttttgggagtggagtgggggccggaataaacccaaagagacttgaaaactaacagaaataaggaagctagcaagtgcatggggcgcattggggcgggaaagactggtgtggtgtgaagggactctctgtggattgggagaagacccactttaacctccagaagaggaggagttgatggacagtgtgcattggatggggtcctgagggattcctcccaggcagccccaaagccagagcctgtggctgttaatgtgggagagggaaggaggatgggcccattgtccagatgccatgtgcagaaggcttcccctcgagttttggggcatgttgggaaggaagcaggatggaataaacatgcagcaaaaaagcctaaattgtatttctttgtactttataagagtattttcccccgccccttttttgagaaaaggtctcgctctgtctcctaggcgggagtgcagtggtgtgatcacagctcactgcagcctcgaactcctgggctcaagcagtcctcccacctcagcctcccaagtagctgggactacaagcaggtgccaccacacccagctaatttttttttttttttgtctgtagtagagacaaggtttgattgtgttgcccaggccggtgtggaactcattgagctcaagctatcctcccacctcagcctaccaaaatgctggtattataggggtgagccaccatggctggacaagaatatctcttgaagcaagttcccagactctggccgccaggcccgctattcctgtcaatggcgttttgttggaactcagccacacccattcccatctgcatcgtctgtggctttcaggcttcgtgtgtcccacaaaggcaaaagtactatctgtccctttataaagttcagtcaccctgactgaaatcatggtgtactcactgtaacaaaattccagttgaaaccagggtagtgcagcagtccatcgagtgtttcctggtgtacctgtgtgcccataaaaagaggaagctgcaaggatcaagttcatagagctagagcctcctgctgtgaaatttttctattgctaagaattggttggcacccaaaatttgtcctttaaaaatatgcatcagttatgccttgttgatggtgtgggtggtttgtaacaaactaaaccagggctgggctcagtaaaagttgtgtaagtgagtgagggagagatgccttcattcttggtgttggaagtgccgacctctcctttcatctgggatccatggaaatgggaccttggctgcccctggatggagtccaggcgctctccttcccaggggccagagaacacctgtgtttcccaggaccttggggacctgtgcccagttcccctggggagagagcggttttgatcactcgcaccaggaatgactcgagtcagaagcaggtgactttgacctgttctgttacctagaaaatgaggccactttggagccaggcagctgtgcacacagccagattagcttggtgtgtgctgagtagccacgaaagagctgagttggggacattgagtgacttcgtgtcaaaccctgtggtggtccagcacaccttcccaggaccacagacgaggctgccaccacagcaagaaaattaggatctgacagcctaccagctaactacacaccctcctgacacgtgaatacacacgtgtatgcttttatcttctgaaacaaatctagtcaacatttaattttttaaaacaatttgttttgaatatatccaaattcaaatagaaacagaccttcttctgaaatatataaatagttgatatgaagcataatccagaccggtattacatttggttcaattcccaattccatgtggggctcatggaattgggaaggccgctggccgagtgctgagaagtttgcatatttgcctccacgcctgtcacttccagctgtgggacccgggacaagcctggggtctgcaggcttcctgtgcttatctgtagaacagatgccttgcggcccacacagcagggaggacctggggttgggtgcccagaggcagctctggctctggcatttctcggtgtgaaacccacttcccctctctcagcttcttctgtaaagtgggttgaactcagcctctgcttcatggggggctctggggagcggaggagctgagtgtctggctcacagcaagccctgggtttctttttttttcttttcttttttttgagacggagtctcgctctgtcccctaggctggagtgcagtggcgcgatctcagctcactacaagctccgcctcccgggttcacgccattctcctgcctcagcctcctgagtagctgggactacaggtgcccgccaccacacccggctaattttttttgtacttttagtagagacagggtttcactgtgttagccaggatggtctcgatctcctgacctcgtgatccacctgcctcagcctcccaaagtgctgggattacaggcgtgagccaccgctcctggcctagccctgggtttctagtagcttctacaaaaacaaacggccaccaggtcctcaaacccccttctggccagcctcgttggtagccagctgtcagcctctcatatctagggaggcatcagaatgatctgtcgctcctggttctttttaaattccatggattgagatgctgggggcccacctagaaggatcgtgagtcacctactctggctaatgcatgccacaagtcgccaaaaaggtcacctttttgtattgttagactccccccaggtaaacataaagtgtacattagaatgctcagtctaaaacagctgggctcgctttgaagtaagcagcccagccgaccgcatgagcactagcaagacgaccctgctatcggcacaaaatagttggccaaagagcgccggtaccagcggtgtggttggcgggggtggggggttgtttgttttttagcacactttggagtcctaaaatgacaacctcaggtgctgaaacagagcgtagagagaaagaacgccaggactggtgactttcctcttctcttagcaactcgcctgtccaggggctcacgggagcctcagaaaccgtctctgggctgcctcaggccactgtgccctggaagccaagcctttcccattgttggatgagagaaagctttaagggtgggggtgagctgtgccttctatggcagaggagactcagacaagaatcagacccagcatgcggctctcctgccttcctggtgacgtcatcctgactggctcagagccacacgctaaccatgtgtggcctcatttataattaggatggcgccagagtcgcttgcatgacacccagtggcagtcatgtgacttggcacagtgtacaggactagcaggcctgctgtcttgtgctagccaatttgatttgtttctttaaaccagaagtgtgagtttgaccccagcctggggtcccccagatatattagccatatgttcaatgcctgtcccatccagcccccgtttttaggagggaattgagtcccaaggcggccacgtggttgttccagcctcagctgggacttcactgtcccagcagggctgtctgtcctattacctcccctctgacttcctctgtggttagtaatccctgtcctaaagacacagtagaaagttcttgcagctttgacgtgggagcagtcccaccaattgtggaaaccgttttctcatgttgcacagtcctgggggaggtctgtgcatctcctggtcaccgtggttcttggtggtacaccctgtctctgaccagggcctcttctgttctctgtcttcttctccctgggtggtccctgcctgagtcccccagccttctacccgcggtgctctctaactggccaatgtcagcaccgcacactcagcaggtccagctcgccctccatccgtctcggcctcaggctatggtgtctatttggtgaaatgcattcgtttctctctggtgtccccagagagtgggagtggtgacaactctaatccatattcaccctgtctgttagcttcctggggctgccaagacaaatgaccacaaaccaagggacatcaaacaacagacacctgtcctgtcaccattcaggaggccacaggtctcagtcaggggtcccagggtggcctccgtctggaagcagtgggggagaaggggttgcaggcctgcctctcctaagccccactggctcaaccctccttcttttccttggcttgttgccgcatctgtcccgtctctgcctccgtcttcacacggccttcttctctctgcctctctgtctgctttctcttcttatgaagacgccagtccttggtgacttcctctaatccagagggacctcatcttaattctatctgcaaagaccccattttcaagtaaggtcacgttctgaggttctgggtggatgtgggctttggagggagacactggtgaacctggcacgctctgcacatcatctcttttctcccgtgaatcctggcagtgatcgatttcaggggacatttggtagtaggccagggaacatggagaatagagagcccatggccattcctgcgccgtctgctggaattctgcggggagcagagcctgccccactccctacactgtctcacgctgtgtgcctcttcctctgcaggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggtgagcagcggctgagcttcgaagctcaccgaagcccctctgtccctgggttccgtggacccatgcagtgcagccataaaaagtcttgcctcgcggcatttctgtgagggtgcaacaggtggaaatgtgcacgcatgtgcccagcactgggtgtgcctcactgagtgggagccatcctccggattggttgtcgtgagccctggctttaggatgtcaaggctgttccacacgacatgggaaggacaaacagaactgcctgtcccttgttcattttgatcttaaattaccatccgtagggttgaataatgcaataacacatacacagaggactttgtgagccgctctggactggagtgatacctggtatgttacataacttgggccaaagccggtgtggccgggctcttgctcagaggtcctttgtgttctcgcatgtttgtggagggcaccctagtaagcttcctggaagacggttcaggcttgcaagatccaggaagcaggaagtcccaaggacaaagctgtcttttatgaatgggatgaatttccaaacaaatggcacagagagaaagtgccataaagattgtaaggaaagagaagtcctttctgtttattcatttgttgcgcacctactcttgcacaaagccctgcttttccctctggaatgtgctgaccctggccccgagatggttccactgtttcttctgtgggcttgtctcactcgtgaaagagtgtcccaaatagtgactactgaagctgcaccaagtaataggaacaaatctcgttctgtctcctaatctttcttcctctctccctccttttgttttttacaactccacctcccaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacctaatgtacgtatttatacatacac

SEQ ID NO: 13400 - DNA, 14961 bp, Human
aaaaatgtggcacttccccactcccctcctgctgccatgtaagacatgcctggcttcccctttgccttccaccattattataagtttcctgaggccttgccagccatgtggaactgtgagtcaataaacctcttttctttataaattaccgagtctcaggtagttctttatagcagtgtgaaaacggactaataaaaggagtgtattaattgtcagattcggggcacagaaataaaactagaaaaataaagaagtgcttgaagaaatcctttaggaaaaaagaaagggaaataaaattctgaatgaagatgaagaaacggaacctttcatcagagagacttaaagctggtgagacctttatgccatggatctttttttttttttaaatgagtatagacacagtcttgctctgttgcccaggctggtcttgaactcctaagttcaagtgattctcctgcctcagccacccgaacagctgggattacaggcatgctccaccatgcccaggtaatttttttgtatttttagtagagatggtttcaccatgttggccaggctgatcttgaactcctgacccaagtgatctgccctcctcagcctcccaaagtgctgagattacaggcatgtgccaccatgcccagcccatcacaagtgttttgacagtccacatagccactcctgggccacatcagaagtaaaaatggaactcataggccactattactcatgagtttagtaattttattatccatttcttctgcatctcccgctcctgcttaattcccagccaggtcttgcctgtctaccacggtccaagcagtcatttgggagagagaactcccaggcagtgaaatccaaactccttaccagaccctacaagaccctcttggatctgacccctacctacctccccaacttccaactgttttccccacacaccaacctttctcgccttttgattatttcattaagccaagcttgttccaacttcgaggggtttgcctttcctggtctttctttctggcaaattcctcctccagagctccttcagtcctgtctggctcgtcacccttgtaactcagtgtcctcttacttagagacttcgcctgactgccctatgtaaagtcctcagtccatccctgccagtcagcatagtattgccaacgatactctcttatttccatattgtctcctactagaaaggaagctgcccgagggcagagattgtcatcaacatcgttcactgctgcatcctcaagcacctcaaactacccggcacaggaaaagagtaagtgaaatgaatacccgtgggctctccttgcggctcactctggcttagagaaatcggcttgccaagcaaaagcatgattaaaactgtgggtttgggctgggtgcggtggctcacgcctgtaatcccagcacttcgggaggccgaggcgggcgaatcacctgaggtcaggagtttgagaccaacctggccaacatggtgaaacctgtctctactaaaaatacaaaaatcagcagggcgtggtggcgcgcgcctgtaatcccagctactcaggaggcttaggcaggagaatcgcttgaacccgggggaagcaggttgcagtgagccgacgtcgcgccattccgtctcaaaacaaaaacaaactgtgggtttgttttgagacagggtcttgctctctcgcacaggctagagagcaggggcatgatctccgctcactgcaacctcgacctcccaggctcaagcgatcctcccgccttggcctcccagtgctggactacaggcctgagtcaacgcgcccggtctaaaaacgattttaatctttccactgaactattgccccgacgaggtttgttcgaagacagtcaaggccggcccggaagaacgcacaaccatcagcccccagcagagctctcggcgcgcaactgaggctgcgcaggcttagggcggggcgtggtgacgcggctgccggaagcgggtctggagcgggcgagacgaccagggccggcgagcgcagtgcagcgccgtgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggcctacggactcttcaccctctgcgaggtaatggcaagtcggcccctccccgcgctcgaaggagggggttcggctttgggagggtctttggggtctttggtcgagcccggacctctggtcggcccctcctacagtgataggacaggagggcgggaactcacgggttctggggacgatattccgctgctggacagctctttaaatgacgtttagtgaaatgtgtgctcctggatagtacattccccttccgtggctgtgctctgctcggtgggttcactcagcatacatctagttcttgcgcgacggcctaaaactttaacttccatgtgttctatgtagtataggcgcgcagtaatttaattccaagagttcaaggaactactaagtgggtcttcctcgtccatcccttctgctcctcaaagtagtactgctaacaatactttacgtagacttccacaaactgtctttgcctccacaagtgtgtgtgtttatctgtgtgtatagatagagtgttatagttcttcctaatctctgtttttcaagggagttttttaaccctccctcctcccaaacccttccccaatttcaagtactttctaaaggtttatgaaattttggacgtgtgtgatagctgtgctcaatttccagattcattcctgttttctctgagcctcaattttctacatctctaaaatagaattcatgcctgccataccagcttcatgatattgtgagggttaaatgcagtaactttgtgacagctctcaaataaaaagaattatcctaattttcaggataagttctagtttcatatgtagtgcctgaattgaatgtattatcccagaagtgatctaatcagagctaagtacagcagggctatttatttttgtaacttggatattgtttccattactgcatccatttgcttttttgctgtcaaagcgtgtttcagagcatggtaatttagcatagaaatatgcagaattaagactgccctaattgcaggaaactatctaactatctaaaccgtatgtttgttcaggcaaagcactgtacctcacgcctgtaatcccagcactttgggaagctgaggcgggcgggatcacttgaggtctggagttggagaccagcctggccaacatggtgaaaccacgtctctacgaaaaattcaaacattagctgggtgtggtggtgcacgcttgtagtctcagctactcggaaggctgaggcgggagaatcgcttgaacctgggaggtggaggtagcagtgagccgagatcacgccactgcactccagcctgggcaacagagggagactctgtctcaaaaaaaaaaaaaaaaagtttgttcataagtcagttaaaatgatgattaagttgacttgatagcccccctaaaatttaatttattgtatagttgaattttagtactagcctgagttcttatagcctatgtatgtggtcatgtgaggaggaggaaatagatatttattaaatgcccactgactgccagatgctttactgaattccttactttagccctagaacgaaggaaaccaaggctcacaaagagcaatgacttatccaaagtctcaaagcagtaaatggcagatctgggcttcaaaccaagggctttctgactctgagaccctttcttttcctttataccattgtatagctgatcttaggcaaaatttaaaaacaaaagcctgcttttatgccaggtcccttctgtacttatctctctcatgccggtgtactctgcttacccccatcaagtacccgaggaatcagtgaccgcatcttcctttaaactctactgcaacactttctaagggctctgtgtgccaaaatttcttacctttcctattcaaaactgtttatgagagtaatgaatatctggaatgagaagaaatctgattgaaggaattcattcaaacatacagcttaaccccaacccaaattaatattgaattgtttgaattctacacagaaaaatgaagttgaaaaaaatgcagatagtagggcacggattgcttttattggaaagctgacatggatcaaatccttaaggatttattgttcttcatcccttcattccttcttgtttttgagttgacagttctattaaagttccaggttgttcccttgtttattccaacctggaatgttcttcccccttccctttcaactaattatattggtcactaaccaccacttcccctacaccaattaaatcctgtttccttggatgtgatgggatattcttgtgtgctttaatgtatttttcttttttttttttaaacttttcttttggcacttatagtcagtatcagagtatcctccagaatattttctatgtattaatcttgcctttaatacatctataagggtcagggctgaattgtattcctctccattcttcttaatgcttattcaatgcaattaattaactcaaaattagatctttctggatcatcagagacccagtactgaatcctccattcatcaatcaacaaataattatctagcacagagataagcaaactttttttttttttgagacaggtttctttgttttttttgagacaggttctcactctgttgcccaggctggagtgtagtggtgtgaatacccctcactacagcctcagtctcctggactcaagcgatcctcttatctcagccacctgagtagctgggactacaggcatgtgccaccacacctggctaatttttgtattttttgtagagacagggtctcactaggttgcccaggctggtcttgaactcctggcctcaagcgatccccccatgttggcttcccaaagtgttgggattataggcatgagccaccatgcctggcccaaacattttcattaaaagactagatagtaaatatagcaggttctgtggggtctgtctcataatattcttttctttctttctacaaccctgtaaaaacttaaaaatcattctttgcttgagatgggccagacaaaaccagaccacaggcccaaatagtttacagatccctgatctaacactatgggttaactatgaaaaagtagaaagagaccatcaaagaaaaccagagctagtgagtagttgaagtggtacaaaaaccagatgttattcaggaactattacagtaggggaaaagagacttcagtatagacttccaaatttcctcagttccgaagatagcatggacaagtggagatttatagccaaggagcaaggtgggagtcagtggatggaaaattacccaaaggaaacatcaggggcaaggtgggattctggctaaattgacttgacaggattcttgctgaaggcatgccaggctgatcaaataccaagggtgggagttctttctaaactgattcagcaagattcttgctacaactgggtgggtagtgcaggcccaacaaagatgtcaaggtcagggcctagacagcttagaggaacctgactagaagtagataaaggagggcatcttgtcagtgcaaagaataataagacacttcctgccctcaaggaatgcagtccaaaattacaaaatttctttgattctaggtcatcaataatttttttcctgtgccagtcttctaaatcatagctttgccgggtgcggtggctcacacctggaatcccagcactttgggaggctgaggcgggtggattgcctgaggtcaggagttcgagaccagccaggccaacatagtgaaaccccatctctactaaaaaaaaaaaaaaaaaaaaaaaaattagctgggcgtggtggcgggtgcctgtaatcccagctactagggaggctgaggcaggagaatcacttgaacccgggaggtggaggttgcagtgaaccgagatcacaccattgcactccagccagggaaacgagtgaaattctgtctcgaatcaatgaatgaatgcaagcttctgggaaaaaagataaaacaatgccacatgaaagaaacacacaccaataggaaaacacattttaacttcagaaatgttaaagattatacattggtcttagaatcaagggaataaataatagacaccattttttgagcccttaacacatcacttagtcaactgtaagtaacacagaacaactaaaatagccttaagagataaggaccttttctattaacaagaagtcataaggtaggagggctccagagttcacgtggagactcatttgattccggctcttgtcatcttactgctgacacccttagtgtgccctacttgtcctccacctggtcctccaagtgcagaaactgcacttccaacccttagcgtcctctagttgtcctctactagctctccactgggtctggcagaggccatagtagttccaggtatctaaacctcatgatgaagggaacgtctcttctgcagatttttaaagataaactcaagttttccagaagcccctccagcagatctcccctcacatttcattggccagagttgtgtcacatgccaatttttaaagcagtcattggcagaaggagtgggaaccaatcatggttcactcactgttcaattggggctggtgggtggctgtttattaggcaagccatagtatctgctacactgtgctaagcactttataattgttcagtctatgattttgcactatatacagatggttcccaacttacgatggtttgacttaggatttttttgactttaggatgatgcggaaacaatacaaagtcagtaggaacggtacttcaagtaggaacggtacttcaagtacccatacaaacattgtttttcactttaagtatagcattgaataaattatatgagatttaccacacgttactataaaatcagattttgtgttacatgatttgcccaactgtaggctaatgtaagtgttcttttttattttttttatttttatttttttagacggagtctcgctctgtcacccaggctggagtgcagtggcgcgatctcggctcactgcaagctccacctcctgggttcacgccattctcctgcctcagcctcccgagtagctgggactacaggtgcctgccactacgcccggctaacttttagtatttttagtagagacggggtttcaccgtggtctcgatctcctgacctcgtgatccgcccgcctcggcctcccaaagtgctgggattacaggcgtgagccaccgcgcccggcctaatgtaagtgttctgagcacgtttaaggtaggctaggctaagctctgatgcttgataggtatattaaatgcattttttaattttaattttttatttgagtgctagaactaaatattaaatgcattttcatcttataatgggtttatcaggacataactccctcctgtattctgctgagggagtgtgaaaggaaaagatttggggtcctttttttttttgagatgtctcactctgtcatcaggctggagtgcagtggtgcgatctcggctcactgcaacctccgcctccgcctcccaggttcaagcgattctcctgcctcagcctccagagtagctgggactagaggcacgtgccaacacgcccagctactttttgtatttttagtagtgatggggtttcaccatgttggccaggatggtctcgatctcttgaccttgtgatccacctgccttggcctcccaaagtgctaggggtacaggcgtgagccacctcactcggctgggtcctttcgatttttagagacagtgtcttatgctggtacccaagctagagtgcagttctatgatcatagctcactgcagcctcgaactcctgggctcaaacgatcctcctgcctcagcctccctagtagctggaattacaggtgcaagctactgcgttcagctgatttaggccctaaagttggaattttggaagaaaaatttctgagattgctgtgatggacattttgctgatggaggtttcccctagacctatccatttgttgtctggatctgtttcactgtatactttcatagcaccttagaacccaaataaaagcaatttccttttcctccatgcatgttcccctcattgcctggagttgactggtaccacttggtaatcttactgtctgtgtctggctctctcttcagaacagcatgatcctctctgctgccatcttcatcaccctcttaggtctgcttggttatctccattttgtgaagattgatcaggagactctgttaatcattgattcccttggcattcagatgacttcatcttatgcttcaggcaaagaaagcactaccttcatagaaatgggcaaggtcaaggatattgtcatcaatgaggccatttacatggtaagtatttaaaaggtaagtattacaggcctctctggaggaggtagccagcccatgggatgttcccagatttaaactaaaaccataaaagtgagacttatatttaaaaggtaaatctctttatttttaaagagatgcagcaggttttcatggatagggaattagcatttcaactttatcttcaagaccaacttcaaaattatcactggcattttttccttctctttctatcttttttctttttttttttttgagacagggtctcactctgttgcccaggctggagtgcagtggctcgatcacagctcactgcagcctcaacttcccaggctcaagccattctcccacctcagcctcctgagtagctgggactacaggcatgcaccaccatgcttggctcgttttttctatgttttgcagagatgcagtctcactatgttgcctaggctggtcttgaattcctgggctcaagccatcctcctgctgtggcctccccaagtgttcagtttacaggtttgagccactacgcctggccctgtcttttttcatttaaagaatgagaatatacttttcttccacttcaaaagctatcaagtgttctactacttaaacatttgtgaaaaagcgttgagccttcccttagaaaaatagaatgtggccaggtgtggtggctcacgcctgtaatcccagcactttgggaggccaaggcaggcggatcacctaaggtcgggagttccagaccagcctgaccaacatggtgaaaccccatctctactaaaaatacaaaaaattagccgggcatggtggcgagcgcctgtaatcccagctacttgggaggctgaggcaggagaatcgcttgaacctgggaggtagaggttgcagtgagccgagattgcgccactgcactgcagcttgggcaacagagagagactctgtctcaaaaataaataaataaaggaaaaagaaaaaaagaatgcaaaatgagtttcacttagactttgctatttgatttattttcttacagcagaaggtgatttactacctctgcatcttattgaaagatccagtggaaccacatgggatatcccaagtagtacccgtcttccaggtgagcatagaatacttttaccattctccaattactcctcaaccttttcattaggaatgtaaattccttttgtcagagtattggaagatacctgacagctgttttgagtgataattaggatttcagttatttgagaagttcctctctgaggcaaatgtattccttaaaaatattcatgcacattttattttattttagagacagagtctcactttgtcacctaggctggagtgcagtgacaatcaccactcattgcagcctccacctcccaggctcaagaaatcctcctgcctcagcctcctgagaacttgggactacaggtgtgcaccatctcgcctggctaattttttttttttatttttagtagagatgaggtcttgccatgttgcctaggctgatcttgaactcctgagttcaagcaattctcctgcctcagcctcccaaagtgttgggattacaagcatgagccagcatacctggcctcatgcacattttaaagaacacaatcaaatatatagcaacttctgcctataaatcaccattcatctactttgactctgtcagtctactactgtacactttttttagatagaggtaattgatcttacattgtacactattgtgtgtcttgctttgtaaataatttaatatgtatgtatcctacaaaggccattatatttattattttaaataattgtataatatattgaaatatcagtttatttagccactcttgccagcttttaaaatcatgcctgggtttttttgttttgctcttacaaaaaaaaaaaaacacttatcagctggtgcagtggctcatgcctgtaatcccaacactgtgggggaggctgaggcaggcagatcacttgagctcaggagttcgagaccagcctgggcaacatggtaaaacccccatctctacaaaaaataccaaaattagctgagcatggtggtgcacatctgtggtcccagctactggggaagctgaggtgggaggattgcttgagcccaggaggtcaaggctgcagtgagctttgatcatggcactgtattcagcctgggtgacaagagaccccatctcaaaaaacaaaaattatacaaacataataaattacaaaataataaatttagaggtaggtatttatgcatgtatttatgtatacagttaaccctgcctcactgacctttttcacaaaggatttaagataagccaaaaattattttgcattgtaattcaaaattattttattaaagcttatgaatagttttatagatttctagtgtttaagatcgggctccagagattggacaactttatcatactttggggattttgtacttctttttctaccatcctggctaatagtggatttagcttttttagcttaatatgtaggtaaaggcattaaatttgtatctctttaaatgataggcttttcatatttccttgtattacctatcagtatttcctcttattttaaactacctatcttctctattagtcaagtagaatctgaatattatgtatttgtatctatttttatatatttttaacaattctttatatattttaggtagtgcacttttattaaatatactttcacatatattttttccattctgtggcttttcttttaattttggttattacatttcattgtgtaaaacatttttcaatatttacatattaaactgcacttcttgtgtttgagggctgttttacaacttgtgacatttctcaagggtccattttgtttttcctcttgcttattcttagaggtggagttcatgaaatttagacagattaaaaagctatcatttgatctcccacctcgcatagttcacaagctgtgctgtaagcctagctgggactctttccagcaaggtgtgctgaggcctaaacttcttaactccatgagctcactgctgtgtcatttataccccttgatgtgggtgagagattgaagttgcatgtggtcccggcaccatggctcaagcctgtaatcccagcactttgggaagccgaggtgggcagatcacttaaggccaggagttcaagagcagcctggccaacatggtgaaaccctgtctctactaaaaatacaaaaattagttgggcatggtggttcgtgcctgtagtcctagctacttgggaggctgaggcacaagaatcatttgaacccgggatgcagaggtttcagtgagccgagattgtgccactgggcgtggtggcgagcacctgtaatcccagctactcgggaggctgaagcaggagaatcacttgaacctgggaggcggaggttgcagtgagccgagattgcgccactgcactccagcctgggcaacagagcaaaactctgtctcaaaaaaaaaaaaaaaaaaaaatttgcaagtggatgcagcaccactgcactcccttatattctcaccttgactccgcatttctcccctttggaattcagagtgccaagccccggctggactgcttgattgaagtatacaggagctgccaggagatcctggcacaccagaaagccacatcaacaagcccatgagccccagcgttcagaaggccagcattgtcttccatgggagatgactcttaagccataggggctggttttccgtactccaaaccatcaggtggacacagtcctaggaaccattatggatgtagtgcatcttagagccatagagcaggtgactggaaatctaactcagtatatttccgtgtattatagtgttttccttgtaaggttttgcctactttaccaaaggaggggagaccttaagaattttgacacagtatgtcaaaagtaatgtcagcaaagaacactttcggaaattgctaagcatgttcaggtttactttgttgatgtttgtgaagcaaaacaatgggaaactgacatcagatgtcttgagaaagctatattttccaatagtaccccttgtgtaaagttacgaaaaaaacaagcccttcagtactggttagcaggaagaaatgtcctacaaaagacgagtctgtcaacctagtgcctgtgttctgtacagggcttatttatttactgttaataaacagatcttccaaaacacacagttacctggttcacagatagctgctttttattgacaaacaagatcatagtatttcagtcatggtgtcaagcacattaatacttttctgttactcagcatttttttttatatcagttcaaaagctacttttgccaagaaggatgagacaaaaggccagacagaaattggactttggttttcagacatgggactctcatgttaacaaagaataaataagcaaatattgaatcctttgtttctaagttagtttcttctgtataagattaataaactaaagggttcctgaagggttggggaggagagagggtgggggaaatagattgaccccaaattcagtgtgaacacagctccattcttgtttactcttcctttggactcctacttttcttctaaactctctgggtagataatgttatccttattggccttagagatacccaagatattataaaaccagagctgttatgtctgtcaccagccctgcaggaattattcaggaacctgtggtacatgtgacttgttcgaggtagaaatgtctcagctagatccccaagttgtggggtgaaaagtgtgaacagaaatggctgtaaaactacttgccttgcaaagtcaagtacatttaaaagaggcagaaacttggatctgcttcttttttcatcatgcttgtcagtttacggggtgagagaggagaagcttacagcagctgaggtgttcagataaactagttctggcctcgcagtttttgctgtgcaaaagatacacacattgttggggttaaaggcttggttttgggtgctactgctaaatatacagttttcagcactttactgacatatagtaaggctgccttagagctaggaaataaaactcagtttcctagatgttggaaaatcagagtatgaactctttcgttttgtttttgttaggggagggtgtgtctacaacctgtctagaggagactgtctagtctcctctgcactcaatcagaaggtctgaattgagggggattatggtattatcagtaaggcaaaagatgaaagaaacttttttttacctgctactcttaggctagggcaaatgtcacatatgtaccctcaccctcaaactaattcccagcagaagtttgccagaagtctcaaggagcatatccaggcccacatgcctgaaatagtcttctgtgtttctgactcatttttggtggtcttacagcagcaaaaagcagagtgcatttgcttggtcttttacaagaagaaggaaacaaatgatggcccactacagtgaacacagccttcaccgagcgctgtccagtcattaaaatgagacagggaggggtcagattggacctacctcctgcccttgcttgcacattgcgtggtactgggtttggcctaaagtccagtgtgaggaaaacagcttgaatcttagcaggtatagcatgttatcctgcaaagactgccccagaaggggctgtaccaatgcctacataccaataatggggaaaaatgagtctattcttttttctccaactctgtcagcacctttcccatttgggaaaggcagcccagtttagtgagttctaggcttctgacagagtgtaggagaattggaaattttagtcctatcctgtttagcgacgttcacaaaacttcaagtataaataagaccatatacaatattaaaaaattagcttctgggctgggcgatggctcatgcctgtaatcccagcactttgggaggccaaagtgggcagatcacctgaggtcaggagttcgagaccagcctggccaacatggtgaaaccccgtctctactaaaaatacaaaaattagccgggcatggtggcgcacacctgtaatcccagctactccgaaggctgaggcaggagaattgcttgaaccctgtggactgggtgacatagtgacactgtgtcccccgccccccccagaaagaaaattagcttccttgagagtaccagtgcagaaagccttaacttatagcactgatgccctcagtaacagtggatcatccctgtctatgtctagaatcaggtagcatctggagtcattattcttatgaaaaaaggaataaatggttttaacactgggtctggattttaaaaagttgagccctgaaacattataaggcacctagagagtaaaggcttcacagagactaaaatacacatttcacagaacaagagtagccgggggctgttagacccgtcaca

SEQ ID NO: 13401 - DNA, 27667 bp, Human
actaagaattaaaagtttgattacagtcaaaagaagaaaacactgttcattattatggttgtgcaatgatttctcattctaaagaataatttgttccagagtctagctacagtgtaatctcaatccacatgctattaatttaggttgtgtgataatctaattgttcattcaccatttcctacttaaccttttttgacactcttcacagacactttttccacatttcttgatcatcccgggccatttttttttcctttctttttaattagagacagcgtcttgctttgttgcccaggctggcctcaaactctgggctcaagcgatcctcccaccttggcctcccaaagtgctggggtacaggtgtgagccgcagcgcccggccccaggctattgatcctttttttgcacctgccccttatttctgtactgtgacaagtcccagcattgtgctgtgggacttacacagtatactgactatcctcagacttggtcatgtctatgctcagtgcatattaagagcttaaccaaagtgtgttgaatcaacagccaatgaacttgatctaataaaaatgagggcccaggagatacaaattagcaaagcattttctcctgagcagtcatacatcttttaatatttgtaggcagtttaaaattgaactcccaagcaaacatttgagaacagacaccttgagcaaaccgtgaaatcggtgaaaataataatttattttaattttttgagatagggtcttctctgtcacccaggctggagtgtggtggcacgatctcagctcactgcaaccactgcctcccgggttcaggcgattctcctgcctcagcctcccgagtagctggggttacaggcgcccaccaccacgcttggctaatttttgtgtttttagcagagacgggggtttcaccatgttggccaggctggtcttgaactcttgacctgaagtgatccgcccgcctcggcctcccaaagtgctgggatgacgcctgagccaccatgcccgacgtgaagacaggaatttatacccatggagtgcaagaagggaccttgtaatttttaacacgtgacacttagtggcagatgagacctaatgaagccaggcccaccttccacaccagattataaattcccctggagcagagattaaatgttttattcaccaacatgcccagatccctcgcaatgcctacgcttgacaaacacctgttgtcaacaagtgcacgaggcagcctaggaggagaattagtctccacgaggagaattactcgggcctagcagctagagtatttcgaggtcatcctaactgggttccacttttgaatttttggtttttgggttttttgtttttttggagacaagatctcgctccacttgggagcaaggtctcccaaagctggagtgcagtggtgggacctcagcctccgggggtagctggggccaaaagtgcgcgccaccatgcccggttcttattttgggtttctggtagagctctcgctattgtgcccaggctggtctcgaactactgggttcaagcaatcctcccacctcggcctcccaaagtactgggattacaggcgcgagccactcgcccggccgggttccacttctgaaagcttggggagccgctgggccttccaagaaaagtgctccacctcccgacggcaggcagagcccctggcccggctatctttccagggccgaaagctaacagtcaagacgcgaaacgaggaattcgggtcagggtggcaaagcaaagcgcgatgacagtgaggacgacgtctagacgcaaacatacatcaaatcgggccgaagcccgctgtcgccgcgcgggctgaacctggcacccggagcaacgcgcgaccccgggacgagacgctctcgtccgagccaaactacatcccccggcgtgcactgcagcgcccgcccctcgccggccggcggggcccgggaggaaggcggccgcgctgccagtcccgcaggtcccctaggcccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccggtgaggcgggggtgggccacgccgtggggagcgcagccctgcgcgctttggaaggaagattctcccaccttcctcccagacccgggcccgcgtctcctccctccgcgtcctcagacacgccccctagggctggcttgtcccagccccaggtctccctgctgccactgagagtaaattggacctcgggattcagttccctgggatccttctatggccttccacattttctcatcttttttcactgtggcaaatagagcagaggggcttttgcatctgcggtcctgtaatgtagagtgggtttctttcatagctgtttttgtttgttttatgcatttaaaagcactagtctcaagacaggtctagttttcaccagactgacagaggatccgtagcacagaaaaagggttaaaaacccaaaggagtcataatttgggggtgttggtaaataccagttattggagggtagagagctggcctttaaaacctgattgtggcatttagatgtggtcttgttttgaacgtttttacagctgagactgtttactaccccttaatttcatgattcaggttgctacaagttctgtctggaggagctagagttttccggccctaaatccataggaaaagctgctatagttcttggcctccggatatatagaatttgatggcaaggacaaaactttgttttattgcttttatttaagagtcagagcttgggtgtttgctcaacgaattactcaaggtcataggaattgaatgactggtgagaatgaaattcatgtatttaatatatatttattgtgaggctgctgtgtgctaggtgctggtgaattgtgaggcaccgttctaggtgctggtgaatattgcaaattacagtgaaaaagatacgaacatccccattctagtgggtaggtgataaacaatatataactattaagaggcagtgttaaagaatacaggaaagtaaatcagagtaaaagaataggggatgggacttcagttttattttattatttatcatttttttttttgagacagggtctcactctgtcacccaggctggagtgcagtggcacgatctcggctcactgcaacctccacttcccagattgaagcaattctcctgcctcagcctctggagtaatagggattacagttgcgccaccacccctagctaattatttttgtatttttagtagagacagggttttgccatgttggccaggctgatctctaactcctgacctcaagtgatccgccttctttgggacttcagttttaaatagggcggttgtgaaagtcctctctgaggagatggcgtttgaacagagacttaaatgaagtgagggagtaaaccagaaatcagggagaagtgagtgtcagaaggagggaatagcactgcaaatgcctttaagcagaaatgagcttggtgtgttcagcgaagagcaggaagttccatgtgtttgggatggagtgagcaaaggagagcgataagcagggccagatcatgtagggccttgtggaccatggtgaaagacttgtgcctttttctaaatatgatgggatgcagttaaaagatactgtgcagaagcattgtgggatctgatttatgtgattgaaaagtagactgcaggcagggtacggtggctcacacctgtaattccagcacttggggaagccgaggcgggcggatcacttgaggtcaggagttcaagaccagcctggccaatatggtgaaaccccatctctactaaaaatacaaaaattagccgggcatggtgtcagttgcctgtagtcccagctactcaggaggctgaggcagaattgcttgaacccaggaggcggaggttgcagtgagccgagatcatgccactgaactccagcctgggcaacagatcaagactctgtatcaaaaaaaaaaaaaaaagaaaagaaaagaaaaaaaagtagactgcaggccaggcatggtggctcacacctgtaatcccagcacttggggaagctgaggcaggagtattgctgtgttgaacgattttgagaccagcctgggcaacatggtgaaacctcatctctacaaaaaataaaaaaattagccaggcatggtggtgcatgcctgtagtcccagctcctggggaggctgaggtgggaggatcacttgggccctggagctggaggttgcagtgagccaagatcgcaccactgcactctagcctggaccacagagcaagactctcccaaaaaaaaaaaaaaatgtagactgcattttcaacctggcactgaattaatttttgcaatgcccatttctataagtctaaataatgcaaaagaacattgctttgaaaaatagaaaattgaattcattattactatggtttgaatgtccccctctaaaacttatgttgacatttatttgctattttaatcgcattaagaggtgggacccataagaaatgattagaccatgagggctccatcctcagagattagattgttatcctgagagtggcttggttgttgagagagtgggttagttcagccctctcttgcttgcctgctctcttgatctgttgcccttccatcttctgccatggggtgacccatgggtagcaagaaggcccttgaaagaatcagccctctcagccttgggcttcccagcctccagaactctgagaaatacatttattttctttataaattacccagactcagctattctgttatagcaacataaagctaagatagttacattcacctttgttgtctacccagcctttttctccatcctgcaaagaggacaatcagaaatatgtgaatttcttttcttttttctttcttttttttgtttttttgagatagagtcttgctctgtcgcccaggctggagtgcagtggtacaatctcagctcactgcaacctccacctcctgggttcaagtgattctcatgcctcagccttccgagtagctgggattacaggcgcatgctaccacacctagccaatttttgtatttttagtagacacggggtttcaccatgttggccaggctggtctcaaactcctgacctcaagtgatctgcccgccacggcctcccaaagtgctaggattacaggtgtgagccactgcgcccaaccacaaaatactctaagttgctggtaacagacatagttgtttaatggataagtaaagaaaatatatacatatccctagaattataataagtccaacaactttacctcttattcactacctcattcacactgctcaataaatgtttgttgaataaattgaatttatctaagcaaacacatggtgcctcatctctgaatcctctttttctagttcagagaccacatcataaagttttcagagctttaatgcccatcatgaattattaggcacagcataatgtacataatacagtccttgcatgtagcttatgctctgtaattgaattcagtcatttttcaataaacactgagaattattatgtatcagccactgtctgggctctgaggacttccagagttcttaccttaaaaagaaacaaacggccgggcacggtggctcatgctggtagtcccatcactttgggaggcctaggcgggcggatcacaaggtcacggatggagaccatcctggtcaacatggtgaaaccccatctctactcaaaatacaaaaattagctgggtgtggtggcatgtgcctgtagtcccagctactcaggaggctgaggcaggagaatcgattaaacccagggggcagagattgcaggcgacagagcgagactctatctcagaaaaaaaaaaaggtaacaaaccttacaaccaagtgtgtgattaatcctaaaataaagttctctgagaccataaaaagggctggacttgagcatggggaagagggggaagcttcaaaaaacttcaaactgaatataagggattgaatgggagtttgctagatgggaaatgcgaagaggcaacacaggagtaaaacatggaatactcccaactctggagcttagaatgtatgtgggaaagtagtagtagaggggcaggtgaaacagccagattgtgaggggatctcagtgtcacattgagacatttggacttgatatggaaagtcagtaaaggacgtaaagcagttgattgatgtggattttcttttagaaggagggcattaatggctagacaggacaagagagagcacaagaatctgggtacaggggactgtgttaagagccttttgggcagtcaccttgctaacgggaatttgtttgacacaggttctcactcctgtctcccgtcatccaggctggagtgcagtggcaccatcactgctcactgcagccttggcttcccgggctcaggtgatcctcccacctcagcctcccgagtagctgggaccacaggtgcatggcaccaggcctggctaattttttgtatttttagtaagggtctcccatgttatccaggctgttctcgaattcctgggcttaagtgatccacccacctcagcctcttaaagtgctggggttacaggggtgagctacagttcccggcccaagagttggttttgaggcagaaattaaccagcctcaatggatatgaggagtgagggagaaaggttccagggtgtctgcattttttcacttggtcaactgggtgaatgatgaacttaagtaagaaacataagaggagaagcagagtttgggttgtggatgagaatatcaaaggtacctgtagaacagagatcatgacataatatagccttacaaaatgtttcttcttctgccattaaaaataacatatgggggccaggtgtggtggctcgtgcctgtaatcccaacattttgggaggctgaggcaggaggattgcatgaggccaagagttggagaccagccttggcaacatggtgagacctatctctacaaaaaaaaaaaagctgagtagtgtggtgctgctcacttgtaatcccagctgctcaggaggctgaggcaggaggatcacttgagtctagcagtttgaagttttagtgagctgtcatcacatcattgcactccaacctgggtgacagagcaagactccgtctcaaaaaaaaaaaaaaaaattatgaagaagtatgtgaattgagaggccatatagtataatatttaacagcaagaattcaagagccagattgcctgagtttaaattcaccttctagtagcagtgtgaccttggacaggttactttaacccaattagtttttcctgccaaatggggataaatcatagtatctacttcacagggtttttgtgaggagtaaatgagttaatatatgtaaagtccttagaatactgcctgataatagagctactagccattttatttaaatgaaaattaagaataccagccctgtatacaactattcttacctttttttttccagagtacttattttctgacatattagacactttccacatttatgatatttacagtatattgtttgtcttcctttcactaggacagtggtttcattgtggtccatgaaccagctgcatcagcatcatttgggaacttgttagaaatgcaaattctcaggccccaccccagacctattgaatcagaaagttttaacaagcagtgtgttttcacagccctccagggggtttctgatgaaggctaagtgtgaaagccactgagctagaatataagctcaatgttgtctttttttcactgtgtttcctaagtaccagaacagtgcctagcacagactaggtgcttcatagatacctattggatgatggaatgtgtgaattgttggaaagaaaatattgatatatgattgtgatttatttctattctgttgtccacattttcattactttaaaaatgggtatattccacctattaaaacaacaaaaactgtatttctccaaagtacagtctccattcactttctgcctttgaatgatactagagacaatgtgtcctgttttaggaagtttttgtgtaactgtccattaccacttacaataattattaatccatttaatatttcattaaatacctatggccataatttctactcttggttttacaacctctgaagaggtctctccaattacctcagagtactataatgtgctataatttcttaatctaatcaatgttaaatgcctgtggtcatgatttctagttttggttttgtcatacctgaagacatctctccatatgtcttaacgtgtatcataaaaatattgaaagttttccattttaaatcatttagatcagtatgtataacacaagaccctattattttcagagccagaaaaaatagtcactatggagtactataatcagctggccgataaacaccaattacttacagactgtagaattttaactattctaactcctcattttttttgtttgtttgttttttgttttttgagatggagtgttgctctttcacccaggctggagtgcagtggcgcgatctcggctcactgcaacttctgccttccgggttcacgccattcttctgcctcagcctcccgagtagctgggactacaggcgcccaccaccacgccgggctaagtttttgtatttttagtagagacagggtttcactgtgtcagccaggatggtctcgatctcctgacctcgtgatccgcccgcctcggcctcccaaagtgcagggattacaggcgtgagccaccgcgcctggcctctaactcctcatattttctactgaatttggtttttgctcttaggttcttcctaagtatttactttcagaaacaatggtggtttctatttattgagcccttattatatttggcacttgctaagtgaatgttatgtgtattatttcttttaaccctttcaaacaacccttacaaggtcagtagtcttatagtccctatttgcagatgaggaaacaggttggttgagagggatctctgttgcttttaactcttgtatggtgtgggatctagtcagctgtcacggtgtacaaataaagggtgtaagtcctccattttgccacagtgaggcaccaaaagcaaagtaaccacatatttatgagctggtgaaactgaagttatttccacaactttaaagggccaagattaggcattcttgggctggaaattcaaatccccataaggaagagaggctgcccaccttggtcaaacattaaggtaggctttctgtagtgctgtttttcagagctgtctgtttccattttactccatgtcagcatccacccagtttcccaaaggagacagagttggtcccagagagtccctcacatgtgactgatttgggcaggcttgtggggtgggggatagtggtatttgaagtggttcattcttgttcatggtgcccattctccccaggatgccaccttgctgtttgtagttgattgtagcatcaattctaactccctaaaaagaggaagaggttttttgttttttcaacagattttaccagttgttaaaggctatactctgggagcacaaaaatgcccctcagttgtatacagtatacagttgtttaatatacagaaaagccttggactgggagtcagcacacttgcattccagaactagtgctgccatacatttgctgttccaatgactgtggggcaggcactcagtttctccagggtctagtgtcctcagtggtaaaggcaggaagttagactagatgatcgctgaggtacatcctagctctagcattcattggtttcataattctgagcctaaagaatttttaaaaagctgctattgatccctctcagttgggtagagatcagtctcttgaattatctgcctccctggctttatcatcacaagaaatgatttcaaaggtttctgttttgttttgttttaaatcttagaagtccagaaaggatctcataaatgtagtgaagttctgtaaaagtatgttgttatagagcacttataagaggaaatgtgttttatgaaatcaggtaggaaatggaatattctagcacacagaagttagtgaaaggagagaggttctgtggtcttcttctccccctttcatttatgtagttacattcctggaatcattctagaatttgcctcttgagaatgcggattttcatacccattaacaaaggaagaataaaggaggagaatttatgactaaacacagttgtagaaaagtctaggaaaggaaggagctaggaagggaatgtacatatgtgtacagtactgcttcttactgtctggcttggatcaggagtgagcatgcctgagtttggagatgtgctgactcagagcagtgatgatgctcagcacttttgggacagcttattacaaaataatacaatactgctccatggaagtagccgtttttgactgtcggtattatttcagtactggtagctaagaacacatccccctcaggaacagtaatagctgccttggtgctcatttcagttacatcatagatggtcaagagtcataccatttgccatggtgaaccttcctctacctttttttaaacaacaaacagccatgggttttgtgagtggtatggagaaaattgtctgaagtatcttgtgtatattaagggggtggcacacaacaatgaatgagacatagtaaagggtgtgttgtcatttgccctttcaggcagtagccacatctaaggaggtttatagttctaggatctatggcacagtaaaaatgacaaaataaatttccatgtttcagaggaacttggtctcaagttgagattatagaatatacgcatccaaaatgatttatggtcacttaaaaagtgggatacaaggacaggtgtggtggctcacacctgtagtcccaacactttggtaggctgaggtcgaggattgcctgagcccaggagtcaagaccagcttaggcaacatagtgaggccccatctctaccaaaaaaaaaattagctgtgtgtggtaacctgcacctgtagtctcagttacttgggaggatgaggcaggagaattgcttgagcaggtgggaggattgcttcagcctgggaggtcgaggctgcagtgagccgtaatcatgccacttcactccagcctgagtgagactgtctcaaaaaaaaaaaaaaaaaaagatataactgacattagatgctgttgtgattaacaaaatgtaaatccatataaagcattacagtgacattacatcttatgtaggattgggttcaaaagtcagggcttggccgggtgcactagctcacacctgttatcccagcactttgggaggccgagatgggtggaccacacaaggccagcctggccaacatggttaaaccccctctctaccaaaaaatagaaaaattatctggttgtggtggtgcactcctgtaatcccaccactcaggaggctgaggcatgagaatcacttgaacccaggagttggagtttgcagtgagctgagatgacgccacggcactccagcctgggcaacagagtgagacacagtctcaaaaaaagccaggtcttaagatgaaaatcagagtagacaaatcatctaagaaaatctcaggacagcaactgaatacccacatgccatttctccataagcccggctcatctgttctcttttgcagcggaaaggctgaggtggatggatcacttgaggtcaggagtttgagaccagactggccaacatggcaaaaccctgtctttattaaaaatgtaaaaaaattagccgggcatggtggtgggtgcctgtaaccccagctgctcgggaggctgaggcaagagaatcgcttgaacctgggaggtggaggttgcagtgaaccgagaccgagccactgcactccagcctgggagacagagcaagactctgtctcaagaaaaaaaaaaaaattgctctttagttggtggaagtgctgctggcttgtgtttaggagtcacattgaaaaatacatagctttaaaaggccatatccccatacgtgcaacagcatagatgaaccttgactttgtgctaagtgaaataagctaaacacaaaggacaaatattgtatgattccacttaatggtgtacctggagtagtgaaattcatagaatggggaggtatttgatgggtacggaatttcagtttgagaggataaacaagttctggagaacagttagtggtgatggctccacaacggtgtgaatgtacctagccactaagctataccctcacaaatggtcaaaatggtaaattttatattacatgtattttgccagcctaggtgaccagtgagactctgtcttgaaacaaacaaacaaacattgtaaatgatggtaactttatggtgataagtagattatgtgtagatttccagggagaacagtcatttggatgtataaatttttttaaaaaatcaagctcctcttaaaaggagctaatttttgcttgttagatataagggaatgacctacttcctcattttgtagtcaatgaaggagaatgtgaggtcccaaagaaatgaaggaaattatctaagtttacatgctgaggcaggcctgaacctggcaccagaacctcaccccgctgactaaccagaaaaggtgcttgtatgcctttcccccatacaaatgtttaccaggtgacagcattctggtaccaccttcataatttttgccatccgcaagtatcattattactgtcacttacattttatttatttatttatttattttgaaatggagtctccctctgtcgcccaggctggagtgcagtggcacaatcttggctcactgcaagctccgcctcctgggttcacaccattctcctgcctcagcctcctgagtagctgggaatacaggcgcccaccaccacaccaggctaattttttgtattttttagtagagatggggtttcaccgtgttaggcaggatggtctcgatctcctgacctcatgatccgcccgcctcggcctcccaaattgctgggattacaggcgtgagtcaccgtgcccagccttgtcacttacattttctttatgtcaacttatttcatgtaaaatacatttatttaaaacaatgttatttaaaaatgaaacttgctatcatattttagatggaaaacctgtagtataaactatcagaaaatacaattaagacaatactgttttagttagatgtttgttttgaagctgaagcctgttctatttttgttcaaaggggagattagtaatttttaggtattaaagatacactcaaccaaagggacagaatgggaaaggctgaaaggggaatgaataacgttctcatcgttcaagtcattgccggtgccacacccagagaaaaacaagcaccacaccagacagcctctcagcaagccgagtaggtggaatttttattttgcagaaaagtagtgtacgagttaacatagaagtggttcactgtgggagtggtgaggggtttcagagagtcactattggtaaacattctttttttttttttttttttttgagacagagtcttgctctattgcccaggctggagtgcaatggtgcaatctcggctcattgccacttccacctcctgggttcaagcatttctctacctctgcctcccaagtagctgagattacaggtgcctgccaccacgcccggctaatttttgtatcgttagtagagatggggtttcaccaggttggccagggtggtcttgaactcctgaccttgtgatccacctgccttggcctcccaaagtgctgggattacaggcatgagccaccaggccctgccataggaagcttattcgaagcagagggaatggcctttacaaatgtgtggaaacagtaataagcatttgaaacttatctatcttttctagaagaaaagaagaaattgatcagggattttgatgaaaagcaacaggaagcaaatgaaacggtgagaacaaggaacaaattttgtttcttctacctggtgttggtcttttccagaagtaatgctatgagctgatcacaaattaactgttcctgtccattgatcttgattttgactatttcttactaaatgaagccagttgatggggatggttgttgagggggtttggcaaacaaatgggtgaagcctgaagatgctcctgaaatgtgactctttggtaatatattgctgatgtgagtagtaagggcattctcatacttttacccaagcagtcttttaaaatctgttgtttttttttttgttgttgttgttgttgtttgttttgagacagagtctcgctctgttgcccaagctggagtgcagtggcacagtctcggctcactgcaagctccacctcccgggttcacaccattctcctgcctcagcctcccaagtagctgggaatacaggtgggcgccaccacacctggctgtttttttgtattttcagtagagatggggtttcaccgtgttagccaggatggtctcgatctcctgacctcatgatctgcccgcctcggcctcccaaagtacagggattacaaggcatgagccaccgtgcctggcctaaaatctgtttttaagagctggccattaagataggttactggtcagtgcggtggctcacgcttgcaatcccaacactttgagatgccaaggtgggaggatcacttgaggccagaagttcaagaccagcctgggcgacatagggagaccccccatctctaccaaacaaaaaaaaattaccgaggtttggtggtgcatgcctctggacccagctactcaggaggctgaggtgggagatcacttcagcctgggaggtcaagcatgtggttagccacagttgcaccactgcactccagtctgggtgacagagtgagacctgcctcaaaaaaaaaaaaaaaaaaaaaaggttactgttctttgttaaacctactgtcacagaaaatgtagtttagaggtaattctaaccatgtccctttctgtcttaagagacaacataggagctggagttggtacctcaggcaagacatgcatgagtctcagttggtacccaaagtttgtcagaagttggttccgtttactgaacagtttaacaactgcttctcttcacctgtggcttttctttaaaaaaaaaaaaactttttttttttttttttttttgctctagccctatagaagcaagagtcctttgactccatctcatcatactctagcttcagcaaactcattaagattggggccaaaattctggtcgctgctagtactccgcagaaatagttggccctgtatttgctacccgagagcagatggagaaaaaattctcttttggccagcgaacttccttcttgcttgttgaagatcagtgtttcaatttcccacttatcccaatgaagttctgagaaggaagcacatctgcatccttttctctgttttgcatctgttttaagaaagaccaggccactagactgtgggaactatcttcttcctaatgggagtactgggagcttttcttaatacctgtgtacagctgggcatatccatgatacctgtttgtagccattctcctgtttcagttaataccttggtagcatttttaaaatcttctagctgctactgatttgtttgatgctcagatacttgttttctccaaactcagcaaaagtaataatcctatgctgcccattccaggcagatgaaaataatttagggcctcttgtggatgtgtccaggtgttacattttacttaccccagaaaaatggaagtctgattcccctaaagcagactgctctgggtaggcccctgttctctctgacatggagacaaacttaattgattttcagaaagaggagcaggagaagggaagaaccctgatgccagacccctatcatttttaatacagtagacttcaaagcacttcttgatggcaatgttcaatcataccaggctaaaaacttggtatattgaagagagctgagagaatttgaagattttgaatcctgactccttttctgtttaattttttatatatatatagagatgaggtcttgctatgttgcccaggctgtgctcaagtgatcctcctgcctcggcttcccaaagtgccaggattacaggtttgagccactgtgcctggcccggactcctttttgtgcgatcttcagaggtttctttaagtcttatatatgaaatggagcatttcctaccttattgatttgttgtgaggattaaatggagaatgtatataaaagtgtttagtaagctataaagtacttctgtttttccattcattcagttcatatactcgaatgcctgctctgtgcttgctgggcactatgcaaggcattcagaatgaggggaacatgccagacatggtccctgcctcatggagcatatggttatttacttggtgtagtccaaataaataagtagtttgattagtccaaactaggcatatttccaaatgagtgagggaagaaccaggctatctgctcactactttctgccttcccagctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatggtaagttttagctgttttgtttgttttttttttcctttaagggcctgtggtacaaaaattaactatattgttggggtatttcatgttatcagtgtatactagactcttgtttcatttttttcacccttatcctcttttctgcatccagttcctgttaccccttggtatctgctctatttaaggcaggcctttcgaactatatgcatatttagatttctttttatccttaatataatacagtcttataataaaaaaaaaacagtgctttgtatgtagtagaatgtaaatgttacctattcttattatctggattctgactcattgatctaatttcttttctccttgatcttttttattctctcatataaattttagaatcactttctcaggtatgcctggaaaattcagttaggtttctaatttatcagaatattgttacaaaatcaatccaagctttcctttaccttaatgtcaagatggcccagcaactgagatacagtagccaatgcagggcgcttctcgagaaggagctttttatcattttattctgtggtaatagaaagtgagcaagactccctctctagctttcaggattctgatttataaaattggactaattgaacatctgtattctgaaaccatctagagcagctagatcgttaaaggaataaaacgtctgaaagattaaatgtgctgcatttggtctgtcttccacaaacacaacacaaagtagaaattctctggcaagtagcatggcagagaaatggaaaggggcccaccagtgcagactgaaaggctcatactacaattttaaacaaatcctgtttcacgatgcatcctgattatagtttaagagatattcaggatgatattggcttgacattgctgatgccaaaactagatcccttgagaatgaagtacttaaaattttcaaatggatgcgcgagggattatcacagattagaagctgacagaagatcacttgtaaagggagactggaaacaggcaggcaggtggagctggttaaagtgggagttgtaaaagtgactttagtcatgttgccaaagttggggaggaagtccaaacaattttgctttaaaattatgagtttcagaaattattattattttttttgagacggagtctcgctctgtcacccaggctggagtgcagtggcgcaatctcggctcactgcaagctccacctcccgggttcactccattctcctgcctcagcctcccaagtagctgggactacaggcgcccaccaccacgcccggctaatttttttttgtacttttagtagagacggggtttcaccgtgttagccaggatggtctccatctcctgaccttgtgatccacccgtctcggcctcccaaagtgctgggattacaggcatgacccaccacgcctggcgagtttcagaaattattaaaacataatttaggtatccataccttcagaaaaagtattgttccaaatctgtctgaagttcatttatgtgatctgatcttttcttaagtcattttttagcctactcagttgaaaatctgcatcttttattttgaaaacctttttccttcttcctttgcgctaacctaactggttttatttgaacctcattcagtggtttcctcgtctactggtctgtatgccatttattaagtgaaaatgctacagagcgccgggcacagtggcttacgcctgtaatcccagcaccttgggaggctgaggctggtggatcacctgaggtcaggagttcgagaccagcctggccaacatggtgaaaccctgtctctactaaaaatacaaaaattagctgggcgtggtggcgggtgcctgtaatcccagttacttgggaggctgaggcagcagaattgcttgtgcccgggaggcagaggctgcagtgagctgagatcttgccactccactccagcccgggcgacagagcgagactctgtctcaaaaaaaaaaaaaaaaagaaagaaagaaaatgctccttgctacttctgttctgggagccaatcttttggctccttgatggtcctactgccagtggtcacttgctctgtactaggcctctgtgagctgggtcccttttgattttgtgtgtgtgtgtgtgtgtgtgtgtgtgcacgcgcgcgcgtgctttgaacagctaagaacttggagctgcctccgtttctgtcagtggttgttaattctggcctgacaaggctacttttttcttcctgctgtctgtatttaggattacaggtggagtaaaacttcggtggggatttagaaaattagggcagttgagaaattagggcaggtggggaagcttgctcaagccccagatactaatttccctgagaccaaatcacccccagtgtggcaggctcaaggttttttgtttgaccttaggtgaagttctttctggggctcaccaagagggtaaccacatacgttttttccagaatgtggtagtgtctcagacttctacatgctttctttagaagctgaaaaagaagaatgtagtcatctaggcaataccactctgaacctgcctgatctcagaagccaagtgagtcaggccaggttagtacttggatgggagaccacctggaaataccaggtgctggaggcttaaaacgaagaacagaatagcttattcatggtccgtcaatcctcagtaccagtctagtgggaatcttcagtgaattaacctttttctagggctgcagagtttagttggtttgcccatagcactatcgaagttacaggctatatgcattatcaggtagctcccacatctgggctgccacctttcagaagttgatagtccaggaggcacatggaccagttcagattcattacaaacacagggaaagtgctccagtatttttaatccatctttccttgcctcgcgtaagtgtaaaaggcagtggagtgggggtattgtgatcctattgattggatttcaggtcctgctttagtctgtgaccttgaaaagaatcattagcttctttggttctgtcttaaaaggaatgaaaattattgctcactatatcccttctaacatggggaaggtgatgaggaatatgctggcaatgaatttataatggaaaaagtctaacatttctcttccatacttctttcagaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagagtaagtctgggcagacagggaaaggggcaagtatggggtaattagggggccactgcacctggaaaccgtactaaggccaaaagctacagcagttctgtattcagggaatagtcttttttaagttcttatgcttttctcaatttttatttattaattttttttttttttttgagatagagtctcactgtgtcacccaggctggagtgcagtggcgtgatctccacttgctgcaacctccgcatcctgggttcaagcgattctcttgcctcagcctcctgagtagctgggattacaggcatgcgccaccatgcctagctaatgtttgtatttttagtagagatggggtttcgccatgttggccaggctggtctcgaactcctaacttcaggtgatccacctgctccggcctcccaaagtgctaggattataggcgtgagccactgtgcccggccgctttgctcaatttttagtttgcttggctgagagatgtcccttagaagcaattttacccctaagatttagacatcactggaaatttttgcttcagtgaggggaaaaaaagatggaaggacctgatttctacacttacaagattacagaaattaataaggataaagtggctgcattctctctttggcaagagaaataatatgtcaaaaggcacttaaggattcaaagcttccaatctgagattttaatttctcacacatctaatagggtattctgctattcttacgaaaacatcatctgcttatatcctgttatttagagccaaggctgttttccagatttcataaaatagtaccacagtttatagatttataaattatgcttcaatcctggactataaccctttactgttatgtaagtaaaagtaaaaaaaaaaaagtaatagggaaaaaaatgtctaaggattatccagtaaggtaagctggatcattgtggaaagaaaacaaatatttaaatcaaatgatgactatatcagggatctctagtctactgtcactctgagagcctcagaaaaataactcatttattttttcctttccataaatgagttaacctacataggaattttttagttttttagagacagggtcttgctctgtcacccaggctggagtgcagcagtgcaattttaacttactgtagcttcaaactcctgggctcaagtgatcctcatgtgtagctgcgatacaggcatgtgctactgtgcctggctaattgttttaattttttgtaaaaacggggtctcattatgttgccaaagttgctctcgaactcctgggctcaagcaatcattccaccttggcctcccaaagcgctaggattacaggcatgagccactgtgcccagctggaatttttttttttttttttttttttttgagatggagtcttgctctgtcgcccaggctggagtgcagtggcgcaatctcggctcgctgcaagctccgcctcccaggttcatgccattctcctgcctcggcctcccgagtagctgggactacaggcgtctgccaccacacccggctaatttttcgtatttttagtagagacggggtttcaccattttagcaaggatggtctcgatctcttaacctcatgatctgcccgcctcagcctcccaaagtgctagaattataagcgtgagccactgcgcccgggcaaaattttttaattggtacaatttaccaatggaatgctgtattcttaatagcagaaggcaaatcaatttgaaaaacatactgtggccaagatttggacaggaaaatactagctcagtgtgaagatttgagtagattttcttaatagcttcagttctccattaagtcagagtaatgccctgccctcttcagtgaaaattcacaataaagtactacattcaaggcaagctatggagaatgtaacttgcttacagattgtgtgggttttggtttttgaacataccaggtagattggttgaatttaaaagccaaggaggccgggcttacacctgtaattttagcactttgggaggctgaggtgggaggatggcttgagcctaggagtttgaaaccagcctgggcaacatagcgagacctcatctctatagcgagacctcatctctactaaaaatcaaaaaaaggagcagggtgtggtggcgtgcacctgtgatcccagctacttggggacatgtggggttattgcttgagcctgggaggtcgaggctgcagtgagctgcgattgcagcactgcactccagcctgagtgacggagtgagaccctgtttcaaataaataaaagccaaggaacgagctgagaggtcagcttaccaaggccactggggaatgggaacagatggcaagtagccatctgctggaggtgaaatatcctccagctgtccagattagtagcaagcagttgaaagttccatggaggttaattcttttcacagttcaatgtaactgtctcttaagagggtaaagaaaaaaaccagatcccaaaagcagtaacagaccagcctacaaaaacaaatgccaactcaagaggctgtcctggaatttggctgatgaaattcaaatcttaagttgctctacagtcactggctggccagtctgctggctacacttgaagccttcccttttggagtagccacggtagaagattagctcagtctcaggagtccatccccagcagcaacctgggaagatgattcttaagcctacttgatgagtactaaaatatcttgtcctttccaggttcttctacttacactcaaaggccatcatttaaattggcttgatttcttggaatttttcaacatatatcccttaatgcctactgttaatctagggatattcaattgtacagagtatactttttaaagagggaaataatcactattttctcttctcagctggtaaacacaagtgaaaacttgagcaaaagtcggaagattctccgttcaatgtccagaaagtaagttttattaaagtcatgaaatttctcttaactcagtggctttcaaccaaaaagcttaaaatagtgacttacaaaggtcctcataaagcacctcagcagttgacgcatagtccctgtatactcagtaccacccagcagaccagaataaagacgctaaggaatatggtcttggataattaaataactcaggataaaatcatttgttaaaagtatatactgctttgacttggagcagtgaaaaatttctccactgaaaggacatttaatcacagctgatgttctttagagaaggcaacacatgggaataacagcttcctattccttgaaatatatttatataatctcagccccatgcggtggctcatgcctgtaatcccagcaccttgggaggctgaagcgggcagatcacaaggtcaggagttcaagaccagtctggctcaaatggtgaaacccgtctctactaaaaatacaaaaaaattagccaggcgtagtggcgggcactgtaatcccagctactcaggaggctgagacagaattgcttgaacctggggggtggaggttgcagtgagccgagatggcaccactgcactctagcctgggggacaaagcgagactccgtctcaaaaaaaaaagaaatatatttgtaaaatcttgattagaaagtagttttcacttgcatagtacttgcttttggctctgcttgcccttcatgggagtcagctccttttctggaagttctatattgtagggaagaagtagacttttaaaaataaaacccttgtggagttgtcagggttcttgggcagtaactgagtcaagatgctgcagaatctgctggcactgtcaggttgcccagaggaccatgagcattgcttcatgcaggcattttgaaaataaaggtccagaaaacacaagctgtttcaggagaagaatggaattccagtgcatctaaagggtggtagagctgatgacctcctgtatagagccaccatggttctcagttagtgaaacagcatatgccatgcatcagctggctgtggtttcatttcccaagaaatgggattgacttcagtcatcacagcagtgacttgattcagtttcattcagctctgtatggactcctagtccatagagaataaataagtccttctttgaagacaatatttgaattgtactaactgccaccaatacagtagtctttaccaaaaataaaaaacaaaatcctcgagtgctaacagcaacaaatccagggcagaaatactgccactgaggttgaagttgggggtaagagggtattgtacgtgaccttgggcacaggtggcctagcatgaaacaaaactacaacccactcatggaactagcaggaggggtgggattttcctacagtgataaattccttgtggactagggagaaacctagagtgaacatgagaaccagaggttggattctttatgtaaacaacagataggaaaatttttaagctcctatactacctttataacatacccatttgggttgataggagagcaaagggaaaaatagggcagagggaagaagtttacaagggattgaaaggtattacccaggcttctagttacttatcctagggcaggacccatcctgagctggatgtctatttgattactttttctagctaacccttctttctagaaaagctatttttaaaggaagtaactactatttgaacaacatttcagaatccatttttatgctttggtttttattgtctcagtttaacatttctgtgaggtagacagtgttatccctaagtgacagctaaagaaccttatgagtacttcctgctaagtggctgtgtgatcaaacatacagcctcagagtatccagccgtggtcccaggtctaaccccaaaatgtttagaaggaaggttatccaaacttctgactactccccactttgcttctctttgtagagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctggaagaacaaagtgtgacaaaacctcaggttcccttgctgctactctcagtgagggtcatcccactgggacagggagaacaagccaaagtaaaaacaagagtccattttatagtagaaaatacctatttttaggaagccccttgcacctcatcctcttggccatgaatttaagttaaaacactgttgtgctatagtagattaaaagaaaccttttaagataatgaaataaaccatccctgttcaactaacataacaggcataattgtcaggcgttctggaaaaggaaaaggcttggtgttgggtgggggaggttttcatcctgcttgttggcaaaatgtatgccacctccagtatgactaggaaccttccagatgcctgcctggaaatgaatcaagtatgaaggcagaggaaatctgccacttgcactagccaaactgcattcccacttttgaactctaatgtgttatctgtatctgttagagcaccacaccatatgccctgaaatgtagttattactgcaaacttcattctcacccctgcaggcctgagctctggaggcaggttccacatctaacaacatctttttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtggcacaatcatggctcactgcagcctcaacctcccaagtagttgggacacctggctaattattttttgtagaaacggggtcacactatgttgcccacgctggtcttgaacccctggggtcaagtaatcctcttgccttggcctcccagagtactgggattataggtatgaaccactgtgcctagccccatgagtgtcttttggagtaaaatattgtagcataggaacaaagagacaagccatgccatatataagtgctagaggttattaacccctgct

SEQ ID NO: 13402 - DNA, 27430 bp, Human
ctcaaaggacagaatgaggaaaaacaacaaaacacccccacagagataggaccacaataaaagggtctaaatgtcagggtcaaaactgattttctgcttcctcactgaaaagaaaaagggaaagccaggcgcggtggctcccatctataatctcagccgccagggaggctgaggccggaggatcacttgagcccaggggtttgaggctgctgtgagctctgatcataccactgcaccccagcctgggagaccctgtctcttattaaaacaaacaaacaacaaactaaataaaaataaacaggatgaggaggagaaagggagcaagttgttaggcacatttgagaaaacgtcaaaattttccttacaaactagccaaacacctacagtgatatgccattttcctgacaaagaattcaggccccaaaagaaaggcagcccacaactgagcgtattcccaagcatgagttctttcaagaaatatttttttgtggaccttctatggattaagacactctttcatcctggagagagcccacagtctagtgggagagaaagacacataaacaaatatctactttacagcgtgatgaccggtattaacacaggtctgaacaaggtgcagcggtgagagagcaaaagcagtgcctcagaaacacagggatatcctctcacagcaggtgacatttggcgggatcttggaaaatgagtaaggggatccaagatcgaatccgagggctatgctagggcgattcgattccatccccactttggcttagggacctcttctatatcctcagtaaacttcccttctcagagcatttattaaaacctccttggcctttccagacgaatgtctggctacgtaaactgtgagctctgtagggcagaggtggcgacggttcagttatataaatccagtgcccggctcaataagggtatgtggaatggatgaatccattaatgaataaagacagcagacctccacaaaagcccgccggccgggcgccttttcctaccggctgggatcgcttcgtccagcctgattcactcaggaggaatgcgcgaagaggccgtcaggaagcctcgccctagactcaagaaaagaacctgggaaaagctcaggatcctcccaggaaacaaggaccctcactgtggcccagggtctgaagggaccgcgctccgggttcctaaacctgtgaaagcggcttatcccattcctttacttacattcgcgagggaaagatttcaattcggtctttgcccgacattctgacgataacttttcggctcgggtccccggccgggcaaccgaggctgcaatagctccagaactggcctccacagtgtcttcctctacgggagtcagctggttgtgtcacttgacccctcttgttgctaagaggcagcagggacacccattttcacttccgcttccggttgtcacaggcgacgaagggggaggacagaacagaggcgttgcccggatgtcgaggcgcgcgcaccgcggaaccacccctcaattccggttcgcctcccaacccctccccatccagcttccctgcggctgcgcaatacgcggcacgcgccaggccaaagactaggagcgaagcgtgcacgccttgtctttctccacctttcgtctttggtcacagcgccatctcatggttagctgaaactttgaaagaggattcattcttcagaggcaaggaatcggagtcctatgtctttctcgcgccttgaaggttacttagctaaagctaagatagcgagaaacagtacttttcaggtccttccatgatctacattcgtccttgttctcggaggacccagactctatggttaatgatgaagaggggcctctattcgttcagcgcttgcgcatgcgaggaggttccgcatgcgcggtggagtgagcgaagcgcacgctgaggaggatcggcggccggtgagggggaagcaagtctggtctctgtgattgaagaagtcggctctgggctccagtgcgggaatcacacacatacctcaggtgactaatcccaagctcggtttctccaggaactcactttggtttgtgtccagtgacatgggtgttcgagagcgggtaggccccgggctaatacctccctttcccgtccctgcgcgggaagtggctggacagcaccgccaccacccgcgctgtcgtgggcctcctcgccggctccgtgtaggtcatcctgtgttccagaggcatcgttgttcgagcagaggaatctcgtgaaggaaagtgggccgagtggattgtacagcctctacaatatgccgaaagtgagaatgccatgacgatggggcggtctcaggagaacgctgtgacaccgtaactcttaaccccggctcaggacgctgagcactttgctttttccaggcttgagaattccatcttttcttccgccccaacagctctaccaaaaatttcccctgcgtctcagtggaaaccaaactggcctcttacctgagaaacctgtgggacgggcaccgtgttggaaagagcggggtccgagtagtttttcatctgataattgaatgagtcaccccttgaaccaaaactaaatgagacttgagtttattactgttactatcagtttgtcgtattttggcgacaatgagaatagaactgtgttaagcatatgttaggttaactatgttagttaagcataactaaaacctaagataaggatatattttcgggttaaatacacagtcatgctgaggtctctttatcctcaaaacttaggctttttaaatttttattaagcaaaaaacatggtttcttcgagaaaaagtatagcagagaagtctttatttcccctcaattgagttgttattcaaggaacaatctctgtcaatagtttgggggtgacttgtacagaactttgctacctattcttagttcatctggtgccaaaagatgtagttgtctcatgcacagtaatgtttgtagagattcggtgataactttctttttcaactataatgatgaaataaaagctttacttatgtagcactcctataccaagaactagcattcagagagcattcctaatacgtgttagatccaaattagaattatcacgagagttgtccccatcacataatatattttggaaaggaatgtgaacttctatatccattatagcagtttgaccatgcactgttttgagaaagaagtcctacctaccatttgtcatgcaaaataactgactatgcagggtatttgaaattagcctggagtttggttgatatattttgaaaggtggctgatactttttacatcagaacacataagagtattatagcatgttgtgatattgaggttctgtgggttaaagacattctggatttgatgtcggattacttgagtttagctcctacgctagtacttattaagcatttgttcttaaggaagtattataatttagtatttctgttccacctttcctgttcattgcttcactgtgccctttcatagtactttgtattgtaattatttgcttgctagtttgtttcccactctatacttaattacttaggtaagagtcttttttttttttcttttttcttttttctttttttttttgagacagagtctctgttgcccaggctggagtgtagtggcacgatctcagctcactgtagcctctgcccctgggttcaagggattctcctgcctcagccactatagtagtgggattacaggtgcctgccaccacacccagctaattttggtatttttagtagaaatggggtttcaccatgttgaccaggctggcctcgaactcctggtttcaagtgatccacccgcctcggcctcccaaagtgctgggattacaggtgtgagccactgcgcctggcctggtaagagtctttcttgttgtatcattagtgcttagtacatagtagctactgaaaaaaaaattaacaaattattatattacaaaatggaaataccttctttttctttcaatattttatgtttgactagcacataatggttttcaaaatgtttttacgtatacatgtgataccctcagtaaacctgtgatgtacatggcacagatgagaaactacagttcaaaggatgttatctttcccaagcagccacttctagtaagtagcagagcaaggactggaacacaaggctagagttgttccccgagtttactatgttaattgcctgatttgacacttcttgaggaccaaataaaataagaatgctgtgaaaaagataaagaggtgaagtcacctagtgtgacttcgatattgcggaatgatttttttaagttaaaaaaaaaatttaagttattagcatttcattaggcaatatgttcaaaaattgtcaaccaatatgcaggtttttgtggtatggattctttttgtacttaactactatctatctttactatgaataacataccatcaacagtattcctttacttaccctttatgttgcaaagagacttgtgcctcctgaagaaatagtattcatagtcatatcccttcaggattctcttacatgattgcccatgttttttaaccatcaaattaagccttgcttcccctaaaagcatcacctttactgtttggagaagcttggtaagtaaatgtggttttcactggtcaaatgtcttgcaactgttccatacatttctgtaacatagtttatttttatgcccaatttgaaactttttagctctcaaatttgagagctttacatacacatattcaacaacagtttccccacccccaccctcgaaaagccctgtttaaaaacgaaacaaacagtcagctgtttcttggtgggtaaggccattgaatgtctacttctctttatttgctaaatccctattttgtagggattttgtattccctacaaagaaatacatctctgctactgtcattaatatgctgctctttgttgtcaaacagatgagtactaatagtttgcacttattggtgttatgtactctggcactgaatatatattaatgttgctttttaagtaaaatgtttctaattataatatatttatgaatagttttgagagaatatagtcttactgataagaggacagactctggatccagacttcatggattcaaatcctgactcatcacctgttagcagtatgtgaaagaacaagtaacttaacctgtgcttcagttttttaatctataaaatggggagaactagggagaaagttgtaccacaaggagataggcaatggccagatcatataggattctgtaggtagtggaaagatacataagtcagtgggaagccactgagaagatataggcaggtgccaattaataagttattatatgaattttcacaaggttttcttaggcctttaagttctgttactacctacgttttgagcagtgacaacagtgaaggttaacagaaaaacatgaaaatcatcagccatgattagtttgagagcttccttttttaaatatgcttctacccaggctatgatttcaggcttgtggatcataaaaggagtagtgctgaaagtaggttgggtggatcaaagggaataattgtaaatatctttaatgcttggaggttaagagaaacttgaactttgtagtaatggagattaaagctattctcaagattaggtatacctattcaataaaagaaaggaatatttgggagtattggggataagagaagctagacattgtgaattcaaggaaaaagaattatgagaggaggatgcattttagtttattttgtgattaaaatttttttagtttttgttgttttgacatgtgacactgtaattttggctataataaatgacagaatgtatcatttggtatattggttagggtttaggtagaaaattttttcctttatatagtgagtggtagcgtatacaatgtttgctcacttcggcaaagagtagctttagttttctgattagttataatagtgatgcttcccatcatttgatatgccttaaagtagtattttactcttgaggtattcctttaatccttaggtcttggagtactttatagatggtcattattttttatgattcctctgaaactaaaggcagagaatcacccaagcattacaaaaatgttgagcaaaataaaaattaaagcttggttcctgaacattatctgttttctggtaccacttaagaagtttcaaaggatgagaagactaagactaataactatttttttcttcatcttttctttcagtggcaggatgtggaaattgattttttttttattttcaccttaactgaatacttacttaattcttttgtttaaattgcagaatgccgggtctaagttgtagattttatcaacacaaatttcctgaggtggaagatgtagtgatggtgaatgtcagatccattgctgaaatgggggcttatgtcagcttgctggaatacaacaacattgaaggcatgattcttcttagtgaattatccagaaggcgtatccgttctatcaacaaactcatccgaattggcaggaatgagtgtgtggttgtcattagggtggacaaagaaaaaggtaagtgagaaaaatatctgtaatataaatttcagatttaaaatggtttatttaaaaatacattttttgtaaattgcaagctgcagcttaaaaaaaaaagctccttttatacttaaaccttttacatacaaagttgttagaaaaggatgccaattagctatctaagcaagatctcttaatagtagtttaattagtacatcctaggattttatggatcagataacttgaattttatttctagtgtttatcaggatcttgataattgactcatggtaaccaaacttagagacaggtaagtcagagtactagttcatttacattggtaggcctgaatatgttggatgcctttttcttgatttaaagctaaaatagtaatgagatcactgggtaagcatgaaaatggggcaaatggattttagggatcttttatataagctttgaaaaagcaatatactatgcgtgtatatacacacctgaaatccaacattgtatatcttgctggtaattagaatgtttgcatctaccagatctcgtggtatctttcagacagttttggatgagcattcattttttacttattggatgccttttctgggccccatgtaaatcatcacctttgtgaatactctttttttaaacatggtgtacaataccattacgtaggttttagtttcagccatcttactataatttgttaggtgttagttttaggtcattagttaccatcatgtccgaaaggcttcatatcagtcaccttgattcaacttacccttctgaatctcctcagccgtctggtttactgatactttctcacttctgcaagtgattaattttatacatactgacattttaattttttttattatagccttagatgatacatagattttgaggatgtcttatgccttaggtagtgactgctacttagcacatggattgttttaaatgttttgctatgacttagctatagccccgcccaaaattattaaactactttgagactatttgttaaacttaggtaagtcttcacatcactgtcctagtagtacctaaagtagtgtctaatcttgtactttttttttttttttttaagaattggggtcttgctctgtcacccaggctgcagtgtagtggtatgatcataggtcgctgcagccttgaactcctgtgttcaagtgttcctcaagcagtcctcccaagtagctggaactacaggcatgtgccaccctgcccagctaactttctttgtagagatggggtcttgctgtgttgcccaggctagtcttgaactgggctcaagcgattctcctgccttggcctcacaaagtactgggattacaggtgtgagccactgtgctcagccttctttttctattgtataaaatatacacaaaaggaggaatcaaatatgtttttagttgcaatcagaaaaaatatggaatggcatacttgcttacgtacagtagatacatgtaaagatatttccatagcatttgtttgtatggcattaactaaaaccaggaaatgaccaaaatggggactggttaaataaatcagtacaaatgcgtgcaatgcaattttatgcagaatgagatctgaatattttgatatggaagatctccaggataggatgagaaaaagcaaagtgcaaaagagcctgtagagaggattcattttgatactagagaattatgtcctcctagacaagcctttcaacgtaaatgccataaaccctgaacaagtatgaaaaataactacctaaagacaatgagaagcagccaaaagcaggccaaaattgaaaatttgaaggtgagtcgacacttataagaaagggtatgttttctgttttacacctttttttttgacctaagtacatgctgaagacagcttcaagccaggcagctaaggttctagcagaaaatttatggtcttattggctttagaactggaggcgagagttgtagacaaccatagtagatggaaactggtggtgatagtggtgagggttagagaaaggaggcggcaggcacaaagggagatcccctaagtctatataaattcttcccaaatctctggtttgtccctgaactactgaaacacagggtggactccaggtagcctaataggggaaaaatctgaacagatttcagttgcttaccatctggggagacagagcttatagttttgagttcagattctgactgcctgctaaaacaaaaaatctatattctctttttttgggggatggagtctcactctgtcgccaggctggagtgcagtggcacgatcttggctcactgcaacctccgactccctggttcaagcaattctcctgtctcagcctccagagtagctgggattacaggcacacaccaccatgcccagctaatttttgtatttttggtagagacagggtttcaccatgttggccagaatggtcttgatctcctgaccttgtgatccacccgccttggcctcccaaagtgctgggattacaggcgtgagccaccacgccccaccccatccaggtcactttgtgctaagtgttctacacttggtcagcattctcataaatacggtgcatggaatggaacacggtgggcacgttgcgtgaactcacaaattcaagaccagctggggcaacatggcaaaacctcatctctacaaaaaatacaaaaattagctgggcgtggtggtgcaccctgtagtcccagcttctcgggcggctgaggtagggggatggtttgagcccaggaggcggaggctgcagtgagccaagattgcaccgctgcactccaacctgggtgatagaaccagaccttgtctcaaaaaaaaaaaagagagaggtgaaggaagttctttaagctgaagagatgtgatgacctgacatggaaaatatataggtaaatgtaaaagactatttttgcccttcttagtttctttaaaaatatatttaactatttgtctcatttgtgcctgtgggattgtaatctatagaggtgactgagtgatgacacagtccaatgcccttgaaagaaaacttttactacttatattgcctgagagaagggggcttgatgtgccatgcagggccacatggggaagcaccagttttagtcaggagtcacaaggaactaggggaaaaagtaggtcagagcttttgttggagtttctgcaggaaaagcaaggcagagcagcgtaaacggcttgcagttggctagtttgaatgcttttggcgggccttggggcataaagactgccctgcttgtctaatacctggcccttgacttacagcagggagaattttggcttggtgtatgagtttatgggctccagattggctgctctgcataagaaaggcatgctaccaagcaagccctttgctgactcctccccacctgacggaggggcagtctctccacaaatgtcagagcctcaagaatacagaaaataagaaaatatttagttactactaataatattaataataaaatatatagttaatacagttggctctgtgattaatggatgccaagtagttaaatatagaagctaagaaaacagaatactgtttaaagcaggcttagtacacttgacaacttaatcacaaaggccaggaggtgtggggtaaatagatctatatgattcttaacgattcttacattttatgtgcagtagtaaaattaaaaggttaaggatgtatattgtaaattctagaacaaccattaaataagccagttgcagtggtctgtgcttgtagtcacagctgttcgggaggctgaggtgggagagtcacttgaggtcagtagttcaagaccagcctgggcaacatagtgaaactatctctagaaataagtaagtaaaatacaaaatacactattgtaaaagccaaagatatattaaaatggaattctagaaaacattaacctaaaagaaaactcaaaagaaaaaaacaaaaaccagaaagaacaaatagaaaacaaatacctaaaatgtaggtattcaattattcagttattgatacaactgaattcatttatatcagtaattaaatgtaaatcaagtaaatattccagctaaaaggcagagattgttaggatgaattaaaaagcaagactcgacgataatcctgtctacaagagatatacttggttgaaaataaatggatataaaaagatatgctatgcagacaataccttaaggagacagtgtctattaatattagataaagtagatttaaagacatagtattttcagatttaaacagggacattttgtaatgataaagggtcaatttgttagaaggaaaacaacagtcatcactgtgtatgtgcctaataatagagttcaaaatataaagcagaaattgaattcaagagagaaatagacaaatctataatcatagttggaagtttgaacaagctctgaacaattggagaaacaattagatcaatgaagaccttgacttgtttgatacctagaacactgcacccagaaaaggcaaaatacacattattttcaagtgtgcatgacattcaccaagatagacaataaggtgagctataatattaatacaactctaaataaatttctaagggttggaatacaaatatgttctctgatcacactggaagtaattttgaaatcagtgtcatatcttgggagggaagagtttgcagtattaaataagcccttccaaataattcatatattaaagccttaagggaaaatttatagctttaattacttatattagaaaagaataaagatctaaaacagttatctaggcttttgttttagaagataaaagaaaggaaaggtaaactcaaagttgctgagaccagctctgttggggagaccctaacccagaggcgctagaggaattaaagacacacacacacaaatataggggtgtgaagtgggaaatcaggggtctcacagccttcagagctgagagccccgaacagagatttacccacatatttattaacagcaaaccagtcattagcattgtttctatagatactaaattaactaaaagtatcccttatgggaaatgaagggatgggccgaattaattgcagcaggaacacgtccttaagacacagatcactcatgcttttgtttgtggcttaagaatgcctttaagcagttttctgccctgggcgggccaggtgttccttgccctcattcctgtaaacccacaaccttccagcttgggcgttaggaccattatggacatgtcgcagtgctgcagagattttgtttatggccagtcttggggccagtttatggctagattttagggggctttctcccaacacaaagtaagtagaagaaaagaaataataaggataagataatcggtgaaaatagagtaccagaaaatcagagaacagtatcaaagttaaaaacttgttttttgtttttttaaaaaagagcaaaattgataaacccctagttaggctgatgaagaaaaggaaataacacaaattaccaatctggaatgagaatggggctatcactgcagatgctacagacattaaaaggctaataagggaatatcattaccaattttatgccaatcatctcaacaaatcaggtgaaattagtgaattccttgcaaaattttacttactgaaactgaccaatataaaatagaaattttgagtgtcctatatgttagagaaattgaatttattgtaaaaaatcttttcatcaagaaaattcggtcctgaccagcacagtggttcatgtctgtaattccagcactttgggaggttgaggtgggcagattgcttgagcccaggagttcaagaccagcctggaaacatgacgaaacctcatctctacagaaagtagaaaaattacccaggcatggtgttgtgcacctctagtcagttccagctactagagaagctgaggttggaggattgcttgaggccaggagaacaagtctgcagtaagccgaggtcatgccactacactccagcctgggtgactaagaccctgtctcaaaaaaaaggaaaactctaggccagatggttaaattgatgagttgtatcagacatttaaggcagaaataagatgagtcataataaaatttcagaaagttaaggaggtaggccaggcacggtggctcacacttataattccagcaatttcggatgctgagacaggaggatcgcttgaggtcaggatttcaagaccagcctggcaatatagggagaccccatctctataaaaattttaaaaaattagctgggtgtggtggtgtgtacctgtaaagtagttccagctacttgggaggctgaggtgggaggacggcttgagcccaggagtttgaggctgtagtgagctgtgatcacactgctgtattacagcctgagcaacagagcaagactgtctcccaccaaaaaaaaaaaagttaaggaggcgggaacactttcgaaatacagtcatgtggtgcttaatgacaaagatacattctgaaaaatgtcttatcatgcaaatttcatagagtgtgctgcttacatagaccttatagcctatacacacataggttgtttagtatactctattattcctaggctacaaacctgtacagcatgttactatactgattaggtagttgtaacacaatggtaaatatttgtgtacctaaacacagaaaagatacagtaaaaatacagtattataatcttaacagcactgctgctatatatgcaatctattgtttactgaaatgttatgcagtgcatgactaattttatgaggccatcataaccctgataagaaaacccaacaaagacatgtttttgtaaaaaagcaaattactgaccaaatatgtgattagcatagataaaacaattaatatgtttttcaaatccaacaatgtataaaaaggataataaagcatgaccaagtggagtgtatggaatgccagtttggtttaacagtcataactttatgttggctgggcatggtggctgaggcctgtaatctcagcactttgggaggcctaggtggggggatcacttgagcccaggagttcgagaccagcctgggcaacatagcaggacctcacctcttttgttatctctcacttctttttatttaaaaaaaaaattaaaaaatttatgtgtgcttttatatgatcagttaattaacaaaagtacaaaggcagctgatcaaagaaaaaattatctttttaacaaatggtgctgggacaactggatgtccatatgcaaaaaagaacctcaattcaaacacctcaccttatacaaaagttagcttaaaatgaatcatagatgtaaacttctaagtacctctagaagaaaacaggaatctttctgaccttggattaggcaaagatttcttagatagcacactaaaagcgttatccatgaaaggaaaaattgattaattggaccttatcaaaattaagaacttatgttctttaaagacactataaagagaataaaaagacaaaccagcatattttaaaaactcttgaacaacctaaaaaatcctgtatctaggctgggagcggtggctcacgcctgttatcccagcactttgggaggccaaggtgggcagatcatgaggtcaggagattgagactatcctggccaacatggtgaaaccccgtctctactaaaatataaaaaattagcgggcatagtggtgcgtgcctgtagtcccagctactcaagaggctgaggcaggagaatcacttgaacccaggaggcagaggttgcagtgagcggagattgccccactgcactccagcctggcgacagagcaagactccatctcaaaaaaaaaaacaaaaaacaaacaaaaaaaccctgtatctaaaccatcaatttttaaaggagcgaaagttttgaatagacactttgccagagaagataattggatagcaaatatgcacatgaaaagatgttgaacatcattagtcattaggaaaatgcaaataaaaaccacagtgagatgccactgcacaatcaatagattgactttttaaaaatcaattgagagacatggagcagttctaactgctccacattgctcatgggaatgcagagtgccacattcactttgggaaagtttggcagataaaattaacatgtacttaatatataacccagctgtgccatttctaggaaaatttatgttcacagagaaacttgtgtccagtttttagtggcttcaggggtgatggaacttgattttggtggtggttaaatgactgttcttttttttaaacacaaagaacttaacactaaaagtggtgaattttactatatgtaagtcatacaatttttaatgaaaaagaatgctcagaatctgaaataaaatcagtgtatatgaacagaatataggaggaaaactacaaccaatttaatagatgtgaaagggcatttgacaaaatttgtcacccattcataataagtcagcaaacaagaactaaaagggaatttcctaatctgataaagagtgtctagaaaaacaccacagacatgctgtcctccagtattgagaacaagacattcactctcaccactgttactcagcattgtactggaagtcattgccaggcacaggtttgtaggtttcagccatttttggctatttgacgttgacaagttacttaacctttcatgggttttagtttcttcaggttaaaaagactggggggcgctgtgggaaagagagtgataatctaccatgcaggattgttgtgagggttcaagaagatgtttaagcacctaacatagttacttgtatatggtagtcatacagtagattagatagttttaatttgttcagtgtgtgtgtgtgtgtgtgtgtgtgtgtgtgtcttctgtgacgatagcctctttccttaaactaaatgaacatcttagtgaattttcctattctggagaaggaaaaggaagaaataggggaaagataggcatttgactacctttcatttggataattgaaaattattagttctctccagtaaggtaatggaatatatataattacctgataataaaaatttatttctgaaaacaattcagaatctctcatcttgtacagattgagtatcccttatccccaaatccaaaatgctccaaaatctgaaacttttgagcaccaacatgacactcaaaggaaatgttcattggagcatttcagattttggattttcagattcgggatgctctaactagtaaatacattgcaaatattccaaaatctgaaatccaaaacacttttggtcccaagcatttctgatgagggatactcagccttgtaatacttatgcagtattttgttgataggattttagtaggaaataattataagtatgccaatcaaacacttaatttggtcttcaaagctggttacaatagtacagtggcatctggacagagatgattttttcacaatttttttgtacaggatatattgatttgtcaaaaagaagagtttctccagaggaagcaatcaaatgtgaagacaaattcacaaaatccaaaactgtaagttgatctttgagtcaaattagtccactatctgtgtgtttaataaataatttgaaatcttaatttcatactgctactaccttaaagtattgcttatgatctaatattctcaaattagtactagaagtgttttgaagccgttttaggttaaattaactgtgggtgacttcaactgctttaacttgtttacagttggaatgcctcataaaatacggggtttttttgtttgtttaaatagaaatgaggtctttctattttgtccaggttggtctcagaccctgagcttcaagtgatccttgagcctcagccctccaaagtgctgggattacagaagtgagccaatgcacttggccaaaatacagttcttgattttcaaccctgttctgggatgagggtaacggagacaaccagctgttatatgttaagaatgaacaggggtttataaaatgtctgtgaatccaggaaagcaaggcagaggcctgttactagttttggtttttttccccctccactagcgtgttaggattatttctttttgcattcttatttttgctattacttcctgcttgtcatccacagtaagcagcagcaaagcaaagatagccatttaatttcttctgtcagtatttctcttttctcaggtcctgtttaagttatccttcatcctctacatcctcagttctgtgtgtgtgtgtgtgtgtgtgtgtgtgtgtgtgtgtgtgtgtgtgtgtgtgtcacaaagtctttcccagactggagtgtagtggcgcaatctcaacttactgcaaccacctcctcctgggctcaagcgatcctctcgcctctgcctcccggaatgtttgagattacaggcgtaagccagtgtgcccagcctatcctcagttcttagtggtactgtttgtattgcttctgttttctttgcccttctctggtgtctgttcttttctgccatgagtgtttctgtcctcaagataaaatatcaaaaaaaaaaaaaagtttcaatgaagagattttaaaaaatcttgcttaatcccagtaagagagaaaataaaggtctaaaagccatcagttacccaaatcatttcctttgttttactgatgtatttacagttatgcagtgtggtttacacatttgaaaacactgtcagtaaaatatcttcttaataaactctaggaccttaccacttagaatgtagtctctaaactagcagcattgacatcacctgtttttttagaaatacagactctcaggtcctactaacttttgagaagcacttttctgggaaaatttcatatttttttgtctccttaggatattgttaaaatgagtgtgttaatagatcttattgagatgttaaaatggaagagttattcagtgtcagtaccttttctcactcaatttttatgtgtaactatgatgaagaccttaatactttttgtctacaccctgttaattttaggaggtaagaaaaagtttggcaggtgggtaagatgacagaaaaaaaattttttttatcgtgattctctcctcagggagtaataataacaacttgtatttgtatagccgttttccatttatagtgtgtggtttctatatatttgatctatgcgagcactctgtagtaaggagagatgctagtttcttctttttccagaggaggaaacaagttcagagatactgtgttactgtcaagacttgatccaggtcttaggaccctaaattgtatactatctctactttttatacccacttaaagtgagtatttccctatggagatcttttattgttaaggaattattgtagccaaattatgttatttactaaaatgtaaaaacattttttataaatctcttatctttgaattgttgagcttttcattttatttctaggtttatagcattcttcgtcatgttgctgaggtgttagaatacaccaaggatgagcagctggaaagcctattccagaggactgcctgggtctttgatgacaagtacaagagacctggatatggtgcctatgatgcatttaagcatgcagtctcgtaagaataccttcttgactctccttctaccttgatatcacaactcttggcctgatatttaacagcatagcatccatgtataaaatacttgccaaatttagattaaaatattttgtattggccagtaaatgggccaatcctatatggtcaagtctgtgtagttttatgtatcatagttatgtagattcataaaccatatggtttatctcacacattttcctttcctagttattgtcctaagtggctatgggactaaagagcatgtctcaccaaaaactataacctcttgttttctctacctcttttgactctcctttgactttcagcccacaccactttagccagtcttccatgtagccttagcctgggccttactatcaccgggatttgctctgccactaaaatctttaattcacactttctgttcttttgcccctgcctcctattcatctagctcccagttggtcctattatttgtcatcttaattctgtatgttaggatctgattccaaaccttttttctccctgtcttttcgccatttcctgccttttctctcttatccaacataggcacaccatgatacatcattttaacgactttgttgccattattgtgagcttttgccttgtttttccttccatccatccagccttggatcaatgttcctgccttctctgtacttgtagactgctgggtgctactaggaaaaatcagtcttgcaggttggtccactgcatattcatggtctccagcctcagctgttccacattctctctgctcctggtcagttcttcagtagtggctattttagagcttttccacgttcttcctcagaaaaccactctatccctgctccctgcctcttggctggtatgctcactacctattttattttataaagaaaatagaaaccattgcacaagaactacttttccactgtctcaacaaacttacatatctctgtcccacctgtcatttcttcctatgctgctgtcactggaatttgtgtcctaattgctctcaaactagtcttgccacctatgcccagctgctgctcagagatctctattagttactttttctcttgggtcacctttccctttattgcttttactccatcagcataaaaatatctctagtttcttccatttatactataaaacccacttctcaacttttcctttactttctcttggagcaaacactgcgtcctctgcttttaacagccacacttggctatgtgtggtagctcatgcctgtaatcccagcactatgtaaggctgaggtgggaggattgcttgaggccaggagttggagaccatcctgggcagcatagcaagactgccatctctaaaaaaaaaaaaaattaaaagtagccaggtgtggtagcatttgcctgtagtagtcccagcaacttgggaggctgaggcaggaggatcacttgagtccagtggtttgaggtttctgtgagctgtgatttgtgattgcaccactgcactctagtctggatgacagagtgagaccttgtctcttaaaaaaaaaaaaaaagccagactctttcagttctctatacttgctgtctctttacctcccactccttcctaaatgttaagagttagaggggggaaaaaagagaatgagtaggacccaagaccattaagagtcccccagaaagccaactcatctggggttccaaatcccttcaagtttattctcatgtgactttttttttttttttttttttttggtatatcacgtggtagaaaaggtgggaatagtaataatgataactaacatttatataattctaacaacaacctgtggtataaatgctattattatccttttcttacagttgaagaaactgaagctgagattaaataatttgttcaaggtcacacagctaacaaatcatagagccaggcagtattcaaacgcgtgcattctggctccatccagagtttgcactattagccattaaacacaactttatatttctgtcctgcagtcctcagtacatttcttaacttgtctcaactgtcatcatctggcttctttagttacctctttaacttctagttccagcaaccccttgttaccactaaaccttggcgtgtgttattcccttttccttagcactcttttcttgcttcattcatgtagggactgtccagatttaactaatgctagttctttgcatttttcttttaattacataaaatttctgacatagttggaaacaatgttttacctttccagacctattttcctcacttatcagtgataaccactattctgaaattatgtatcaatatcatttgtttttattgttttactacatatgtgtctattatcattttttatttaaaatgtaacctattgtatctttttgtagcttgcatttttacatataagcctattattaagcaggattcccccacaatgatagatgtatacttgatccatattaatctctatatagtatttcattgtgagaatatgctttatctgttcctctattaagagttgtttaggtaattttcccttctgtgccatttgtcaaacagggctgtgatgaatagtgtatgtgtctctatatgtagttgtttgagagtttctaatatatatgcctaggagtggaattgttgggtcataggattgattatatatctttaaactgacttggtttcaccaaatccttgccacaatttggtatatatctgattttttctcctttttctagtctaatgaattcacagtagtatcttttgatttgcatactcctgattgttggagaggtcaacagtttttcatgtttcttaaccatttgtatttcttctgtgaaacatctgttcacctcatttgcccattttctgtttatcatcttgtttcttatacatttatgttggttgtcttctcgttactttatgttagctgagtaaaagttccctccacccaaattctcttgccttttattcccaataagaccccttgcttattaagcctgatgcttgctcatgctattccttttttacatgacataactttctttttttctttttcttttttttttttttttttgagacggagtctcgctctgtcgcccaggctggagtgcagtggcgggatctcggctcactgcaagctccgcctcccgggttcacaccattctcctgcctcagcctcccaaatagctgggactacaggcgcccgccactacgcccggctaattttttgtatttttagtagagacgaggtttcaccgttttagccgggatggtctcgatctcctgacctcgtgatccgcccgcctcggcctcccaaagtgtctttttttctttttaatagagatggaggtcttgctatgttgcctagactggtctatgaactcctggtctccagtgatccccctgcctcagcctcccaaagtgctgggattacaggcatgagtcactggtgcccagccttatgtatcataacttttttacaatagttctacctttactttttacagtgctactcctcttttagtctttatttcatattttcatttgctcactcattcaacaaacatgccagttaataagaccctggtccctgtcctgtggcacttaggagggtcagatgaaatgctactttttgcatgaagcccttcctgacctcattaactggaagtaatacctttctgtcctgatgcccacagatgtactgttacatttaaaagtttttccatgttttttttttctattcaagatagattataaactccttgaggcagggacagctaattgcatggaagtaatcaattatagtagaatatcagatgtgttaggcattaaattgcttgttttagtcagatcactaaaattttgatttcactaataatcagttggggtgtaagtgcaaagctaagatttgaattctaattgtgacactaaagccttaactattatatgcattaactattatatgcttaactattatatgcattgttccatagtgtttggtttcacatttatcagtaatataaccttgaccttttgttatttatttatgtttttgaccagagacccatctattttggatagtttagatttgaatgaagatgaacgggaagtactcattaataatattaataggcgcttgaccccacaggctgtcaaaattcgagcaggtaaatgattttttaaatgatttttacagtattttgcatgcatcaaaaaagctattaaataatgagacttaccaaagaatatgttgctacatcaacatctataaatttttctaaatggttgttttttataacaaaagcttaagaaattattttggcttctgaatcataaaatttatatattgacacaagtagaaacagtcttgtgagttcagctaacctaaaggtagccctttttttaaaaagaggggtttgattgttttgttttagtgcatactttaaaatattccaaatttttacaaagatgagacataccatgcggaattttctccaactagccttttccacccagtgtatcataggtacccttccattgcagaacataggaatctttctcattcttttttatgctgggtaatgtttcatagaacagataaaccttaacataaacccgtcccctcctgatgaacatttaggttgtgccagttttctcacagttacaaaaaaatgctacaaattagcacccttatattatacatacttaaccatttacacaaatgttcttcaagacaaattcctaaaagtagaatttctgagtcaaagggtaatgcaatttctaaaccgttttagataagttgcagttattgttatattccatctttaccacactcctccttgcctcccttttataaataaggaactgcagtatagagaggttggattcagtataagtatttgaatactaatatatctgccacgtgtttgatttcctttaaacttttaaatattttttgcattttttatcaacttttgaatttttgtaattgtagatattgaagtggcttgttatggttatgaaggcattgatgctgtaaaagaagccctaagagcaggtttgaattgttctacagaaaacatgcccattaaggtgagtcatgagttgtctccctccctgctgaaatgctcacctaaaccaaataggatctttgatctttgtttctttttttttttttaatcacatttcataacaaaagtgggttttttactcttaaaattgagcagtggttcttggtaatatttctagatgtttgtgatttatgtttaggctttgttggtttctactgttactatcacagtggatggagattcctattggtagaaagccagcgatgccaaacctcctttacaataaagagttgctgtgcccaaaatactgagagcactttaaaaaagagtaacactttcttctatctgtacacatacaagttttatgaggtttgatcagaatctttcattagtgataaaattaactggatggctgtaactcagaaggattcttccatcagtttagttcagagacaaattatccattatactgatgataattgcagttagtttagccaccaaagatacacggaaatgataattctttctattcagtatcgcagtgaactgtttatactattgcattagatccctgtgttgatttgcttttgctacattaacaaatcaccccaaaacgtaattgccaattctgtaggaccctaaattactgtcctgtagaattggcaattacgttttggggtgatttgttaatacagcagattaataaaatctcaagcatcctaatagttgtgggttctgtaggtacattcataaatgaatttttgtctttctcttttagattaatctaatagctcctcctcggtatgtaatgactacgacaaccctggagagaacagaaggcctttctgtcctcagtcaagctatggctgttatcaaagagaagattgaggaaaagaggggtgtgttcaatgttcaaatggaggtgagatcaatagattcatttttaataatgactcaggaggttcctaaaaggagttcttgtaggcaaataagagctgtcggccttggaatgtcatattgtaggatggtcattcaggcctttgatcactaatggtgttagggtcaccccccgtccccagccagggggaagggaataaacaatataaatgagaagtttttttatggtttgaatttgcatgtggcatgtctaaaatttgatctcagaattggagaaaaaaaaagttgtctcctgtcttttccttgtccaacaagaaagaagtgtgtgtacgtgcgtgcgtgcgtgtgtgtgtgtgtgtgtgttatggttccttctatggaaaggactagtaagctagtaagtagtagtttgagcctggaagacaggtttttttaacaggatatctatttgtggtcttgaaagatacagccattggggttatttcatgttttcagttttagcttataaaaatgacagaaaataattttccattttaatacatacatcctttttctatactattctcataagtttcacctcttatttatgtaatggaatttattgctgataagtcactcaaaagtgaacagatatgacagagttgttagaaaagtgttaaagagagaaaacattaggcagtaatagtattgaaattaaatttgtatagtatttactacttcagtttgaaattatacctctgcttccacagcccaaagtggtcacagatacagatgagactgaacttgcgaggcagatggagaggcttgaaagagaaaatgccgaagtggatggagatgatgatgcagaagaaatggaagccaaagctgaagattaactttgtgggaaacagagtccaatttaaggaacacagagcagcgcttcctggctgtaaatcctagacttgaaagttttccagtattgaaaacttcaaagctgaatattttttatttctaagtatttaaatgttctaacagatcagaacatgaaatgccctcctaaatgtcagctgttgtcacacagtagctccaacactttgagcatttttaagggagtggcctcatttcactagagacaaatctttaagaatagttctaaaattgggcttgtgatttccatttctgatgtctccagattggcacccctttctagttcaatgcctcacgagatttgccaggggcatccaaggcaaacaatcccaatctttctatataaaatgtattcaagcaaacatcaaataaatttctgggatatttaactataggcttcttccttcttgtcaccagttaaaagcattttaatactaagaccctaattcttttatctttattttagtcttgatgtggaactgtaggagcaggtgaataaaggatctctataacagatcctttcaaaagaagagttttagagaaaataaatttaactttaaccacagtgaaagttgacccttagcgggacaaagccttaaaatgcattgaaagaattagatcggttctgtgccttttatctatttgagattgatgacaacctgtgtgagagaatttatcacaccacgtccttattggaataataagctacttgccttgagtttataattcagggtggtaaagtatgtttttaaattttaaaaagcagctgcattttttatttagttggaatatcacccaattttttatttttattgctattaaaatatccactagatgccacctagagctccagttctttataacaaaacagggatctgtttgaacacttactgttgtttttttttttttacatgtttccatcatttctgtctttaagaactaattcgtacataataagtttcataggtaacacattatttgaagttacagctacagtagtcaggtgtagaaaatcttgagttgctttggtctgcttgtcttcataaatttattctcttatgatacttgaggtaccagttgtatttaattttattcattatccctagatagctattaagatacttagattagacctaacccaccatagtcaatccaagactagactactcaatattaaagggtctggaaaatagaagagtgtgttgggcaggtagtttgtaccatttatgaaggtttgttcctttgttaaatttagcagcctgtactagcttttgaaatccagaagttttaacttccagtggctggtttctgagagagtgccatgattgctagccagcattccatattgggaatatgtagaggagaacctggatgtacttaagagtggcatataattttcacttctgtctgttgaggcatcaaaaaaacaagtttagaaagctggcaacatgaagaatgcattcaaaatataacaggtgcttctttgttgtacgcagaggaattttttcttttgattttgtttactgaaatttgttatacttcaaaagccataacttgaaaaatactggtggcgtcgatggtgagtgatttttatcccacgtgggccttttgctcagttccatggcaattttgtaaattgaccctagccagagaatagatcagtatttcactgataccacgaggaaaagaacaaacaaaacttaaaagtattcatacaccttgctaacctaaaagacagcagggacaagatacatatgaggacaaggtatacacccagttctgaataacttgaagaacaggcttggcaaagaagtaagtttatccaaatcttgaatttctgccaggcatggtagctcatgcctgtaaccctggcacttaaggggccaaggcaggaggatcacttgaggccagtgagctgtgatcactccagtgcactcgagcctgggtgacagggcaagaccctgtctcaaaaaaaaaaaaaaaaaccaaaaatcttgaatctcccatcaaagccttttcattaaaaatacaatttcatctactccctactgtacctttcactgatgtcaagtggctatcaattcatatagctgaaaattagtgatagtttgggtctcatttatgcataaattaattgaaaatcagtaatggccaggaagaaatatgaatattcaaaccacttttttctttttttttttttttttttggcaaatggtgttatattgcctgggcaggtctcgaaatcctgggctcaagctatcctcctgcctctgcctctgtaagagtgtgagccaccatgccccacccaaaccatttttcatatcagttatagcaaaacaagacaaaccagttcttaataatgttcaaagttggacccatagagacat

SEQ ID NO: 13403 - DNA, 6770 bp, Human
atttttatcaaatgttggtatcagagttattaaaatgatctgaaattctctcatatatttttgtttctcagcacagcacattttttctatacttctcataatttaaaaagcatataaattatttcttgagaatttgatgtgacaatcattaaaatatctaaggcctggtacattccatagaggcaatttttaataaacttttcaatttgttacacggttgttctcttcttgagtcaattttttataatgtacattttcccagaaaagcattccttctatcaaaatagctctatcagatcttctcagtttcaagagaagccagaaattttcattacagtagtactgcttttattaaaaataattttagacttatattaatgttaacatcttatgtaaccacagcacaattaccaaagccaaaaattaacattaagagattattagctaatttgaaaaaccaattgtcctattaatatactttttttctgcaacaggatccaattagatcccacattgcttttaattgtctcctttgtccttgttttttagtgttaacaaataagttataacactgccggactaacaagacctcagacctacagtttgctacttctggacaagtaaggcacagctaatgcttatgtcttgtgtattatcagcaaaagctgtcctgaaactaaatgcaaggctgatgagagtttaatagagtatagaaaagtgagtattcactatacctttactttctttaatttgccagagggatatttcttgcacttaatgtatcatgtagaaatcaatttttattttcttattctggtattctctacatcttgcatggcctagcatatagtatatgttgagtatctgttgaataaatgagtaaattctgacaaaaaagaaatgttggccatttgggaaaagtttctactagcaagaatgtatgtgtgctatatttttgtgcacacgtgatgtttttgtttattcatcatctattttcctttcttttggaatagtaacccaattttccttttggaaacgacttttcccaacactatgcagtcttgctgaaaccatcagtcaaggtgccaagaaatgagcaaatgactcagattagaccaataaagttttcctggaatttcaagccttgagcagaatgatattctgctcaatgaatggctggagctgattcattccattggcagaacactgaatggacctagattcttggaatttttctgattcctatccttcccatagcttaatttgttcagctttttcttctattttataagctacttccatccttccaatgaatgctcaccttaccgccacttggtttggctgtatttagtcagtgtcagtttctattgcttataaagaatgaaatttaagtatatatgaaaggggaagtgggaagcctatttctagattttcttccctaaatgagtagaaattagcaaagaggaaaggtatggtatataaaatccaagttctcccctcttccatatgtaagctaatcacatgtccttcataatattacagcttatttaacatccatatatcaactatagtattatataacagctatggatatatctatattacatacaacatatatcaatatcatataattatgttctatattatatatattacatatattaaatttaacaatatagctcaatataaaatagtgatacaagatatagcaaatgatacttttttcatgaaaaaaattcaagtagatatttcatcttggaaaacaataatcaagcatttctcaagctactagattaacatttactgaagttaatatcactttttaaacaggtatataataatctgaaaaatacattatttgacttccaaatccttggtaatagtgatccactatgttctaaaatgtcttaccctataacagtttgcacagttgaatcataatttaaaaaaaaaaacattttggaggtacctagtgtctgagcggcacagacgagatctcgatcgaaggcgagatggcggacgtgctagatcttcacgaggctgggggcgaagatttcgccatggatgaggatggggacgagagcattcacaaactgaaagaaaaagcgaagaaacagaagggtcgcggctttggctccgaagaggggtcccgagcgcggatgcgtgaggattatgacagcgtggagcaggatggcgatgaacccggaccacaacgctctgttgaaggctggattctctttgtagctggagtccatgaggaagccacctaagaagacatacacgacaaattcgcagaatatggggaaattaaaaacattcacctcaacctcaacaggcgaacaggatatctgaaggggtatactctagttgaatatgaaacatacaaggaagcccaggctgctatggagggactcaatggccaggatttgatgggacggcccatcagcattgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccctatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccggctaaattttttcatattttggtagagatggggtcttgctgtgttgcctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactcattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctgggggctggacacactgaggacaatgcggctatagcagatgaccatggcagtcagtggcagcagaaagaggcagcagaaggtgaagaggttataggtggtctcttgccattgagccttgaagctgcctttggtgacacactgagtgaaagggactgggccagctcagtggacggtgtggaacaggaacagctggagtggagttgaggactattagaactggttcccctcaccacccaacctacctacctatgtcatactatctcctcccaattcatccttaattccaagttaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgtgctttataagggatgatatttctaccacctcactcatatttttagctgaaatgattttcctggtatgtctgttattttgtggaaaaagaaatattgtgtaaaatgggtgctgccaaaattccaggccattttgcagtgactctgaagtgacctttagtagtaatagtcttatgtgcagtaactataatggtaaagaatattaaataataaaatttaacattttccaaatgcaaaaaaaaaaaaaaaccacatttaaactatttgcttataagactcttgatatatttgtgttatttttctttacatgtttacagtatggaatttgaacatcacaatacaaaataattcttattactggtttaggaatctgtgtttattaacttataataaaaatacatgcatttgtatccaatttcatttcttaacataaagatgtggtaaaagcattgaccatcaaatgtcatctctcatatattgatagctcagagaaaaggtaactacatttgaaatcctggaaaaaattgttaagccttcagcattcccgtgtcaaagtaatcactgtgactaatacgcagcaataaatgacaaaaaacagaaatacaaattgctgttttacattatgtcagtacttacaattgacctagtctctgtgtttggtctctgatgatcttaattctgaagtgtcatttcctttaagaactaaaggaaaatacagtgtacataatgtcccatgaaatcaaatagttgttctagattggtcttagttttacaggcagaaagaaacagatcatgaaagatgttaaattatgtaaatgaaaagttaaccctcttttagttttttttgtattctcccttgttatctaaaccagagaatacttagttgtgtttattaatagatgaaaattcgcaagaagtgaaatgcactttttgaggccaaagccaaaagatcacctgaggccaagagtttgagactatcctggggaacatacatagcaagacattgtctctacaaaaaatgttttaaaaattagctgggtgtggtggtgtatgcctatagtcccagacacttgaaagactgaggcaggacaatcacttgaccccaggagttcaaggttgcagtgagccatgatcatatcactgcattccagcctgggcaacatagcaagactccatctctaaaaatcaatcaatcgatcgattaattaattaacttttaaaaaataagtaaaatggcaacagcatatgtcaaaagagctagcacatcagtgtactttctataatccttgttctgtccagatcatctgtaccttccagaaagaagtaattctttttctaatataagaaaaggattgccacgtagttacattttttctttttatatggcatagaggagcttgcttcatttctcaataaaaaatttaatggcaatttctgaggcataattctctagattttactgacctacaaatttcagtagttttcaaaaagaattttaatcatttactcaacaaatatttatgaagtattgttatgtaaaaaatcctgtgctagatgttttggagacagggcaaacaagacagacttaatctctcacctcctggaacttacagcctagtagcaggtacaaacattaaacaattaagtacataatttttgtataattaaaattgtgataagttatatgaaggaggtatgcagggtgttatgaaaatgtagaacaggtattccagtagtctttggtagggaaagtaagacttctttgaggaagtggcatgaatcagtgaaaatcttattaacaaagtctatgattctcttcagatctaaagccacatttttggttacttttctgtttaagctagtctgagttgggtgtctgttacttacatgtgagaatcttaactaatacgccatttaatgtcaagtaagaagtaaaattacttttgttcaagatattcaggaaaaaacattattattagggtttaggttgctatgtgaagttcacttctaattgcaattaatttttcctaggtaatttttttcaagctcattccccaaagaaagtgtaaagaaaataattcaatatatccacacatatgttttttgaaactcagaaaaactatactttaggtcaaactaattatccactaggacaaaaatatttcaatttcaaatattttctttttttttttttttttctggagatggagtctcgctctgtcacccaggctgta

SEQ ID NO: 13404 - DNA, 237863 bp, Human
ctgcttctcacaatctttagtgctttctttgccttaatcttaagttttgggagaaaggaaaagcaattcacttcgcaacgtggttggggtctcatcttcaaagacgtaattaaaactgtcctggatagctgggcatcattacaggctcatgcctgtaatcccagcactttgggagcctgaggtaggaggactgcttgagcccaggaattcaagaccagcctgggcaacatagtgagatcccatttcttaaaaaaataaaataaaaaattagctgggactggtggctagtgcctgaggtcccagctacttagaaggctgaggtgggaggatgacttgagcccaggagttcaaggctgcaatgaattgtgatcgggccactgcactctagcctgggcaacagaaggagatcctgtttcaaaacaaacaaacaaacacacaaaaattgtcctagtggcaataaactataatgccatctgagtggatgacctcaatgtagtattggctaaaaattttatttgcacatatgacatattcattctttcaccagaagtttcttgtatgttatcagctgagcttacatgactatgcagttataaagaagtataaagcacaggctattaaatggtccaaaatataaagtactagagttgcctttgttcttgaagagcttcactctgaatcatgtaactggtctggatgtggtctttcaataagacaatagcagcagcataataagcctccgggtcagcatagtagcatagtatttggtgttacctattttagtaagtttatgtttggttaactcctgttgaggaacaatattatgatcaaagagatgatatggtttatttattagatgaatccttgatgtcttcatactaatgtaaagctctgtcacagcctgctttgatctgctggttcctgggtgtggtatccagctgtttgtcagcatccctctctatacccatggaaatcccaactgtatttttgggttttgggttccctaccaggttcactgtttaaaaatgtgaattgaatgttcctttttattgaaaagaacacaagttctatgatgagttaaaattactataaatgtttatagcttatactcattgtatcagattatttgaaaaatctagtttgcatgttcccttctgatggagtttgggtcagatgaaggtggttacaaaaaatgtttgacactaaaaattttcacattacactattgtttgatagtcattcattaattcttcacttagtctacttactcattaagaatcaacaaatctttattttggagatgaataagatgtgtcctttacagtgggaaagcttattatttaatagagctgtttacagacttcaatttgccttcttgataaatgtgatgaacatggtttacaatttacaaagatattcaggctatcagatcttggaattgcagaactaaatttttctgtatgtattcttatatgattttttcctaggtatttggggaaataaatactgtctgatggagtagatagctttttcatattttgtatctgcgaatgcatattatcagctgagctgacatgactatgcaattataaagaagtataaagcacaggctattaaatggtccaaaagaaagtaagtacaccgctcataaatctttgaaatcatgggaatgtttccagacagaacaagatggaatttatcttcctaattgtgacacagtaccttgaaaaatgcaactgggtgcgtggagataaggctttgtataatttgccattttaaaagttcccctgtcaaattcaaggtattaagttgctttatggaaggctaagaccaagccctagatgcaagaccgggggaactgactgccggaacgtttgtgttgcagcgcctcgccccttgccggtgctctttcgcgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctgtgagttgggcggcagtggattccctgggggagagacgcgctgggtgggaggagaggaccgggagatgctaggcctcgtcttgggagcaaagggcgttgttagtttcaacactggggaggaaaatgggaaaagaaggcgttgtgactttaaatagactgtagccgctagccccgagcggctctggcctgctttgaactgcgggttctcagtgtggcatccagcagtttgtcaggttcccccttccatagccaatgagtatcccgactgtatttccaggctttgtgttgtttactgggctctggacatcgctgattaaaagcgtgggggattggagtgtttatttcatatgaaatgtttttattgaaaaagtgcgaaagtgctatgaaaacttaaaatttgcttgagtatatactgctgctatttattgtatgagttaattaaaaaaccctgtgtgtatgcccacttgtcctgatggagttcggttagactcccatcactaaaatgaagaaaacccggactgtaggtagttaattttgaagatataataatggctggcatttgagtgcacattttgtgccagacagtgttctaagcgccttaccatgaattatctcagttcattcctacaacagtcccatgaagtagatactggtatttccatttcacagggaaggaaatcgagactgctcaaggtcccttattaagtgggccttgagagaattggaacccaggaagtctgactttagaacgcccattttcaggggaagggggcagaaggagggaggttgagtttgtgtattttgaaacagggattggtcaaagtgtttcttgccagatttcttgtcagatgtggtttagtgaaggtggttctagaaagcactttgagataaaaaggtgccatgtaatggcgagcatatattcctgtagtttctttcaggtttattggaggcaaaaaataatggataatctacagtgtgtagacaaggtctcctcccaaccccccaagtgctgacaaaaatgtagagcaatgacagggtctttaggtaagcataaattgcatgattagctgtagctataattattatatggaatttattagcttacttaacttttctaattgatctttattttcctttgctttactctgcaaagaagtatagtagagctgtgattgaatgatttaagattagaagtaaggtaaaagtaatcaagaagaatgcatggaaaagggaattctacatggaaaaacactgtagatagactgtttttagagagatttcgttcaatttctctccatttttctttatcaggtttgttatggtggaacaggaaagagagtttgtttttttttttgggaaggatactaactaaatgtaatttaccagaaggatgctaaatgtaattttctggcctagcagcacttagccattcagggaagattatacgatttcagtaacataaatggcattttaattgggcaagtataaaatatttattttaattgaaattgcttttgttgtatcctcagccctttttgttaagatctaagagttaagacttttgtctaattcattctggtgttgcatttaatgtggttaatttgctaacctgttagataacaggctacattttacagtccttttttgacttgaaatgtgaacaaaatgagtgaaaagctgtagcgtattggctgagagaacaagctttggaatgagcctgtctgatttcacattctttactcttaccggctctgtggccttagggaaatgactaactctttgttagccgttcttcttgttggtacaatagagaaaatagtgctgcttgtatcacggtccttaagtattaaataatatatggaaaatatttagagatatttagtattctgtcacataatatttgtttactatatattggctattttattattattattctttgtgtggcatgggtgataagcagaaataaaattaaaacaggacttatttggcctgctatgaaatacttgcacaataatgattagctttaaatgatttcagtacactatgaaatgtgaaaatacagctttaattataaggactctgttgtaattttcttaatatgaactctttagcatgttgtctaattaatcatccttttaaagaagtactttaatctaggctaacacactgctgtttctgaatggaggagagaactcactgatttttttggcaatcatttaaaaaatttaaaattatataagctattaataataaaagcaacgtaagttattaagtgaaaggtaaaaatttctgtggttcacttctccagaggtgacaacttttaggttgtttgtgtatattttcggatattttctatgcatatacaaacatgggtgtgtttgggtagaaaactttttcttcctttagcataaacaggaatatagcataaacatatatatatgtgtgtatatatatatatttccttgcttttttcattatgtatattggataatctctctagatcaatatgcatatgttttcctcttttaacaatttgatagtagtccattgttcaaatataatttatttaccccaatttttaaaattaatatttaattatccagtttttccttggagtaagcatccataaatatgcatatatatgtacatatatgtctttgagcatttaggccagtatatcataagatataacaggtaaaaatcacaaggtaatgtccagtagtagaattgttgggtcagagtttgtggcttttaaatttgataaatatggcccagttgttctcaaaaaagattatgtcaagacaggcatggttgttcctacctgtaatcctagctacttgggaggctgaggagggagggttcgagaccaacttggacaacatagggaaaccctatcctttttttttttttttgagaaggagtctcgctctgtcgcccaggctagagtgcagtggcgcaatctcggctcactgcaagctccgcctcccgggttcacgccattgtcctgcctcagcctcccgagtagctgggactacaggcgcccgctaccacgcccggctaatttttttgtatttttagtagagacggggtttcagcgtgttagccaggagggaaaccctatcttacaaaaaaaaaaaaaaaaagatcttgtcaattatgttaccaacaactgtatggagattcctattgccacacaactttgcctatattggctaatattattttttaaaatcttgcattttaaaagatgtttaaaagcatcttatcagatgcttttctgataagaaaaacatcttggattttttttttttttttttttgagacgaagttttgctctgtcacacaagctggagtgccgtggcatgatctaggctcactgcaacctccacctcccaggttcaagtgattctcctgcctcagactcccgagtagctgggactacagtcgcatgccaccatgcccggctaatttttgtatttttagtagagacggggtttcactatgttggccaggctggtctcgaactactgacttcgtgatccagccgcctcgatcctcccaaagtgctgggattacaggtgtgagccactgcgcccggcctgagatggagttttgctcttgttgcccaggctggagtgcaatggcgtgatagctcaccacaacctctgcctcccgggttcaagcagttctcctgtctcagccttccgagtagctgggattacagacatgcgccactacctctggctaattttgtagttttagtagagatggggtttctccatgttggtcaggctggtcttgaactcccgacctcaggtgatccacccgctttggcatcccaaagtgctgagattacaggcgtgagccaccgtgtccagcctcattttggctcttaatgaaaaattttttgatagtttgttgagtttttatggcatatatttcatgggattgaatataggcatttttataatatgcttgttagtctgagaagagcaggtattattttgctgaatgattctggctcggtcttaggatgttgtaatcaagttgttggctaggactgcagtctagatttgactgggcctggagtatctgtttccaaggtcactcatgtggctcttgtcaggaggcttcagttcctccccatggactcttccatagggctacttatgacgtggcttctcccagaactagtgatatgagcggaggtaaggaagattggagagatggaggggagaagagagaaagggagggaggaagggaactggaagctgtagagccttttaaaacctaatgatagaagtgatataccatcacctctggtgttttgtagtgttataatgtgggagagtacacacaagagtgtgaataccaagagtgtgaatatcattgggctatcttgaaggctggcttccgcaggattttattaacttatttttttttttttcatgtcctcaagtagcaaagactttttggaggcaagtgataaagtgagtaggagtagtgcttcataaaagaggaactatagggttatggaaaaattaactaggagttttacttatgggagaaaatacaggagcagagaggagagaaaagaggtgaaacattattaaatacctttgtctcttagctgctagcaattgaagaagcatatttccctacttatcaatttaatctagcaaatgcacaaatgaattgattgtatgcatatagaagaagattggatttcatgttctttttttaattttttctgttcaaggatgaacattgtctcaattacagaaaatggtaattttttttctttatcaggccacctatttcaagaaatgggccttccattctgaaggcatatagaattagatggaggcagtggtatctaattctcatttaactacagcctttaataatttaatttctgtctgggtgcagtggcttacgcctgtaatcccagcactttgggaggctgaggcgggtggatcacctgaggtcaggagttcgagaccatcctggccaacatagtgaaaccccgtctctactaaaaatacaataattagctgggtgtggtggcatgggcatgtaatcccaggtacttggggaggctaaggcaggagaatcacttgaacctgggaggcagaggttgcagtgagccgagatcacaccactgcactccagcctaggctacagagcaagactccatcttaaaaaaaaattaatttctatcccaaccattcttggcaaaacctgtctctggaaattttatgtgctaaatctacttttttcatcacgcacgagacgcaaagtacaagataagcaaaatcaagtacctaccatcttgatatataaaggcaatgttttgtgatagttacttaacatctttctctttctttttttcccttttttttctgttctcctatttctctctcatttactgatgttactggatagtttatcctgaagagtccgaattttgcttattgcatctctgtgatattgttaaatatgttcttctgttctcagtatttcctctaaattgttagttatgtttaaaagttttatcagattaagtttgaatttatttgttgataagaataataagtggtgttaactcatttaatatactgatcttattcagtacctttgtgcaaattgggaaacagagccccctctgggtagaaaattaggaaaaggcacttattttaggtggaagatttagaacaggaacattctagatatattattttataattttctgttgtgataagaggatatactctataaaatttcagtcttttgaagttttctgaaagcttgcttatggtccagcatatggcctgtctttgtgaacaatcagtgtacatttgaaaagaatatacattctgtggttgttgggtgtagtgtagtataagttataaacgtggtacatattaccatacccatcttggttgatagcattaccagatcttctgtatctttattaatttattttatctactcatcttatgaattactccactatgattatagatttgtcagtttttcttgtaagttttgtcatactttatgcattttggaactctcttgttgggtacatatttgggattgttatgccttcctaatacatttctccttttatcattatgaaatggccctctttgtctcttgtaatatgctttttcctgaagattctgtctgataataatttggcactgtcagatttcttgtgcttactatttgatagtgtgcatttttccgttcatttactttaaaaaaattttttaacccatgtaatatcagtggcacaatcataaactcctgggctcaaatgatcctcctgcctcatcctcttgagtagctaggactacaggtgcatggcaccacacctggcttatttatttatttatgtatttattatttttattttttgagatggaatctcgctctgttgcccaggctggagtgcagtggcgcgatctcagctcacggcaagctccgcctcccaggttcacaccattctcctgcctcagccttccgagtagctgggattacaggcacgggccaccacgtctggctaattttttgtatttttaatagagacagggtttcactgtgttagccaggatggtctcgatctcctgacctcgtgatcctcctgcctcggcctcccaaagtgctgggattacaggcgtgagccactgcgcctggggtttttttttttttttttttttttttttaatttttagtagagatggggtcttgctatgtttcccaagctggtctcaaacgcctgagcgcaagtgatcctcctgcctgggcctcccaaaatgtaggtattacaagagtgagccgctgtacctggcccccatccatttactttcaaccaatttgtgtctgtctctgggagactctacttcactgggtcttgccattttatctggattgacaatctctgccttttaattggtgtactagtccattatatctaattattgatatcattgggtttaagtctacatgtttccttgtattcctttggtttttttgttgttcttttgctcctttcctgccttattttgaaataattggattttttaaagtattggcctattagccggtagctttttattttttatttatttttatttttttttaaataagagacaggatctcactctatcacccaggctggagtgtggtggctttatcacaggtcactgcaaccttgaactcaggggttcaagggatccttccacttcagccaccccagaatttgggactacaggtgtgcactgccacagccagctaatttttaatttttttttgtagagctagtctctgactgtgttgcccaggctggtctcaaactcctggcctcaagtgatctacccacctcagcctcccaaagttctgggattacagtcaccttttatggccaacaattaactcctcattgttattattattattagtggtttctttcagcatatcttttatttgtatttgtgatttgttgttatttttgctttaaacagtcagttgtctttaaggaaaggtatgtttttaaaaaactacttcactgaatataattcacgtaccataaaattcacacatttaaagtgtacgtttcaatggcttttagtatattctcagagatgtacatattaccccacaaagatacctctcaccacttagccgtcacactcctcaactcccccctcccatagcactaggcaaccagttatctactttctgactatgtagattttcctattctggacctttcatataaatggaatcatacagtatgtggttctctggactggcttcttttacatagtgtaatattttctaggttcatccatgttgtagcatgtatgagtacaacatttctttttattgctgaatattattccattgtatggctatactacattttatccattcatcagttgaagaacatttgagtcatttctactttttggctgttatgaataatgctgctgtgaacattcatgtacaagttttcgtatggacaaatgtttttgtttctctcatgtatatatttaggagtagaattattggatcatatggtaactctttgtttagtttgttttccaatgtggctgtaccatcttatagcagtgaatgagggctctagtctctctatgtagttgccaatgcttgttatagttgtcttttgattatagccattctagtgggtatgaagtggtgaaatatagtctcttattttcacctatttactatctttgatattgcccttcttcctttggatctgattttatagtcatattgatttccatctgcctaaagaacattctttagcatttctttttttttttgagacggagtcttgctctgtcgcccaggctggagtacaatggcacaatctcggctcactgcagcctccgcctcccaggttcaagcgattctcctgcctcagcctcttgagtaactgggattacaggtgtgtgccaccatgcccggctaatttttgtattttcagtagagatggagtttcaccatgttggccaggctggccttgaactcctgacctcaggtgattcgcctgcctcagcctctcaaagtgctgagattacaggcgtgagccactgcgcccagctccttagcatttcttatagtgtaggtgtgttggtgaagaatatactctgattttgtttataagaaagtgtttttatttcaccctagtgtttgaaggatatttttgctgaatatagaattatgggttggcatttctttgaccatacaaaagatatcatttcattgttctctagtgtttctgttgagaagttaattttactcatatctctttctccctgttctttagattatatattttctattgatctatcttcaggttcactgttgcctgtctgccatttctaatctcatccaatagatttttcatttcttattgtattgttttggtcgtagagttttcatttttatcttttttatagttttcatttctctgatatttcccatctatatactcatcaagaatatatttttctttagttctttgaatgcattttcctttaattttttgaacatattttccattaattcctttaaaatatttatgatagtcaatcttaaggtttctgtctgtaagagttaactccttggctatctcagggttggtttcttttttgtttgtgtttttgagagagcctcactctgttgcccatgctggagtgcagtggcatgatcttggctcactgcaacctccacctcttaggttcaagtgattctcctgcatcagcctcccaagtagctgggattacaggtgcctgctaccatgcctggctaatttttgtatttttagtagagatggggttttgccctgttggccaggctggtcccaagctcttgacctcaagtgatctgcgtgcctcggcctcccaaagtgcggggattacaggtgtgagccatcacgcccagccatctcagggttggtttctattgactgcttttatttgactgtaggttacagttttctgcttatttatttttgcatgtttactactttttaattgtaggtggtatattatagagattctggattttgtatttttgtgaaaagtgttgattttaaaaattcttgcaggtagttcagttactggcagataactttgaacttgtgtaggcttggttttactctttgctagaatgatatgtggagaacccattgtttccttactttagtgtaactcaacctcacatttttaatcccttcaaaaacttgttggggcttgattttagtctttgttagggtgcacctagaatatgccttattctaggatgtggttcttactcttagttgaggcatttttgatatctcagctggatatctgagatgttaataaggtgttaatgtgatttctctgctctggctggtgggaactctaggtatacccagtactcctcaactctagtgtattttcctctcttaaccactctcttttaagccttgattggttttgccctacacatgtgcagcctatttcttggccaaggatttatgggggaatcctacatgtcttctagcctctctgccttgtggatttcagccacatcaactaccctgcattctgatctctgcctatttggcttagcacaatcactattcccttgttaaactcttgcttgctgggccatggttatggcaattgttgccatatagaaagctgaggtatttgtagggctcaccttgtgagtttcccatctctcagggatgtcctgtcctgcctgttgtctaatgcctgtaaacagttgtattatgcactttattttatggttgctcatggtgggaaggctagtctggcatcagttactccatcatatttgttagcaaaagctggccttactgttgttaagcatttacttcctcctgtagtcttgcagattttctcagttctatatgtacctcttgcttttcttttttgtttgagacagtctcgctctgttgcctaggttggaatgcagtggtgcgatcttggctcattgcaacctttgcctcccgggttcaagcaattctcatgcctcagcctcctgagtagatgggattacaggtgtgtaccaccacgcctggctaatttttgtatttttaatagagatggggtttggccatgttgcccaggctggtcttgaactcctggactcaagagatctgcccaccttggcctcccaccttggtctcccaaagtgctgggattacaggtgtgagctgttgcgcccggcccctgtttattttctttgcctcaaaattggcagtaccctgttaacattttcttttttgttgtatagttctgattacttttttgtttttactacctcagctccttccctaatatttttgtaagctttcttttcttttaatggagtgttttgaggttgattagcagtatagtgctgcagaacagcgcttagagaattggtgcctcctgtcttctgactggtaattacagtgaagatctcaagattcttctgaaggggaggtagtttgtgctttcaaacatatgtaagagttggtgttgtatgtatcttaattatccagagacaggttgaggagtagaaagaacaccaaatctcaagttagaaaatctaggctctagtttcaccatagactagcgagttataggccagccatttaactttggtttgttcacttgtttataataggtaacatccagccccctgaagctcttaaaatttgtgtaatttaatagttaattagaaaattattggctgggtgcggtagctcacacctgtaatcccagcgctttgggaggccgaggcgggtagattacgaggtcaggagttcgagaccagcctgaccaacatggtgaaaccccatctctactaaaaatacaaaaaattagccaggcgtggtgggtcatgcctgtaattccagctactcgggaggatgaggcaggagaatcacttgaacctgggaggtggaggttgcagtgagccgagaccgcaccactgcactccagcttaggtgacagagtgagactctgtctcaaaaaaaaaaaaagaagaaaaaatcagtgtagtctgtagtcttttctttgaccttgcaacattaataaaactattcgtattagctgtaatttttttttcccagtatgagggatggtgctgatcactctgcagaatatgaatacttcattacggattgcttattatatggctctaacatatattttttgcttgatcaaaaatgactattagtgtactttagtctttaagatgcagtgtgctaatatacttagttacttactgagcgtaacttatagttctttaaaactatgtttacaagatatttactaattatattatttgtaatgtttctactctcctctaattcccttctatactgggaatcctttttaaagattcatttcatatatatatatatatatatatatacacacacacacacacacacacacacacacacacacacacacacacacacacacacaaaattatgtctttttttttttttttgagacagagtctcgctctgtcgcccagtctggagtacagtggtgcgatctcggctcactgcaagctctgcctcccaggttcacgccattcttctgcctcagcctcctgagtagctggactacaggtgcccgccaccacgcccggctaattttttgtatttttagtagagatggggtttcaccatgttagccaggatggtcttgatctcctgaccttgtgatctgcccgccctggcctcccaaagtgctaggattacaggcgtgagccaatgcgccctgcccaaaattatgtcttaatgatgggtatccattctgagaaactcatgttaggcagttttactgtgtgaacatcatacagtgtgcttatggtgtagtacctggtatagtctattatatacctaagctatatggtgtagcttattgctcctaggctacaggtctgtatagtgtgttactgtacggaatgccataggcagctgtaacacaatggtaagtttttgtgtatctaattatatataaacacagaaaagttacagtaaaaaaggataaaaaatgatacgcctatatagggcagttaccctgaaaggagtttgtgggactggaagttgttctgggtgagtcagtaagtagtgagtgaatgttaaggcctaggatattactatacactactgtagacattataagccctgtacacttaggctacactaaatttataaaaaaattttctttcttcaataataaaccccagcttatggtaacaattttactttataaatttttattttcttttgaactgtttgactgttttgtaatacctagcttaaaacacaaattatgcaggtgtacaaaagtattttatttatgtccttattctataagacttaagctttttttctattgaaaacattttaaggccaggcatggtggctcacacctgtaatcctagcactatgggaggccgaggtcggcggatcatgaggtcaggagatcgagaccatcctggctaacacagtgaaacaccgtctctactgaaaataccaaaaattagccgagtgtggtggcacccacctgtagtcccaagctacttgggaggctgaggcaggagaatcccttgaacctgggaggcagaggttgcagtgagctaaaattgcgctactgcactccagcctggacaacagagcgagactctgtctcagaaaaaaaaaaaaagaagaaaatattttaaatttaggttttccttttttttgagacagggtcttgctctgtcacccaggctggagtgcaggggcatgatcacggctcactgcagtcttgacatccctggcttaagcaatccttcagctgtagccttctgaatagctgcgactccaggttggcgccactgtgcccagttagttttttgatttttagtagggatgaggtatcattatgttgcccaggctggtcttgaactcctgggctcaagtgatcctctcgccttggcctcccaaagtgctgggattgcaggcgtgagccactacacgtggccctatttttgtttttactttttaagctttttcattaaaaatgaagatacaaacctacacattagcacatacattagcctagacctacacagggtcaggatcatcaatatcactgtctcccctctccacgttttttctcattggagagtcttcgagagcaataacatgcatgaagttgtcatcttctgtgataacaatgccttcttctagaatacttccggaatgatctgctgaggctgtttcacaatgaacttttttttttattagtagaaggagtacactataaaataacaattaagaagtcacagtatcgtaaatgcataaaccagtatcgtagtcatttattatcattattaactattatgcactgtgcataattgcatatgctatattttcatacgactggtggtacagtaggtttgtttaccccagtatcaccacaaacaggtgagtaatgtgttatgctaagatgttaggatggctacgaagtcattaggtgataggaatttttcagctgtattataatcttaaggaacagacatcattgtatatgtggtctgtctttgaccaaaatgtccttgtgtagtgcatgactatatatagttttgaattttggaggaaatctatccagatttgtacctgcaggtatcagaaagtttcatagcatctttggctttgtgaacattctctttccatggaagttatgttctcaaacttgtattccaagagtcaaacaggtgaagctatctattggacattcaaacttatttgttaaaatgcaagttattttattctgtaaggatctaaagtagtagttcattagtttcctttagggatacaaatacaaatagaaatggaattaattttttctcattgctttttttctgctgtgggcataaaaatattatgtctaacaaatatatactgacagtatgattgcctgggttggaatcctaggttcgctacttattattagctatgagatttagggaaaattactgattcttattaaaactttttctcatctgtacaatgggttcactagtagtgataccttacagttactatgaagattagatgaggcacagttcgagtaaatttaagaattcaagtaaatctatgaattcaagtaaatttactctataaagagttattttcagtagtctatgtgcaaaaaatatatagtttttcagcttaagtttcaggaatcttttggcaatttattttcagtttacttagcaacttgttcctgagacagcaaatagaatgagaataattgagtgaaaattaaatgagattttaatgattttcttcaggtttcaaatgtgttaagcctattttccaagaaaaaaataagacaacagtaatttactagttgttggtgtttactaataaacgtatttgcagtctttctcagacactcaatacattttccaggccagtgattccaaaacttacctcatcctaagaatcatctggggtgcttctttaaagtacagatttctgggccctaccatagtctttcgaggtggggaccagtattttatactatctaggtaaattttgtggtctaagagggttgaaaacacagttctggggaaacaacagtgaatgtggcagacatggtttctgcccccattacttttatagtgtcttagttcttcttttgagtcattaaaaataaattcgtttttctttctttctttttttttttttgagacggaatctcgttctgtcgcccaggctggagtgcagtggcgcgatctcggctcactgcaagcttcgcctcctgggttcacggcattctcctgcctcagcctcccgagtagctgggactacaggcatctgccaccacgcccggccaatcttttttgtattttattagtagagatagggtttcaccatgttagccaggatcgtctcgatctcctgacctcgtgatccgcttgcctcggcctcccaaagtgctgggattacaggcgtgagccactgcgcccagcctttttttttttttttttttttttgaaacaaggaggaaaaggaaagtttatagttatagaaatattctttgtagttaagatgtgaaagtgggctttattgttaaataagctattttttaaaaaaattactatttgctaaagaaacataaatctgaaatcttgcagcctgattttagctgttctgctgatttaggaaaaggtcctttggggaagcaaatcattttggttggttgggtacaggttttgcaaagttagcatcaggggaacaaaaatgtctgggtgataccaaatatacaaatgttgtacgtggttccaaatatggaaatggttttgtctaaagcagccactgaagagaaattatctaaatattagcccctttaggaaagtggaatgtgttgtctgatttggctctcaggcttagtatgaaagtttgtgcaaaagtacagcttacaaaatgctatttgttttattaaaaggattgataggaagttgacatacttagttaatttaaatttggaaggagctcagcaaacatctttctagttgtattttatgtctccctccaccttcttttttttttttaatcaaatggggaaactgaagcctaagaaaggatatatggttgcatagcccacctggacagctccagtctctttttttgtgtgtaaatcccattcagaaattaaatttcaaaattaattttcaattacattttgattacctgttgactaaatacatttttttttactgtaatgcaactgggttgtaactcaaactcatgcataagatgaaaaaactacaatattaaaaatcattttgatctacttagaacaattttctctttatattttattttctagggtgctagcttacgataaaaagcatctttgaatattcaataatgatatttttcctgatattgtatttgccacatctttattttttattgatgatatataagcaatgacatagtatttggtttttgaggtatagtcagatgtcaactaggaagcctaaatgaattgtattgttgatgcagtgaaatgatttgtaggataacttattttatagtatttttatttttcatatttatttttaaagaaatatagattatttacatgtacaaacaaatatatatattctctacaaaaagataagaaaatttaaaatttaacagactttatcagaaatgtttggagtgttaggttttcttttcatttactaagttggaatatgtaaaaaaaaaaagaattttgagatgaggacaagtgattgtatacctcactcagtttttttagaacacaaatatgatagtggttatatcattgaaaatcaatgaagcctccatcaatatggtgcagtgcctctgcaccactgatttatatatatttaatgaacttgctgttctaatttcaggtaactgaagcaaactgcatctagcactaactggtttacttataaacaattcagctcattaaaatataaatatcttgaaatttaccaatattagatataatttctttataaatagttctactgtgtttacttcctggtgttaactgacatgtttctaaaaaaatcatcatattttggtactgtttcagataatgttaccaaaatatgttgttttatttgatcttatttcttgctactgatctagaatggatttggaatagaagatatgggacaaaaaagctttcaaaagtgatgggatttatgaagtatgacatgccagatgctgtatttttgagatctattggagcataagtgaggaccagttaaggatctatttctatattctttgggattaggaatatagtttttaatatttgcattttttaaaaaatgtattttaaaatagatttattttaagcatgtctattatgttttattgaaaaaatgccacaagataatattaaaaaatgttttgacaaaagaaaaaaattatacataatactttcacagaggagttcttttaatgtttatcttcttatttgtatgtgtgtgtgctgtgtagtctcagctgctctggaggctggggtaggaggattgcttgagcccagggggtcaaggctgcagtgagctatgagtgtgccactatattccagcctgggtgacagagtgaggctctgtctcaaagcaaacaaacaaaaaacactttggagaatgctgttttaagttttgactcagtaactaattttgtaagaaatttcatattactctaccattgtactacttattattattattttttgagatggagtctcactctgttgcccaggctagagtgcagtggtgtgatcttggctcactgcaacctctgcctcctgggttggagcagttctcctgcctcagcttcccgagtagctgggattacaggtacgcaccaccatgcccgactaatttttgtatttttagtagagacagggttttgccatgttggccaggctagtcttgaactcctgacctcaggtgacccacccaccttggcctcccagagtgctgggattacaggcgtgagccaccgcacctggcttgcactagttatttattgctgtctaacaaattatcctaaaactaaatggcttaaaataacaaacatttattttctcacggttcttgtgcatcaggaatttgggcatggctgagctgggtagttttggctcagggtgtctcatgagattgcaatcaagtttcagctggggctctattcatttgaaggcttgactggagttggaggataaacagttgaccattaaacaacatgagtttgaagtgtgtgtccacttatatgtggatttcaaaaaacaaaacaaataagaattgaaaatacagtattcacagtatgcaaaaccccatgtatatggagggctgactgtattaagctcactcatgtggtttttgtcaggagtcctcagttctttactgttattttttggctagaggtgtcagttctttgtcacatgggcctctcctaaggatttcttcagtgttcgcacaacatagtagctttcttctcctcaggtggatgattcaagagagagacaaacagaagccacgatgtcttctatgaacatcattcagacaccatcgtttctgctgcattctgtttgttcagagtcctaaatacagctcacattcagaggaaggggaattgggcttccccttttgatgaaagaagtataaagaatttgtggccatatgtaaaaccacaccaaccacatatgtatatttatcactggaataccttgaatccaagagggctcccagtgatttttgtctcctactttttatgtccttgcttagtttctccctgattgtatcagggttgcttgtataaccaatcgaatatggtagaagtttctcatttccaaggctaggtctttaacaaagactttgtggctttccatgtggttactctctatgttcttgggcaacttgctgtcatgaaagacagtttatgtgtcgtcagcagccttatgaagttccgtgtggttaagaactgagaccttctactaaccgccaagtcagtgagccatcttagtcttcagtcccagtcctgtcttcagatgactgcagccccagctgatatcttgacaaataagctgctcctggattcctgacactgagaaattttgtgagataataaattgtttattgttttaagctgtcaagcttggtggtgttttgttatgcagcaacagataactaatagaatcccttcatctttattaaaacaaaaggcacattgccaaaagctgtacacatattagggattttattttttttttaataatagggagaaatttcttcttttttttttttttttttgagaccgagtctcgctctgtcgcccaagctggagttggagtgcagtggcacgatcttggctcactgcaacctccgcctcccaggttcaagcgattctgctgtctcgctctcctgagtagctgggactacaggcgtgtgccaccacacctggttgattttttttttatttttagtagagacggggtttcaccgtgttagccacgatggtctcgatctcctgaccttgtgatctgcccgcctcggcctcccaaagtgctgggattacaggcgtgagccaccgcgcctggcaatagggagaaatttctaagggcgcatgttcaacaagccattgtcattagagaagtggcttttgttcagaggcatatgaactacttttattcagaagtaatcaagggggaatctagtagtattgtaaaggtaaacattttaatatcatgtaagatgtgataataatttagtgtttttagtgagaatcctgtaagcttcctgtcattgactaaggtctggattacattctataacgcatgaagtagcaatttgagaaactaattctttataaaaatactttcaccttgttaatagatttgtttctgtaagtaagaaatacagtggagttgaatcttatgtggaatttgtatatacgtattttttttttccagagacaaaatctcactctgttgcctgggctagagtgcagtggcatgatcacggctcactgtaacttcaaacctctgggctcaggaacccttctgcctcaacctcccaagtagctaggactataggtgtgtgccaccatgcctacctaatttttttttttttagatgcccaggctggaatgcagtgaagtgatctcagctcactgcaacctctgcctcccaggttcaagtgattcttctgcctcagcctccagaatagctgggactgcaggcacgtgccaccacacctggctactttttgtatttttagtggagacggggtttcaccatgttggccaggatgttcttgatctcctgacctcatgatccacccgccctggcctcccaaagtgctggtattacaggcgtgagccactgtgcctggcctaattttttattttttgtagagacagggtcaggctttgttgtccatactggtcttgaactcttaggctcaagccatcctcctgcctcgtcctcccaaagtgttgggattataggctagtcactgcacacagcctggaatttgtattctaaagtcatgtaaagcagaaaatatagtgaagattacccttaatattaaggatcagaaattgtccatatgggtaaataatttttcattaaacctagcgcagccagttttccttccagcatagtaataaatcagtattcctcacctgaacagcagatgaagtaattggctcttgttttggcattatactgaaaagacttacctttaaacactgtcatatatagtccaataagatgcttgtcctaggagaggcattgaaactgagtgcaacagagggaacagcagagtgacatctctcattttatgattactctggggtatagagatagtcactgagaggagaggctggggaaatgggaccgctttctaaaaatgtatctctgtctctttttgctgaacatatataagtgaatttgtgtaagtatgcacatgatgtgatgccattgtgtaatgcttctgaaacgtaaatacttgtctttttttgggaaatgtagactttttatttctttcattatgatgcttagattatttgatagcctatttaatggactatgggataagaaagattgagttttgttaacttacatatagcacaatgtgggaacctctgttcataacgagctgtctatgtcattaaggaaagtttcagtgatagtacacaaccatacacatttgttgaacatatgcattaaagacagagttatattgaaaaaagtttagaatagaacttctgcattttggagtatgctacacttgtctggaaaagttactgtcagataatgttttgttactcttggaacatgcgttattgtacatgaaattctgaacttttatagagtatgagctaagaagtgcttttcccattactaaggaggctgaatattcaagagtgatcatggaagaattttaaaaaatagtatatttttatacttcacagtgtcttatggattgcttaccatttaacagttaagctggaggatggaaaaatcttgatgtaagtggtaggaacttctgccaactggaaatcaattaaaatgaaaataaagcaagtataaagttttagtgttactgggaagataccatttgactcacaaaggtgtcattcatgtgctctttctggctatatacctgtggcctaaagctgtggtcttttggggatttaattattaatacagaaatgtgttttacaaaatagagccatgtctattttgatgccatatagtttctttttaaaatgtataaatgcccttgcgtttttttgggcaaaatcaatcatgctgtcttgtatttggaggtaaatgacaacaggatattcacttccagtttaagtagtagcctacagtttctcttgaatttagtttttggcttggttaaaccattagtgtatttgacctggactagaacttgattttaagatgtcatcagctgtgagttcccaagtgactggctctcacatttcactgagagagaacaggctatttgacttgttagtttgaagaaatcatatgcaactttctggtactgcagaagttgttcagaaacataacacagagtactaagaagctaaaaatttcctgtttaaaactaacggtgtatggagtaatttattttgtggaatctggagggattggtgtttgagatggaaatacatactgatctgacagtttcttactcttatttacctctttcctcagtttttggtgataattccaagttatattaatatatagactgtatcaagccactatgaaaattttatctaaatgcagttccagattttgcagtattttagtgcatttttttttattgtccacacacacccacacacaggctagaatgtttgacattttctggtcatcaattgagacactgaaatgtcttgtttgataaagttatattttgtttcaaagatatttttaatagactgttcctaagcatttgaaccaaacagcagctatgagcttagggctttagggcaagatttcctagaatatcattcatgttactcctagtttacatcagaatataggagacaaactataatttagtttcagttaatactttccaaatttttacccctgtggcatttgtctgagaaatactgatgagtcacagagattccctttctgtccttaactagaacatatgtagaataggaaataggagaaaactgttcatgcatttccgtgcttttaggtttttttctgctcttggcagtgtattgattctgatgctttacttattttgtaatttttattttatgacttcctgtgtacaaggagttgatgatgcaaagttgaatcagaggtaatttttgccctgaggtctcattgctaagtatggaagatagacaaacaaaatgttacaatacactacaataattgttatgatgagtgttgttggaaccatctaaggagcataatttagatggtagagggcagtgggaccaacaaatataccagatattcaaataagaaatctgaggtcatactatatgtactaggcttatttctaagccctacgaagttgtgcccataactgtctccttaataacttccaaattacagattttatcctattccccttgtagtctatgtcttccttatctctacttggacttttttttttttttctttttgaggtagggttttgctttgttgcccaggtgagagtgcagtggcaagatcatggcttcttgcagccttgacttcagggctcaagcaatcctctcatgtcagcctcctcagtagcaggaactacaagtgtgtgccactacacctggctaatttatctttttgtagagacagagtcttactgtgttgcccaggttggtctcgaactcctgggctcaagtgatcctcccacctcagcctcccaaagtgctgggattacaggtgtgagccacgttgcctggtccacttggactatttcaactgtctcctggccgaggactgcttcaagcttaattaacatggatactgcttactaccgcccactcctcccaaccctccaaaaaaaaaaccccaaattcagaaaacaaaacaaaaaatagtcttccccttttaaccatgatacttcctgcttaaacttctttggtggtttcttgtgtcttccaccaatgcttctcacattttaaaaagtaacattaacaatggaggaaaacaaatttgtacccctagtttgtctggaggtgcaactagaagtgtcgctttgaaagcccctttgaagttttggttgaccttaaaaatgcatgtaagattttaattttttaatattttctgttagtattaaaacaaaaagtatatgccttcctaattttttatctcatacccctaacctttgcataaaattgatgttttaggaagacgcaccacgttttcctctggctttatgtaatccctgacacacagaccccacatcatcctgtagttcagtattttcaaactgtgttgcctgagagatttcaaactgaaactctgagagattgtttgaggcagctgctcattgtcatcccttaaactagagcagtctccatttatctgtttacatattaggtttctgggtaacatttagtatgaagaaagagttctgttattaaagaaatataagcctgaaaaatgctactgtaatatatgctaaaaatccaaattccttagcttatcatgtaaagatttttctggtctggtctctgcctattttacttttctttcttctctctctcctcagcttccagcacctttcctagagattgaaacttgaaacctgagggtgaaattaattttgtttggccctggagtgttggcttgcacagcatttaaattaaaacaaaacaaaaaatgaattagttgccaacatgtaaaaatgaggagacatcatgtaaaaatttggatctctcagttttgttgaaaaactgctagatctggtaacattttggctccatattctcaacagcatggagttgatgagtagccatcattaacatgagatgcattctttagttggccagtttgatgaatgttggaaattgttgatgctttgaatagaaggtataccaataaccttctcaaaaggagacttttcctgttgttgtttaaaaagtaactttctacatgccatactattcattgcaggtatactgtacttaatctttgctttgtaagtgttagttaggcctaagttaaagaaattagacttataagtaaaactgctttatgcataatatttctctagtggatgatttgttaataaaatcatatctagccttaggtcaaatatttataatcattctattatttaaaagaaatttttttaaattataagaacagtttttacttatttaaagttctgttctgcccagagagcatagtataatatggaagtaggtcttctgattagaatttatttaagtagtagaaaattcaagccagcttgggtagggagaatatgaagtgagagaaactgaaatgtgaaagattaaagttgcaaacagttttggtacaattaaatatatctattccaagtggacaatataaacttatgcattaatgaaatgatatggtcatattatttgaaatttgcagaaatggaatcatactatacctttacctttttttttcagttagtggtagattttgagtatcagcatatgctttacctcctttttagcaggtaatatttctttatatggatattgcttctgttgatggaaatttagaaatatgaaattttgatagctctttctaatttttttttaaagtgcactggttaattccctgcaacagtgtacaaaagtgcctttcccccaccacacttgcgtaacatgcaggatttcataaaggctctattagttttaactcactggggttacaattaacacctcactgcctttcatatttgtgtttagcagcaagtctccaatatgattgtaagaatacagacataaagcattttttttcttaatgtttgtgctttaagcaaacacacaggttaaagttttcatttaacattatttaactttctgagcaataaaagtctgaaagaaaatttagaaatacaattgtatgaaatagctattgtttgtaagcactttatccacctcttatttctgtaaaagagtcatattacaattactatgagatctattctttgggcagctggaaagcaggacaaggaaaaatcgttctcctcttgtctggtagaaagtacattgtgccctctggtaccagacttgggcttattcaaaggctaatggattccacacaggtgagtcagtcttttgtgttcttaccaggtgcattattgattttcatgatggtagcctaggtgttctcattcaacagcagctttagcaaagtctccaaaatatcacaaagaaaaccaaagattttgcacattttgggtgcaagaaaatgaatttttctcaactcttttggccattgtactttttttcttgctagacgcttatgaataactcctttggaaaatgtattaatatgtaatgtgtttacttctttgtttttgggcatggattgtgtgtcatgatctatttatttaatttagagtgtgaagcaacgtgtactggcttgtggtacttttttttgcccacagactgagttaagttagggttggaagggttccctgttgtagaaggttatccacataccagattctaggaatagtcaagttcagatagtcatctggggtcaccaatcatttgatattcacttggcccttaaatcacaataccacaatacatttgagttttaactaagacaaacatttcagggtaaccttcaagtaggaactctttgaacagtgttctctaagtgaaaactataatttacctgagagcccttaataattgaggagaagaaagtgacttttaaagtttgggattatctaattttcaggttttcaaattgtttatttttcaatccttagcactaaggtagtagcttaaactatgacagcactgaaaaatttatgttgatgcttattaaatttagatattttcaaaaagttgcaaagcagctctctttgtttaggttatatttcctttattgcatgtttctttttagggttatgttttccttttacagtcttcactgctgcttttattcaacaaatatttgggtaagactatgtgccaaacatattcatagttacagaatgatcttatcttttgccctagtaattaggtttctttccttatcaagtgtaacactaattaaatgtgttatgagctgctttccctttcttatatcttgttttgtaaataatggttttgtttaaatgtgttatttagttatttaacctattttgtgtggtttgacagtttttagcatatataaattaatgtcccggctgtaagtgggatcaaactatctagatctgtgaactggtacgttctaattctagtgctttatacattgcaacattaaaaaatcagatattcattttttctttttcccatgttttactgattctatttttcttcaagtttcttccttcttttcctattacatcaatcatctgctcttttaacacagcaaattgctgctttgatttgagtcagtgacttgaagtttgggacaccataatcatctctctttgtttagaaatctcatcccaaaatctcaggaggaaaaaaccctaaagaattatttgatgtatttattgctttctgggcaagactcagcttcatgaaaaaatttttagggaattcttttctgtaatatcttatgatggattataggtggtttcaaatagattatcaggagagtgaatgatgggaagtatgtaaagacactgtggccaggcacagtggctcacacctgtaatcccagcaatttaggaggtggaggtgggaggatcacctgaggttaggagttcgagaccagcctggcccactaatgtcatctctactaaatgacatctctactaaatgtcatctctactaaaaatacaaaaattagccaggcatggtggtggatgcctgtaattccagctacccgggaggctgaggcaggagaatcgcttgaacttgggaggcggaggctgcagtgagcagagatcacacctctgcactccattctgggcaacagagcaagactctgtctcaaaaaaaaaaaaaaaaaaaaaagacattgtgtggtaaaatgattatgatattctttttttttccttcccttacattatggtattttgtcagtaatttttctatatgctaaaccaaaaactaaattgtgactaccacttggccggaaatttttactgagctcagtggtaaatttatataaacaaaataaagaaaacataatttcttgtagctcagtttgcagtttggtttatcagttgttgtatagagatagcttattatcatgtatggactttaaagccaaaaggaaccttataaatcatctagtacaacttcttaattttaatagataaaagaatatatttttcttttaaagctgtttcagcattgaaacactgcagattcatacctggctttttctccagttaaactaaattagggaagttaagaaaaaagtcatgcgtagggagttaatttacacaattttcattggtgctaatggaaatttcttactgagattcaaaatgatcacacttatctttatcatttatctttaattaatttatagatgaaatggccattgctgcattgctggttaggactttttaataaatgcagcagctacaacctatatcattttaaatgaataattaaagtggagtggtttattattttccagcataggtacatataataattcctttgaatcatatgctctttatgctggaagagatctcagagaatatctagtccatatttttattttatagatgaataaaatagggtacagagtgattaagtgacttgtctaattttccctgactaaagcattttatgtattggactccattgtaatttagtaaggttagagaccttaatgttctttcagttcaattttcactcggttaaatcccagtttatgaatgtgctgtgtgtatcgtctgccttcctactctagtgtaagtcatcaagcagtgaaaactcagaatttttggtgagtaataattgagcacaattatttctctaaacctatcattatctttaatttggaactacaatgaccaggaagcagtgttagtctaagcataatttaataaatccatattaatccacctggcggagtataacattttaacataccttttagatccacagtgatggaaaaatgattaaattacttattgtcaaaacaaagggctgctttagatatggttatttaataaactgttttgcttcatgtaaactagttttgcttaagcttcagagatatagtcacatggatttatctttccatgacaattgcttactgtctgggtttatgtttaatgcaggtattggtgacagtttgtaattcttgagtcattgcctagcatggaaaatagttgattttgctagctatacacagtactgtcttttaatgatcactttttaatgcggttaagcctgacttaattgttctctttttagagtgttatgtaatagttgttaatggtatgatatatctgttaaactacttatatatgtaaagtgaaaagtttatgtgtacatgttattttctgcaataatgttgaagctcaaaaataaaaggggttatatacttatgtacttaaaatacataatcctggtgtagccctctttttctggaagatcaatgccatttttcttcagtacattctttcttttctcttgtttatgattttgtgtctgctataccagtgactgtttttgtctatcagatagtgaagctaattgtcttaaagcttatcacaaacagccagaagttaatgggctatttgggtttggaacccatacttttggtcccttgttttaccttaagtatgaagaagacattaaagcattagagttgaattgaagaaagtagggaagatttgagacagatttagatggtaaattgagaggatttggtgattctgtggctgtgagggtaagaagaagcggtctaagataattctcacattctggattttgatgcccaggtgaagaatgtaattttcaagattcagtgaaatctcttctggaacaaggcaaggaatgtgtatacgtaaataaataggcaaataaataaattaacaaatggtagtagctgaaatggtaggtctttggagtctggcctgattataaaaggaagtgtaagtaggagtaagctgtaattaggagaaaaaggaaatataaaggattggagatctggatgagatcaaaggggcagtgtgtataatgagggactgagagctcccagttcagaaggttgtgaccagagtttggaatataggccaggcgcggttgctcatgcttgtaatcccagcactttgggaggctgaggcgggtggatcacctgaggtcaggagttcgagaccagcccggccaacatggtgaaacccccgtttctactaaaaatacaaaaattagctgggcttgcggcgcatgcctgtaattccagctacttgggaggctgagacatgagaatcacttgaacctgggaggcggaggttgcagtgagccaagatcgtgccactgcactccagcttgggcaagtgagccaagatcgtgccactgcactccagcttgggcaacagagactccatctcaaacaaacgtctcactcataagtgggagttgaataatgagaacacatggacacagggagggaaacatcacacactggggcctgtcggtgggttgggggctagttgagggatagcattaggagaaatacctgatgtagatgacaggttgatgggtgcagcaaaccaccatggcatgtgtatacttatgtaacaaacctgcacgttctgcacatgtatcccagaacttaaagtataatttaaaaaattaaaaacaaagtttggaatataactaaacagtctgatgctatgtctagtgctggagaagctagtgacaagaaagctgtataacacacacaaaacatgtttggaaaattaaaaaacaatagagctttcataagattaaaataatcattggaaaacagaggcctacccagactagattattgatgatggcttctatttatggttagactgaatataaaaatcttatacctctaggcaatctaagacatacagtactgtgttaaaaattttgagcttttatttgtcatatggttgtgactctagcagaggttggatatattctttattaaagtgtagaatcctcaaaatctgcctctataaatttaaaacctataatcttagaaatatataaaatcttgacttataaaattaaatgtataacttaaaaatgattaattcttttaaaatgaaaattttaactttctaatttctcttttaagtgatttttaagaagatgatttagataatgtaaaaggattgcatctgttaaataacaaactccactgggtgcagtggcttacacctgtaatctcagcactttggaggcctaggcgggtagatcacaaggtcaggagtttgagaccggcttggccaaggtggtgaaaccctgtctctactaaaaatacaaaaattagccaggcttggtggtgggcgcccataatcccagctacttgggaggcgtagacagagaattgcttgaacccgggaggcggaggttataatgagttgagataaagccactgcactccagcctgggtgacagagcgagactctgtcaaaaaaaaaaaaagaaaaaaaagaaatacaaattactcccccttactccttttttgggtattcgtcttgttttaaaaatctttttgtggcctggcgtggtggctcaggcctgtaatcccagcactttgggaggccaaggccggtggatcatgacgtcaggagatcgagaccatcctggccaacatggtgaaactccatttctattaaaaatacaaaaattagctgggtgtggtggcgcatgcctgtaatcccagctactcgggaggctgaggcacgagaattgcttgaacccgggaggcagaggttgcagtgagctgatcgcgccactgcactccagcctggcgacagagcaagactccgtctcaaaaaaaacaaaaatctttttgagaaacttttagatatgggacaattaatgaatatctaatactattcattgtatgactagatttcattttggggaggcttattaatataatttaattattttgaacaacaagatgaattgggtaggtgtttgttagaacttcaaatacattatagttgaaaacttgaaacagtaatacaaatgcaagaataaatattcttttagaaataggaaatggtttcagataatatggagaaaatataaggaaacaattcaataataaaaactattgtttgtaagtaaatcaagtttgagagtttctgctttaataagttgttaaggtttggattcagagatctgtttctcttatagtaaacatttttaatataggaacagctcagggaaatggtttccatatgcttcttgaggtgttaacaatacacttttggattggaaatgcaatataaacctaaactacattctggaaggcaaagtggaggagcatttcaatggtaatatgtacaagaaacccttgtgctttgtagatttgtgacttatggttttgtgagttcctggaacattcaggttactctgcaaacctgtagtctaacataccttgctttgtctggccagcttactgccttagtctggctcagtatttctttttactacagtttgtccatctgggatcttttttggatactctacacttgtggggagaattgaggccagttttggggcctattttaagggacttaagatacatagaggatggctgaagaaagtaaataaaatccaagtggtaattatatctgtgagacccttccgggttttctaattgatcttggaggcaagaacagttcagttttttttttaatttaaatttaaattttatttatttatttattttgagacggagacttgctctgttgcccaggcaagagtgcaatggtgtgatcttggctcatcgcaacctctgcctgctaggttcaagtgattcttctgcctcagcctcctgagtagctgggattacaggcgcatgccaccacacttggctatttttttgtttgttttgagatggagtctcactctgtcgccaggctggagagtagtggcacaatctcagctcactgcaacctccgctccctggttcaagtgattcccttgcctcagcctcccaagtagctgggactataggcacacgccaccacacccagctaattttttttgtgttttagtagagacggggtttcaccatgttggtcagattggtctcgatctcctgaacttatgatctgcctgcctcggcctcccaaagtgctgggattacaggcgtgagccaccatgactggccttattttttgtatttttagtagagtcagtgtttcgccacattggccaggatggtttcgaactcctgacctcaggtgatccacctgcttcgacctcccaaagtgctgggtttataggcgtgagccaccgcgcctggcccagtttagttttttgaattatggctaacttcattcctgcttgaggttgagtgtataatattattgtattactcatttattaagagctccggaatgtgtctgctcataaataggtggttgtcttcaatagtatttgtaattttgaagagttacatgtttaataactttctccctggttgacttttaaaggtcttggttgacttcttaaaagttttgttttggttttaaatgatatgttctacagaaacacaaggacaaattacaaaggttttaggagttatatctctgaacaggatttttctaacctttctttcaggtaatatcaaaatctttcaaatggaggtggagaagagggagatgagaataacctgggagggttttaaaaattactactacttatacagaaatgtttactgtgtcctaggcataatgctgaatgctctttattcgttatctcatttaatctttataataactctaattggtaggtattgtaaatatccactttttatggatgagggaattgaggcttagagattctaagtaacttgcctaaggaaacaaactagtaaatggctcagcctagattcagctaggcctcattgatgacaaacctttgcttctgaatcaccatgccataatacactttgtataaaccctttttgtttttctcctttatatcagaatgtggatgatggcaacgctatgtgcattttcaaaaagttaccctactcctaagattataatgttgagtttacatttttaagttatttttttgcatacaaaaagtgtatatataatatgtatagtttaatgaataatgaaaacaaatcaaatgcttgtgcactaaccccctgggttgagaaatagggtattactggtaagtttgaaccctctatcttttttctattatattttctcctcctcccatagaaatgactacttctttgaattttgtcattctttttcttttcttcatagattggccagatattgttggatctctaaacagtatactatttagttgtggattctatataagtgtatacattatatatttgtgttcttttttaagatatattttaaaaaatttgaaacaggatcttgctgttacccagggtagagtgcagtgggacaacataactcactgcaactttgttctcctgggctcaagtgatcttcctgcctcagcctcccatgtagctgggaccacaggcatatgccatcaggcctggccaatttttttattttattttattttttttcagatatggcggtctaactttgttgcacaggctgatcttgaactcctgggctcaagtgagccttctgctttgacctccctaagtgttgcgattataggtgtgagccactgcacctggctaagaattattttactgtggtaaaaaacacacaacatgaaatttaccattttaactgctttaaaaattaaaaaaaaaatttgttttttttagagacagggccttactccgttgcccgactggagtgcagtggcaccatcaaggctcactgcaaccttgaattcctggggtcaaatgatcctcccgtctcagccttctgagtagctaggactgcaggcacatacatggctagtttttaaaatgtgtttttaaaatgttttttttgtagagacagagtcttgatatgttgcccaggctagtcttgaactcctgaggtcaagcaatcctccttccttggcctcccaaagcacgggggttataggagtgaggcaccattcctggccaccatctttacctttatttttaagtgtatagttcagtagtaagtatatttacattgttgtgcaatgaatctctagaactttttcatcttgtaaaactgaaattctatacccattaaactaattttcccttcttttctgccctttgcctttgacaatcactttttaactttctgtttctgtgattttgactggatacttcatacaagtggaattatgtagtatttgtctttttgtgactgccttattcactttgcataatattcttgaggttcatccatgttttagcatgtgacaggatttccttttttaaaaggtgcataatatttcattatatatatatagtatccttatctattcatccatcagtggatatttgggttgcttctgcctcttgactgttgtgttaatgctccaatgaacatgggtatgcaaatatctctttgagatcctgctttgaattctttggaatatttacccagaggtgctggatcatatggtagttttattttaaagttttttttaggaatctttacactgttttccataatgattgcaccattttatattcccaccaaaatgcacaagagttcttaatttatatatttgttattttcatatattctgttcctttcacatattcttttcaaatattctgttctgctcaaatatgttttgaaatattaacccagcagtgggattgtgggatcatatggtagttttattttcaatttttttaggaatcttcatactgctttccaaaatggttgcgttattttatatttctaccaaaaggcacaagggttcttaatttgtatatttgttcttttcaacttactttgttcattcagcattgtgtttatgagttatatttttgatattcacaatgttaatgcacatagttgtaatttgttcatttccactgttatatagtattccattgtaggactgtactgcattttatttatccattctgctgttaatggacataggtattgtttccaaatttcttttttgctataggaaattatactgctgtaacattcttgtatatgtccactggtgtatatgagttatggtttctctagtatatatacgtagaataaaactattaggtaataaggcatgtccatttttaactttactaggaaatgccattttgttctttaaagaggttgtacagtttacactcctatcagcagtatggagggtttttttgtttgtttgttttgttttttacatctttgccagcatttggtattgtcagactttaaaattaaaaaaaaaattcagatgtgaagtggcattttactgtggttttaaaatgcatttccctgattgtttccccttttcatgctttttggtagtttctgtttcctcttctgttaatgcctgtataaggtgagaatttgtccactttttactctcccttctgttacttctttttcacgaatttatggtagtggctcatacattagtttgcctgcttttgcctttgtccctatagtctgctttcacacacagtggccaagaatgagccttaaaataagtaatttatgttctgccacttctgtattctaaactctgtagtggctcctcatttcatgcagagtagaagccaaagtccttatagcgtcccttctgtcttacatgatcattctccagcttctctgatcttattacaatccttgcctacctcactctctctactatcctgagcacttttcaccctgccctacattttcttctttccctagctcttctcttctaacactacgtaatttatctgtccatgttagtatataggctctatgagggcagggatcattgttttgcttattgaagtattcctaatgcctcaaacagtgcctgctacatgatgggcacctaatgaatatttattgaattgctttgaatttggtgaaaaagtgtccattttctatgatgggtaaattttctttgaaggtattttagttctctgaataataggagttttctgtaaaactaaacaataatggagagcaattttatgcttgctttcagttgtactggaaggtttcattttcccttgttgaacacttgtttagatgaattaaagagcgcatttttaagggctctaagattatttttgattatgagttttattacagggtaatcactagggaatttaaaattaagatcaaaaccatactcaggaggctgaggcaggagcattgcttgaggctaggagctcaaggctgcattgtgctctgattgcaccactgcctccagactgggcaacggagtgagacccccacatctctaaagaaattgacataaataaattaaaagatgatgaattggccgggtgcggtggcttatgcctgtaatcccagcactttgggaggcggaggcaggtggatcacctgaggtcaggagtttgagaccagcctgaccaacatggtaaaaccctgtctctactaaaaatacataaattagcccggtgtggtggcaggtgcctgtactctactactgtaatcagctactctggaggctgacacaggagaattgcttgaaccaggaggcggaggttacagtgagccaagatttgtgccattgcacaccagcctggacaagagtgaaactccccatttcaaaaaaaaaaaaaagccaattcttggctttccaaaaaaaaatcaaaatcagatatttagattagaaactcagattgcattagtggtttcatcacaggataacctcatttcttgttaatcacaaagtatataatcttatacgtctaaaagtaaaaagctagtctgagatttcttgattgtgttgtagtgaaagaggaagagttccagagtgctaggtagaaatgaagagtaatcccaaggctttgaggtgtctgaataagcaaatgaagtaaggaaggcaaagtccaagagctgctgttttttttttttaattttttaaaacatttatttatttatttatttatttatttatttatttgagacagagtctctctctgtcgccgggttggagtgcagtggcgtgatctcggctcactgactgcaacctctgactccctggtttaagcgattctcctacctcagcctcctgagtagctgggattacaggcacacgccaccacatccagctaatttttgtatttttagtagagatgggggtttcaccatgttggccaggatggtctcgatctcctaacctcgtgacctgcccgcctttgcctcccaaagtgttgggattacaggcgtgagccaccacgcctggcctgttttttattttaataagttgaaattgtgatagactgtagagaaactttgagagttggagttgttatgtttgatgtagtgagtggaagtattttactaaggtgttacattcattcaaccactatttgcaccaaaacacagggcttgagataccaataatgagcataacaaatgtgatcactgtgttcatggaataatatatttggggagacagatattaaacacaaaaattaagaaatataagattcttgattttgataagtgggccataaaaagcaggatatatatcaattggggtttggtcaggaaagcaaaaaccaccctagatatttcaagccatgaagaatttacttcaggcaattacaggcttacaaacctgttaggaagggctagacagtaatgtaagagaaactgccccattcagaaagtcagaaagaacaggaattgttgaaaaactgctgctgctgattccacttgtctcttatgtttgaagcaggtggttcacagaagagtacctgaaagctgtgagtgaaacctaatgtgtcatatgctgatgcccatgtgctgtcctttgctgttgaaggaacagtaatgcttctgttgtctttttgccttccaaagcttttcagatgtttctcaagatgttctcaagaggtagaagcaaaactggagctttggtcttagggattttggaaaatgaatgtagtttccagatttctagtccctgggaagagcacagaatgatgaaaatggttttaagttgccaagagacaatctggcataattagctatgagagaaaataacagggtcatcaattttagattggatggtaaaaaagtcctctttaaggaggagatattgtctgatggataagatcttttaaaagacagatcaatttctaacaagaattttggctgttttgtggcacaagtggaggaagacttaggagtagggataatttttccagtaagagtctttctaaagaggtgacatttgatttgatacttgagtgatgagaggaggcagccatgggaagattgggaagaacagaatgtatggctgagaagacaaatgcagttgccctaaggcttgaataaccttggcatgttggaaggaaagaaagaagagaggggtagaatgataggaatgaagctggagagttaggtaggggtcaggtcatgtagtatcttcagtggtgtggtaagtcatttgtattttatgctatttaatatgagacaccattgggtcatgaacaagggtgagaaatgagctaattttcattttaaagatatgattttggctgttctgtagagactacatttggaggaagaaggtgggtaagtgttggggataagtagtcgaagtaaggagaacagttgggaaatcttagcagtacttcaagtaataagtgatagtggcatataacagtgcaaatggccaaaagcagatgtattttagattgtattttagatgtagagtcatcagtcttggtattaattagatgtgggtaattaggaagtggaaaaatcaaggaagcctcctaggtttttggcattagcaactatgtggattgtgtgacatttagtgaaataggaataactgggggaggagcagatagagcagtatgaaataatcaagtattctgctttggacttgttatgttttgtcattgtttaggagtcaaaacttgtcatgttttgtcattgattaggagtcattgattaggtggttggttgagctgagggatgagatcagggccgtaatcagatttgggaggcacatttacagctgtttcgactggatatgatcatttgtagggggagaagaatgcccacgacataactctggaacacttcaacttttaggtggtttacagaggagaagcagccagaaaaagaaacagagaaagagagacaggtaataggaaaactagttaagtgtgaggtcacagaagtctagagaataaagtgttcccagatggaggaagtggtcagttaatgctgctaagaggtggtattggatgaggacagaaaattcttctctgttaattaactattggctttggcaagattgaggatattggtaaaattcatgagaattgtttcagtggaaagtcaggaataaaagactaatcagaatgagttaaagagaatgggacatagcagtatagacaactcttgtttcaggaattttgctgtgaatgggaatggggaaattgggtagtagctgcaaaggaatgtagagtcaatttaaaaaaatggttgttgatattaaggtatgcttgcattccaataagaatgattcagaagaggaagaaactcataatgcaggagaaaggggagataattataaaagtaaaatacttgagtagggattaggaagtgggatatagagcataactggaggggaggtattgacttgtagataacaacagagatatttttttcattttaacctgaaggaatgcagttaatatggttatagaaacaggtagattgatggcattggtgtttagaaatgagattatttttgtctctatagtatgaggctaggtcactagctatgattgaggtgagaatgggaaatgtgagaagtctgaggagagagaagaaagtatgaaatggttcattcagggaatgggaaaatgactttaattaaaaattgtagaaggaatgtctggcagtgttgagtcttcatctgagatctgtggtgttaattttagtgtgaataattttagtgtgaacttcagtaaggttatgagatgtttttcttcagcaaaatttagctgctcagatacagtcatggactggtagatagatggcttcaaccatagatggatcaggtggaacaacagtggagaggagcaagtgagttaaatgcatttgcaaaggattggttttaattctagatgctgtaatgtatgcttgtgtaaggatgaggttaggaccttgagaggggtgataaatagggaaaagtagtagtgtcagtggatgggagctccttgtgaggtcaaaggatagagtagtggtatttaatgcaagtcatctgaaaggagagggaaaggtgttcagagagtgagatgctagaaacagacaacccagcagagagatatatatatattgataatgacaagattgcaggctgaaggtatgagggtgagtgacttaagtgggatggggcaagagatcattggagtgaggcagtccaaggaattaaatgtctaggataatgcctggcttatttatgaggatgttcaagttgccaaaaatgatgataggtatagtggtgaacagggagaccagaccatataagccagatgctgaaaactgtcctggggggggaggagcagatactgttaggggaggccataactgaggataaagatggtgggattccagaactagtatcactgattgaagtgtctgcaatatgagtatgtattacgtattgagaatactttggatcatattcactataagtggttccagagggtgatggggaggacatgagaatacagtgattgtgatcatggcaggaaaaaggtgtacaacatttaaatttaaatggacttgtatagtgttgtggttttttttgttgttgtttgtttgttttggtttttgtttttttgagacagagtctcactctctttgcctaggctggagtgcagtggcatgatcattgcctgatgcagccttgacttcccggctcaggtgtttctcctaccccagcctcctgagtagctgggattacaggtgcacaccaccactcccggctaatttttttgtatttttagtagagacaaggtttcgccatgttgcccaggttggtatggaactcctgggctcaagcaatccacctgcctcagcctcctaaagtcctgggattacaggcgtgagccaccatgcccagcctttgaatagtgttttaggaagttaatttgagtagttgggagaaggggaaatatgcttaaatagctttaggaaactagctctctaggtaaggtatgtgtttctctttgtataatcccattattgacactctactacatataagattttgtttttggatgggtgcagtggctcatgcctgtaatctcagcattttgggaggctgagttgggaggatcgcttaaggccaggaatctgagaccagcttggacaacacagcaagacctcgtctttacttgtaccccacctctccccccccaaaatttttgtttttcagtctattttaaaattttgatgtagcataagcagtccaaataaaggtatttgatttaatctcatgtattttctgcatacttttaaatttacaattgttttctttaccttcatattggatgtttttttaattgcttgtatggctagcctgttgaggtcctctttttgcttagtccccccattctcattccataatacatattgggaaaagattataataaatattgggaaaaggttatctctacactgatacctttcatgtttacatctttgtttaccatagagtctgctcttgtgccatcaaagtatctaactgaatataaaacatagcattaggagtatctatcttctatagatgctatctatagaagcatcttctagtggaaagattaggatgagaacaaagtagaccataacaagtataatagccatacaaatagctagatggttatgcttagttggctgaatttaataggctgggttctggagcaaaccagagcagtctgagaattcatttctattggcaacaactgaaggaatgccaggcagactttgaaatctgtgctgggtctaatttggtgatagtgggtttgttttgattcttttaagattctgagtcactattcagcccagttactacttgatgcttgctctgctagtcatcttcagtgattcagttttggctgcaaacctatgaagaattattggtcagagtgaaatgacattgaaatctggggacctaaagtgctatgacctactcttgttagaatggggaggggtgtatgagactcagataattataataaatagagttctggcccagatttaactcacagtgtgtctctgttatcagagtcctttctctggttcctagttttgtaattggaatcaacatacatggtagttggcagaattctcaacttggctccttgaccagtttggttaagtgctttcctagtgggggaagatcaagtggaagcctctaaaactgtaccttccctcaccttggaagggacagcatttcttctagtttgggattaacacatattctgggtccacatgtttgctttttctgcccataagtccacagccagcaccactatctgaggacttacagagtgtttgatccactaatacgggatcttgagtaatattgtctcttaccaagagtcgcactttacaggaaagatgtgtagcagtgggccaaagttcatgaatccactggtcttaactcatactgctccacctataatcctctggattgatagaacagttgtaatgggctcataaaggtacaactgagatgccagattggaggtgatcctctacaaggatgggtttcatccctccagaatgcttggccatcatatggatattcattatattaagtatcctcaacaggtaatatgtacacgggttcaacaaccaagggatggaataggagtggtctcatttactatcatacccaatccttacttgaggaatttatgctttccattcatatagctttagaccctgtgggcttagaggttcttgtctccagaagtagaaatgccctactagggaacagacacaatgagagttccattaaattttaagccatgcctgctgtctggtcactttgggctcctcttgccaaaatcactagggaagaaaaggagtcaccatcctggtaagggtaattgactctgatcattatcacggtatggacagagaagaatatgtctggcattcaggggatccgctgatatgtctcatggtgttcctaagcccattattttaataaatgtacaaatacagtagccattgcctaaaaagggcatggtaaccagagtttcaaacctcttagataaaaggatctggatcgctctactggcaagctgcttacaccagcataagtgctagcagaggatgaggggactctaaagagggatgatgatctgttatggccaggaaatcaactacagcattgggactatagtttgtcttcttctcttgaaagtttcccgtggaaacaaaataagtagaatccttaagaagctgtttccggctgggcgcggtggcccacacctgtaatcccaccattttgggaggccgagcaggaggatcatgaggtcaggagatcaagaccatcctgaccaacatggtgagaccccgtctccactaaaatacaaaaaattagctgggtgtggtggtgcacgcctgtaatcccagctactcaggaggctgaggcaggggaatcgcttgaacccgggaggtggagattgcagtgagccgagatcgcaccactgcactccagcctggcaacaaagtgagactccgtctcaaagaaaaaaaaagaaaaaaagaaaaaaaaaagaagctgtttcctgctagagtgaacttactctaagaagcaagtggatggtctttacttttgaaactcttggcggggaagtgctgttggagccgctgtggttgctgtccgtgtagtgaaagcgcgtgcctttgtttgtgtccctggccatgtgtccctggccatggcgctgcagctctcccgggagcagggaatcaccctgcgtgggagtgccgaaatcgtggacgagttcttctcattcggcatcaacagcattttatatcagcgtggcatttatccatctgaaatctttactcgagtgcagaaatacggactcaccttgcttgtaactactgatcttgagctcataaaatacctaaataatgtggtggaacaactaaaagattggttatacaagtgttcagttcagaaactggttgtagttatctcaaatattgaaagtggtgaggtcctggaaagatgacagtttgatattgagtgtgataagactgcaaaagatgacagtgcacccagagaaaagtctcagaaagctattcaggatgaaatccgttcagtcatcagacagatcacagctacagtgacatttctgccactgttggaagtttcttgttcatttgatctgctgatttacacagacaaagatttggttgtacctggaaaatgggaagagtcgggaccacagtttattaccaattctgaggaagtctgcctttgttcatttactactacaatccacaaagtaaatagcatggtggcctacaaaattcctgtcaatgactgaagatgacatgaggaaataatgtaattgtaattttgaaatgtggttttcctgaaatcaagtcatctatagttgatatgttttatttcattggttaatttatacatggagaaaaccaaaatgatacttactgaactgtgtgtaattgttccttttgtttttttggtacctatttgactcaccatggagttaacatcatgaatttattgtgcattattcaaaaggaaccaggaggttttttttttgtcaacattgtgatgtatattcctttgaagatagtaactgtagatggaaaaacttgtgctataaagctaagtgctttcctaaatcagatgttttggtcaagtagcttgactcagtataggtagggagatatttaattataaaatacagcaaaggaagtctaaatattcagaatctttgttaaagtcctgaaagtaactaataatctataaacaatgaaatattgctgtgtagctccttttgaccttcatttcatgcataattttccctatcgaatcagtttccaattatttgactttaatttatgtaacttgaacctatgaagggatggatatttgtactgcttgatgttctgtgatacagaactcttaaaaatttttttttgtgttttataaaatcaagttttaagtgaggaaataagtttgttaaaaacaaaaaaagaagcaagtggatttgtgtggtgtaatttgcctgctcatataatccactcatttttctatagcatcatttattgatttgtagaacctctttatatagtatgaatattatcttttatgtatgatgaaaaaattgttttctagtttgtggcaagtcttttaatagtattgtgtttcccctcccacttatgaaaagttttaaatttaaaattgttgtttttagagatgatggggtcttgctgatctcaaactcctgacctcaagtgcttcttcagccttggcccccacaaagtgctgggactacagatgtgagccaccacacctggccttaaattttgataaaatgaaatttatcaatctcctttacatggtttaaatttttttagttacttttaggaaatttctgccctgatctcgtaattatattctcctataatttgataaaagtttaaagttttctctttgatctttagtcatttgttcataggggatttctttttgtgtatagggtgaaagatagggatctagtttttttctctccttatctagaagcatctctccttatctagaaagcatttatttagtgtctcaagtatttatttagtagtcatttatttccacattgatttgtaatactacctctttcctatgccgtatttccatgtatgcatggattttgtttgtgtgtgtgtgtgtgtgtgattttttttttttttttaacagaagtatacttgttccttacagtgtgctgttatgttggtggtacatgaatccatagacatcttcctggaatgtcaattttacctaaagaatatgaaaaagattgagtaattgaataactggtaactatttgaggacatttttcaatgaaataaggctgtttgaattatggagtcaaatagaactttcatgaagttttagctttttaagctaaaacgtgatacaatttgaagacatgttgagcttatgggggaccatttgaggccatttccccaattttccaggaagttcattctttatcatttaagaatactgtggtagaaaagggtgagaaggactaccttacatggactgtttttattttttgtcaaaacgttgtgtttattgttccatgtatacactgtgtgtattgatacctttattttttttgtgatctctgcctggaatgtcatccttctttcatatttcaaggccagcacatttttcatggcccagctcaattcaacctatttcttgaatcctttaacagttgtaatccttgttactggctcctttgaaatctggtccttactgggtattccttgtattaagtaatatttctaatggctaatgtttattgagagtgtactatgtgtctggtatatttctaagcattttacctgtattaactaatgtaaatctcatcagctctgaaagctaggtttttacccctatgtaggtattctttttatttctcacaaggaaggaaacagaggcacagagaggtttaataatttaaataaggaaaagcaggcaaactggcttcagagtctgtgcccttaaccagtatgctctgctccctctcagttgctcaataaataattgctcaggaatgaatttaccacttatattaacacttagcagacataactttgttctgttgttttatgggtgtgttctttcctaactatataatacatccctgaaggcagggataaaatcttatacttctttatagtatggctttatatttcatacttcattagacggatttactacttataacaaatccctagtagatgttcgtaggtgatgataatgaatttggtatgacctttagatttgccatagagtaacataaacctaatcattcattgtcaagtgggtctaagctttctaataagacctgttggtttgaatactccagaaccacagataaataacactatgagatctcctggttctgaagctgtggggtttggctagacctgtaacattctattcagttggtagagagatccccagagattaggtgacagatttctggcctgcacttaaactatgacctggacaggtcattttgtcttgctatctgtaaaaggagaaaatcatatttagtgcagcttttatttttaaatcatggtctttatgtagaccatgctttttagaagcaaagttatgtaccttcaaagtagcatattctcttactttgttataataatacataccattatgttggtacaaatttggaagaatgtattattaccagcaaagctgtgctctagcccaggctggagtgcagtggtgtgatcttggctcactgcaagctctgcctcccaggttcacgccattctcctgcctcaggctcccgagtagctgggactacaggcacctgccaccacgcccagctaattttttgtattttcagtagagacagggtttcaccgtgttagccaggacggtctcgatctcctgacctcgtgatctgccttccttggcctcgacctcccaaagtgctgggattacaggcgtgagccaccgcgcccggcctttagttttacttttaaataaagagcaaaatatttacgtattttttgagatagggtcttactctgtcacccagggtgtaatgcagtggtgcgatcacagctaactgtatctccaacttcctgggctcaagcgatccttgcacttcagcctcccaagtagctgggactacaggccactatgcccagctaatttacttttattttttattttatttatttaatttgagatggagtcttgctctgtcgcccaagctggagtgcagtgacacaatctcggctcactgcaacctccgcctccgcctcctgggttcaagccgttctcctgcctcagcctccctagtagctgggattacagatacgtgccaccatgcctggctaatttttttttttttttttttttttttttttagtagaggcgaggttttgccatgttggccaggctggtctcaaactcctgacctcaggtgatccacccgcctctgcctcccaaagtcctgggattacaggcatgagccactgcgcccagccacccagctaactaaaaacattttttttttttttaaatagagatgagggtcttgctgtgttgctcaggctggtcttgaacccctggacttaaatgatcctcctgctgcggccttccaaagtgttgggattatagatgtgagccactacacaaggctgaaaatattttttcccccgcaagacagagtcttgccctgtcacccaggctggagtgcagtggtgtgatctcagctcactgcaacctccgcctcccgggttcaagcaggtctcctgccccagccttctgggattacagttgcccgccactgtgcctggctaatttttagtagagatggggtttctacatgttggccaggctagtctcgaactcctgactttgtgatccgcccacctcggcttcccaaagtgctgggattacaggcatgagccaccgtgccaggcaacgaaaatactctttttacagttagtttctggaaagtgtaagaattctttggtcaagtggaaaggacttgataaatgtgtagctatagctaacacttttttttttttgagaacgagtctcaactctgttgcctaggctgcagtgcagtggtgtgatctcagctcactgcaacctctggctcccaggttcaagcaattcttgtgtctcagcctcctgagtagctgggactacaggtgtgtaccaccatgcccagctaatttttgtatttttagtagagatgggatttcactatgttggacaggctggtctcaaacccctgacctcaggaggcctcagcctcccaaaatgctgggattataggcatgagccaccacgcccagccagctagcactcagtgaacatttactatgtatcaggaattgatttaagttcttttacctataataactcatttaattaagttgattgttgggtggccatttgattttttaaaaggtttccatttccccctctttattagtgtaattcaaaaatagttgtcaatactaatcagaaaaataaaaaattacaaatataaaatataacttaggttttgaaacaatctggggaacgggtctcaaacttgtctgttattttattaattgattttccctagtgtttattagggatttaaatgattaattgaaaatgttagcaaatgttgagcaaacattgatatactttgctttcaagaaaacaaaaatgagaacattgtatttttagaactatttcaccttgagttaagcattgcttgtcataaaccaaatacagttcttgccttcatagccccacattctctgtatggatcttctggaattttctgttgttgaggtaggagatgatagtttattctcacacatctgctttatatagcttatataatttagtctataattatttgctagtatcaactgtttttaattgattcacaagaatgtatattcttgtactcatcaaacatttgagggttcagctttgcatttgacaaggcacctggcatagtactgagaggatagccaactgtttagcttaaatatttgaggacctaatgaatagaaatagcatcttgactagttgttatattttattctatttaaaaggtcataataatggatgcttgataaatattgacctagaagaaatagtttaaaaaatgaattatatatattttttcatggcctcttaaaaatagtagaaaagtacaaactgttgtggatatgaagagtgaaataatgaaaataaacccagtgttaaactctaagaaatagaaacaaaatataattaagaaaaattgaataaaataaataatagaaaagtagaaattagtaaattggaaaacacacaaaaaattgtgaaattcaagtttctttatagtgattctttaaaagggcctttatacaacttagacaaacatgtagcatttctaatcaagaaaaagaggtagaaaaacaaaataagaagtgaagagagagctagaacaatagtaacagtggaaaatttaaaaaatattttactcagtactaataaatgagaaaatcttaatggcttgggtagtttggggaacacttaaattatgattgcattcctttgagttcatttgttcattataagcaatcttttattggtcacatgtaacagtggttctcagactttttggtgttagtaacttttataattttaaaagttattgatgaccctcaagacctcttatttatgaaagttatatctgttaacatttatcatattaggaattaaaatttggaaactttgaaatgttcatttattcatcaaaaattataaacctattacatgttaccacaatgtatttttatgaaacataactatattttccaaaacaaaaaaattttgtgagatgagtagcattgttttacatttttgcaaatcttttaaaaatgcttggcttaagagaagaaaactagattctcacatctgcttctgtgttgagtctgttgtatgttttggttgaaataaatgaagactatctggcatctatagatacctatttggaaaagggataagcattttaataatagccttttcaggtaattgctgacattgtttttggacatacttagttacatgtatttttaactcctttgaatcatggtggaagtaaagacataccttatttagtgcagtggcattaatggaaatcagagtattagttgaatttgcccttcctttccccgaagtagaattatagtaaaggtctgtatgcaaatgctagcttggtttagtgggacatcgttctttcaagtctccaaagtcctgaatgctcctgtggccatggtgctttcccttattactcgtatgcagacatacctcagacatattgctggtttggtttctgaccaccacagtaaagcaaatatcataatacaacaaatagcacaataaagtgactagcacaataaagtgtgtcacacaaactttttgatttcttagtgtgtatgaaagttatgtttacactatactgtagtatattaagtgtacaatatcaatatgactaaaaaacagtgtgcataccttaattaaaatatactttactgctaaaaattgctaacaatcatctgcgccttcgaaagtgactataatctttgtgctagtagaaggtcttgcccagatgttgatggctcctgactgatcaggatggtgattgctgaaggttggggtggccttggtgatttcttaaaatgagacaacaatgaagttcgttgcatttattgactcttcctttcatgaaagatttccctggagcatgtgatgctgtttgataacatttacttactggaaaattcctcgcaaaattggaatcaattctcaaaccttgccacagctttatcaactaactgtatatgttatttctgaatctcttgtcatttcaacagtgttcacagcatcttcaccaggagtagattccatatcaagaatcatccctaagaagcccaaactcctcatttgttcaagtttgatcatgagattgcagcaattcagtcacatcttcaggctccacttctaattctagttctctcgctgtttctgccatatctgcagttattttctccactgaagtcagaccctgaaagtcatctgtgaggattggaatcaacttcttccaaatgccttttaatgttaatattttttatcttttcacatgaatcacacatgttcttaatggcatctagaatggtgaatcctttcaaaaaggttttgaatttgctttgcccagatctatcagaggaatcattgtctgtagcagctacagcattatgacatgtattacttaaataacaagacttcaatgtcagaattagtccttgacccatgggcttttgaatggatgttgtgttagcaggcatgaaaacaacattcatgtccttgcacatatccatcagaggtcttaggtgaccagattcattgtcaatgggcagtaacattttggaaggaatctttttttccgagcaataggtctcaacagtgggttcaaatattaagcaaaccatgctgtaaatagatgcgccatcattcaggctttattcttccatttatagagcacaggcagtatagatttagcataatatttaagggctttatgatttttcaaaatgacaaatgaacattggtttcaatttagtcatcagctgcactatctcctgaaaagacacccttgcctttgaagctttgaaaccaggcattggcttctcctctgtagctatggaagtcctagacggcatcttccaatagaaggatgtttcatctgcattgaaaagtctgtttttcagtgtagccaccttcatcattatcttagatagatattatggataacttgctgaagcctccatatcagcacttgctgcttcaccttgcacttttatgttatggaaacagcatctttccttgaatttcatgaaccaacctctgctagcttcagacttttcttctgcaacttcctcacctttctcaacctttataggattgaagagagttaggtattaggatctggattaggttttggtttaagggaatgttgtggctggtttgatcttttatccagaccactgaaactttctctgtataaatgataagactgttttgctttcttaacattgtgtgtcattggcgcagtgcttttaatttccttcgaggacttttcctttgcattcatgacttggctaactggtgcagttggcctagcttttgggctatctcagcttatgatacaccctcctcaggaagcttggtcatttctgtcttttgatttaaagtgagaaacctgtgattgtttttttcacctgaacacctaagagtccattgtagggttattaattggcctaatttaaatattgttgtgtctcaaggaatgggaggtctgagaagagggagagagttggaggaacagtcagttggtgaagcagttggagtacatacaacatttattaagtttgctgtcttatatgggtgcttttcatggtgccctgaaacaattaaaatggtaacaccaaagatcactgatcacataacaccatgtcagatataacgataatgaaaatgtttgaaatattgtgagaattaccaaaatgtgaaacagagacgtgaagtaagcatatgctgttggaaaaatggtgccgatagactcattccatggcagcgttgccacaaatcttgaatttgtaaaaaatgaaatatctgcaaagcccaataaggcaattcgcaataaaatgaggcatgcctgtaattgtcagttctcccagtctgcagtattatttctgaagcccttcataaagttagacagacttttccctccaatttctagcttttaccttgtttcctcaaccatatccctgaaggggctttgagcctctaatgtcttaaatcttaacatccagcactatcacatgcacaccctttttagctatcaggatgaaactgttcatcagtggcagaaagaatggctacagaatagtccacatatttcagaaaatgttcttggcttagagcatttggaatatgatgtgttattaacacatgctggctaggagtatgtagtataatttgttgagctgttgctcattggctgaaagcttacgatagtattcaaagtatgcttttgtaatagagttactttttctttctttttttttctattttcaccatagtatatgaatgtttatgcacaaagttggtgtatctgacacagacagaagaatattggttttgagtatgttgagtttgaggtaacttgtgggatatcaaagagtaattgtgcaatgggcagtgtgtaataggaatttaggagagatttttaggctagaaatagatacttaggatgattattttcataggtcattgtaaaaattgtaagaataagatagaaggagaaagtgtagagtatgaagaggactgtaaaagggaaataaatcttgggacccccaaaatcactaagctaaagggaaaagtcaagctgggaactgcttagtgcaaacctgcctcccattctattgaaagtcattcctctgaggctcatctgagacaaatgaatctctgattgcttcctctgccctattgtttatgtaaaaatgcagattcactgagccagactaaattgtgtattcagtggaaggctgatcaaggactcaaaataatccaaccttttgtctctcatctacttctaacctggaagcccccacttcgacttgtcccaccttactggaccaaaccgatgtacatcttacacatattgattattaatataaaatgtatgtcatgattatcaatataaaatgtataaaagcaagctgtactcgaccactttgggaacatgtcatcaggacctcctgagggtgtgtccttaactttggcaaaataaacttcctaaattgactgagtcctgtctcagaaatatgggattcacagggtaatggtgaattcttactagttatatgattttaagccagttatttgacttctccatgcttagtgccctcatctatgtagtaaggaaaataatatctacatcatatcgcaaaagccctaattaatgttattttctttctatgttccttcatatatttccaacctctttctagaaaatatttatagtgttattccataaaggatttaaatttggcttaggagttttctggcaaaggggcaaaaaggaaaactggatagattccatggtccttgctgtctgtcaggaggatacaaacccatttttttgaaagtgagtttttctggcacagctttatttaattattaactctttccttttcccttgagtacaaatatttgtttttacacagctccgtttttctggctcagaatggacttaaatatactatttgaatttgtaccttatattatttgcttgttagttgaaaattgctatgctaaatgataatagccaacagaagattgattagacattaattttgagttctaagataatgaaaaaatgggtaaacatgcttttttaaattttgagggcaatatcttttcttctgaaagtctactatctcttcataatgttttaatacctgctcccaggccatcacttctctacctgtggatgaattcttttgcttcatattccaaaagcactttgttgaggtagtttatataaattttttctcaggatttggaatacatagattctgagttcccttttaggtatcaagtgattcatagcaatttagcctaaaggtatgaaaggactgatgaggaaatttaacagcaaatattccaaagtttaaattgagaatgccacataagtaaatgtaacacattcctattttagttgctgagataaatgagaaatgattatcgtagacaaagttaactggatcccgtggctaattggcttgaaatccatgtatgcaaataagtaagtctctacttttattaagattgtataccccttctatcaaaagttattcattttgaggtcataagttttttaaaattacaaatatctgggctttaagaaaatgtgaaacctttttaaggtgaagattcaattggttactttctggggactaaaacttgtagaatattcttttaaaattccagtttaattcccacttgaaagctgatatcatcaactcatggtgacggttaggaaggagagaaaaataagaaaagaaaatgtctaatattttgttcatcttctttgggccagtttagttgaaaaccctaaccatcacatataaatagtttatttgggaaaaatgtattttgagttccaagtagctaatttgtaagcaaactattggaacaaagtctatttgtaaattgactgccttttctaaaatgcaccaggtgttatttttttcatgtgttttccatgaatccttaaacgcatttcattattggatgttgataatattttaattaactggtgatcatttaggtcatttctacctctaaaatttctatgattcggttagagcagagatttttggcaaatgatttagttgaattaaggtttctaaagttttaatgttcaaagatatggcacttcaatcaatattttcttgtatagacaagttaggtttattttgggaggaaattttttaaaaaataatatcctgcttctttcttacagaatttagtacacatgggcttaaggaagaatttattgtaaaaataaaatttttcttttacaatgttattacttgttttttagctttcaagaccataggtttctgtttcatttttaaaagccaaggagctaacgaagaatggaaagtgctgataaaactaggttacttcacagaaagtcttaagtatagagtttttgacaaactatgaatatttcttttaggccagtatgttttaataatatttgaaatttgacatggaatatagttgctctttaaaaagtaaagtgaacaattgactaaaattttgacgagaatattcttgataaaataaaatctgctaaaaatatgtcattcagagagaagaaggatgtcattctgatttttaaaaacaaaaaccataaaaatatttttggaaatggataatgactgaaaatttgggcttcttcagcagatttttctgttttctgcagaatgtaaagttttatttgaaaaaattcctagcactcctagaggcaaaagattgcccatatactgctgttttggttgctctgttgccagataaaatgaactagcaattatcaactactacttcttcttcttcttctttttttttttttgaaacagggtcttgctctgtcgcccagactggagttcactggtatgatcacagcacactgcagcctcctgagtagctcccatctcagcctcctgagtagctgggacgcaagcgtgtgccaccatgcccggctaatttgttggtgttgttgttgttgttttttgcttgtttgtttgtttgtttttttgtaggaatgaggttttgccatgttgcccaggccagtctcaaactcctgggcccaagtgacctgcctgccttggcctcccaaagtgatgggattacatgtgtgagccactgcacccagcctatttttcctgttattttatttatttatttatttatttttggatataggtcttgctttgtcacgcaggctggagtgcagtggctaatcacagctgacagtaaccttgaactcctgggctcaagtgattgtcctgcctcagcctcctgagtagctaggactacaggcatgcaccaccacatctagctaattttttttaaatttttatattttgtagagggagggatctagccatgttgtctaggctggtcttatattcttggcctcaagctatcttcctgctttgccctcccaaagcactgggattataggcgtaagcaactaggcctggcctgttcttttttttaatgattagtttttatatatgtattttgtaaatatgtagaaaaagatgtggccacacaaacactaaactcaacagtagcatattacccgtgggaagtgagatacagaacacaatgaagtagaactttgagttatttttctatataattctatattttataagctttaaagaaaaaatattcttttcacagttaaaattagaaatggaaaatgttacgtaggaaaataaactgcaataaaaaattttaatactatttaaattattatgacaaggcagattataaaaagtggagatgtacaactgattttggaaacaatatattatgtctaatatacaatataacgtttagaaatattaatgttctatattaccttgctgactaaactattgattgagtctaatctccaagaccttgagatatattaatgttatttgtggctctgtaattttgactattttggatagatgcttacttataaatatctttagttagtatagttgtaaagtttgcctgttttcaccttccatggatgggtttaatttcctctaaccacaaagaatagtgaaaatgcaccactctgaaacttcctaagtccagagtggtttatctggggtttagttgatcttgctaatgacactatgatctttggaatttttccctgttattttttagtgacactattaagatagaaatataggccaggagtggtggctcatgcctataatcccagaaccttgggaggtcaaggcaggaggatcgcttgagcccaggagttcgagaccagcctgagcaacatggggagtcccagtctctacaaaaaaataaaaaaattagcagagcgtgacagtgtgtgcttgttatcccagctactgaggagcctgatgtaggacgattgcctgaatctgggagggcaaggctgcagagagctgtgacaacttcactgcattctcaaaaaaaaaaaaaaaaaaaaaaaaatatatatatatatatataaaataggtatatatatacatatgtgtgtatatatatgtctgtgtgtgtatgtatatatttaaagatcaatgttagtattttactaataaccttaaaaattcttatttttcttattacttttcttatttagcttattctgtaagttaaatacacacttggaagaaatcaactcttccctattcattagaatttctctttttccctttgtcttgtattcatttttttgttttgtgaagtttacttagtgagtacttagcattaggcactgcggatagagaacaagataggcaacattctgtctttatgaaatatactgtacttccttgtctaggagacagaacacagaaataaataagatgatgtcagatattgccaacaaaaggagtgattaggactgtgtggtcctaacacatatggaattgggcaagattacacctggaggactacaaatgtttaaatatttatcaaaacattcgaatatttaaaagttataaatcaagccacatccttggcccagcctgatttcctacacagcatgttgagttgccagcagcctataccctcaagactcagaggctaaaggaactgctctctcctcccatccatctttgtaacctgcctgactgagtggtagtatggatctgttggggtagggcagggatgattggggtggtacctagacccatctaaaacagtatattaacagatcccaccaagtccccaggaatctggttatagagaggtttgcctctccagttcattgttttttcaactcaagtcttctaggaagttgtaagcccttcttaatgttgcactaccagaaaaggggatgcaggtatctgggaaacctggcttgcctgggaattcggtttgctttatttggggcaacgaactttaaccgaataaagcttttataagcagccactctttctgggatttctcatggcagaagttgtgttcattttctccctcacacatactggagcgctcaaagttctttatcctctggccagtgaggcctcattcagctagcacctctttcctgtaattgtcatttgctcagttgattactgaactttcaaaagacattcttacaaggaaaggaagaaaaaaacatctgttttagtgcttggggtatatagggctctctaaagagcaggcccctggcagaggcttctcttgcccaggtctatggatgatattgggactggggatggaggtgaccatacagtagccttttacatgctctttgacttctccctatcctgctcttcttcctagtctctcactcaatttgttttaatttataaatttgtttgatctgtaaaactaaactggtatcacttgggatacctatatctgaaaagtaagctccaaatgaaaaagaacattttccagaaagttttttggtaagattttaaatagaagtgactagttttcaagtctcactctccttatcccataggggcaaactattcagatgtgttgtagatttgaacattggcttaaatgttatgttttatttctgtccttacagctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatgtaagtattcctgctcgaatgattcagtcaacaaagaggactttaacaattatgtcagtaattgattattatttgctcataaatgtggacagattagcaagtaaataactataaattcatttaagttcttagagaactgagtaatattatttatctttgttaaagaagagcctcttgattgatggcttcattattcatttgtatttattctttgattaataaacatgtattgagtacctactatgtattgagtacctactatgtgtaaacactactatgtgtaaacatgttatgcatgttaagcagtagttatgaagtgatgagtaaaacagctatgaactctgtcctcatgagacttaccatacagtagcataggatagcaaaaagacaaaaaaacaagtaaaccaaaacaaatgttatttattatagattgagaatagtgctatatagttagtgactcagtgttgctgtggtcaatgatgtcaggtgtgggcagaggaggtaacattaagttgaagtttgaaggctattagagaaaattacgtgttagctatagtttattttggtatgtgtatttttgtgtatatagatatacacacatgggcatagtatatatatgtgtgtatatatgtatatatatacctatatattattaatctgtctttttcatttacaatttaggctttactctttactctttgttaatagttttgggtttccttttatctgttattatgagaaataattgatatgtttatttttatttttggtggtatacatttcaacccaggtaaccagtgttttagcagcatctttctaggtacataaccaataatactttatcaatccgcctagcggctcttttattgtttgtataacttctgcaaggtagtctcttagattttgatctttcattggtaattccttgcaatttactgattctttacaggtacattacaatatttacagattttcttgatctagtattttttagactatgtcatgaaaaatggaggagtcgcttcaattttttgtgttttggaaattagtgaatcccttagaagtaaataataccataatttccaatgttatgtcttgcttaagctcatttcccaatctttcaagctcccaatttatctttccctgaagtcttaacaaggattttgcatattgtaccattttctcctgatcctacttcttctccgtagtcataagaatttaagaattgcatttttggtctggttacaaacctggtgtcaagaaaaacagtgttttaggctgggcgcggtggctcatgcttgtaatcccagcactttgggaggccgaggtggtggatcacttgagatcagagtttgagaccagcctggccaacatggtgaagtcccatctctactaaatacaaaaaacattaagtggatatggtggtgtgcgcctgtaataatcccagctattcggggggctgaggcagcagaattgcttgaaccagagagatggaggtagcagtgagccaagattgtgccactgcactccagcctggacaacagagcaagactccatctcaaaaaataaaaataaaaaaatagagaacgatgttttacacagtaagcaattcttttccatgtatcatatatgaattaggtcagaacaagcaaaccagttagataatattaaaagcaatgatatgtaatatgtagatttcttttttcttttcttaaagatacaataaaagggaagaagattttcctagtctaagagaatacaatgatttcttggaagaagtggaagaaattggtacgtttttaatttgatgtatgctagcctataagaccatgtgcttttatcttttaaatgcttaggagaacatctcacataaaaacctcttaacaggttttgttgtgatagctaacatttacctaattactttcttttgcacttgagtcatgtttgtcaaattgaaggcatacttaagtaaagaacctatttaatattgtcttttaggaaaaatatgtttaatagagatagtaacacttcatagctggggaggaagactatatgggtacatgcatctgtgtgttgataacatattagagtagtttaaatgaatggaaaacatattctgatttttcaaaaatggggttcctattaaccatatttatagtgactaaagccatatgtttatcattatttgtgcttctgtggatatagtagtcttaaagtactttgaagcagttgactgttgaagtggcattctattaatcagtattattctggaatcagaggttggagtaatctttgtgccttttctttctgatgtgtttagtcaaaaggaagattttatcaagaaaaaatgatttcagttttcttaaataaaatttcagagatgttaaaaactttggaagttgttatatgttgatttaaaaaataatgctgctttttaaacttgcagtaattattactaagtgcgggtttggaaatgacacaaaggttatatactgtgaacattagaatgagactatgaggatcaaacagcaatcatttttattctttcaaacttaataggtaactgtactcaatatttactattaaaaataagattataataaaatggatcattctttagaagatttatatatgataaacttaacaattcagattcctgaggaataataaatattctaattcctttaatttctttactagaaaatccagaaaatctttttgtttcaactgttacctgaaacttttctcatatgtctaagttcatttgttatgccatagcaaaagcatgtggaaaacataatttagggtttctctgggatctttcagtgccataagagccactgcttttccattctgcatgtactcattgcactttgtatgttatcttagcaatcatgagtgactatggattttagctgaaaagatggtagaattgggagtgacaaggcaaagtggaaaagttagaatgtagactgagaagaaaaaccagaaagaaatctacaagaactgggcaagtatgaaggtatgtagaaatctggctctatatagatactaagtataggacaagctgttggatagcaattgggaagaaaagtagcttacatatattctaaaggtaatgtgattagtcaaaagtctggtcaagcaataaagggaaaggaaattataggtgttgcagtacaagttgaatacatggtcacaattacaagcaggcagtcaggataactaaaagaaacatatacagagaaggtgaggaataggtttaggggatgaactacaaggagatcttgattctgggattaagattctgactgagctatgattaaaaaaaaatatatatatatatacacacacacactgcatatatatgtgtgtgtgtgtgtgttgctccaagataaagtaatttgaaggtgtggacaacatggggcccataattggtactagaattgataggcaagagcaagtctggatattgggggtatacaacatgtaatgctttctttaccaaaatatagaagctgtggctcagaccatttaatttgaaagtgattctgctattatgtgtattcatgaaggactgtcttcagttgcagtatcgggaaactctcttaagcaacctccacttaattgtctcattgaagtaactgtcattccccagttcttccataaaaggtactcactgatacccacagcataatgaatgcattgtgaatgccatcaaccttcttatgccagttgtacttgttattgtagttatgtagttatgtaattaaatacatatttaatattatatgtaatttaaatatttaaagtgtgtaaggttggggaaaaaattgtaaaactctagaaggattctgtttctcaggtttttaagtcacttcttaaaaaatggaaattggccaggtgcagtgactcgcgcctgtaatcacagcactttgggaggccaaggcaagaggattgcttgagcccaggagtttgagatcagcctggacaacataatgagatctataccaaaattttaaaaagtagctgggtgtagtggcacacgtttgtagtcccagctacttgggaggctgaggtggatctctgaagtctaggagtccaaggctacagtgaaccatggttgcgccactgcactccaacctaggcaacagagcatgcccatgtctcaaaaaaccagaaaacagaaaaggaaactgaacaatatagatgacagttatggcctatataaggaagaagcaaaactctaaaaactagaatttgctctatgtcattaagttagagaatgactatatacttcctatatatgttttaagttaaagtatttgaagagagagacaggtgtatgtgtgtgtttctctcctttaacaaacttatttaaatgttcaactataaatcctcattgtgtttattaaagagtggttctactctatttaaagatattgatgatttttgggaagtaacctcttggatttatagtttattttctgaacttcagttcaattcagcaagtttttaaattatgttatgtgaactgctttatggatggggatatgtggtatttgccctcaataagctcagactctaaagggggagataattatgttaactaataactataatgtaatgtgataagtcttataaataggcatttataaaatgctatgggaatacagataaagcaattaacctagcactgggaaatagagatgtggtttggtgacattcagagaagagatgacatgtgagtttgatcttaaaagaagaagaagagttaaccagatagaaagggcttggaaaaacatttgtaacaaaagaaaaaggcaccgagatagaaaaatgttgagcatgttggagaatgagcaagtagtctgttataggtgggtaaaacatgagggatgactaaaaatggggcctgaaaaacaggctggattaaggaggccttagtaccatagacaacaaaagcaaaaatagacaaatgggattgtatcaaactaaaatacttcctcacaacaaaggaaacaacagagtgaagaagtaatctacagagtgggagagaatatttgcaagccagaaatctgataaagggttaatctccaaaatatataaggaagtcaactcagtagcaagaaaatacttgattagaaaatgggcaaaggacctgaatagacatttctcaaaagaagacatacgtatggtatatgaaaatgtgctaaacaccactaatcatcagagaaatgcaaattaaaatcacaatgagatatcatttcacatctgttagaatgggtattatcaaaaagatgagataagtgttgatgaggatatggagaaaagggaatccttgtatgctgttggtgggaatgtgaattagtacagccattttggagaacagtatggaagttcctcaaatactaaaaacagaactaccatatgatccagtaatcccacttctgggtctataacctatagccctattcacagtagctaagatatggaatcaacctaagtgtccatcattggatgaatagataaagaaaatgtggtacatatgcaccatggaatacttcagccttaaaaaagaaggtaattctgtaatatgcaacaacgtggatcaacctggaggacattatgctaagtgaaataagtcagtcacagaaagacaaatatggcatggtctcacttatatctggaatctaaaaaagttgaacttagagaagtaaagagtagaatggtggctaccagaggctgtgggatggatggtgggtggggaaaggggagctgtatggagttaatcaggtaaacattggagaataggcagtattttttattattttgttgcctaaggatatgaaatttcaattagacaggaggaataagtttttgaggtctattgcacagcatggtgaccataattaataataatgtattgtatatttcaaaattgctaaaagagtagattttcaatgtccttgctacaaaaaaataagcatgtcaggtgatggatatgttaattaattagataaaatagttccacagtgaatacatatatcaaaacatcacattgtaccccatagatatatacaattattatttgtcaactgaaaaaaaaagagggctttgtaaactgagctctcagttaagattttatcttgtggctaagaggagatactaaagagtgagaaatgacttttcaaggggccattacagtaatttggatgagaaataatgagggcttggagtagatagtcacagtggggatagataaagaggatattttagacatacaatattcaagtggttgatttgatgtaggaagtgtgttagagtaggcaaagataaattcaaatattatgacctgaccccatgcagttgtatggtgttaatcaggtaaacccgggagaataggcagtattttctattattttgttttgttgggtgaagcgtttgcagaaatgagagataaagtgaaaactttagttttagaccttttaagttttgttagagtgtggctccaccacttagttgtatggcattgttcggtttgtcatcatataaataaaactttttttttttttttttttgagacggagtttcgctctgtcgcccaggctggagtgtagtggcacgatctcggctcactgcatcctccgcctcccgggtttaagcaattatctgcctcagcctcccgagtagctgggattacaggcgcccaccaccatgcctggctaattttttttttgtatttttagtagaaacgggatttcaccatcttggccaggctgatcttgaactcctgaccttgtgatccacccaccttggcctcccaaagtgctgggattacaggcgtgagccaccgcacccagcgaaaacttcctgtaaaaatcttgtttcaatagctttctattttgtgttgtattcatatttttaaagatagttagatgtctgtgatatctgtattatttgtgttaatcagaagtataaaatgttaatttaatggacatttactaagtaccagactgagctgtacacacattatctcataatttttgaaactctaagagacaggcatttttattcctattttgcatctggagaagaggcacagagagcttaagtattgtgcccaagactgcattgctagtaaagaatggagccaaattgtaaatataggattttcttactttctgagtctagaacatggagttctatggaattattagagatgagagaaaaaaagtagtttggggccatattttgaaggatattaaagacatttgaactcgatcttataggtagaagggtgctgttgaagataaacgtttaaatctggagtaagaaaactagaattattagggtgcctcagagggtcagtgtttgaggattcataaattggagattgaagtaattttgttgtataaatttcattatgaatcttttgaatatgaatataaaaatgaaaacattataattttaataatagcatcaaacattttcaatagaaggggcacacatgaagatggactttcttatggcattaacaatagactcttttctgtggttatgacaatctatacataaaattcttgttccttatggctccagagattatctcaaaggtttattcttagtttcataatgaacagattattcttttggtgcaaaacagattattcttttggtgcagagaatacttatcttaaaagggtgagaaagtcctaagggctttaattataaattctggatgtcaaaaagacttcaaaattgtacgtgaataacattaaatctttcagaaaatacaataggctttttgtttgcttttaatacttgactaaaggcaggtcaacatctaagctaaaccagtaaacagataaagggtcaaatgattgttatagcaaattagcttctattcctttttcttcacggctattgtaccaacctgattcattgggtatgaatgagacctgcttcatctgaaaacttttaaaatagtaattcacttttatggttcttttcttactttttaaaggaagagacttgtattatctgattatgatttgcatttattattgctgttacctttgcttctaaattaaaatctgaaacaaattattttactttttttggaattcataaagttttcttttttaaatttttatttattcatttattttttagagatagggtctcactctgtctcccaggctaaagtgcagtggtactatcatagctcgctgtagcttgaaactcctgggctcaaatgatcctcctgcctctacctcccaagtagctaggactacaggtgtgtaccaccacacttggttaatttaattttaaaagtttttaattttatttttttggtagagatggggcctcatgttgaccaggctggtctcaaactcctggcctcaagtgatccagaactcataaagtttttgataagcataaaagaaattgcttatataaaaacagattaatttcacttaggatttaagtttgcctatttctgggctctatttaatggaaaagttaaaatcagtagtaaactgtctagtttgctaataaacagtgttttttaaactgttttgaacatactagtagagctctacatgggatatcaatttgaccgcttacttttcagtagattcataccataagaaaccaagataatttagtcctgtccttttgaaccttcctcctttgccatgttcaaatcagtaattataaaggttattttagttaaatctataattataaaagtaattataaatgttgggtattagtttattttttctctcatgataattcaacaagtatttcttgagcccttaccagatgagaagttttttctttttttctttttttttaaaagtagacttttttttagtgaagtttcagattcacagcaaaattgagcaaaaagtatagagaattcctatatatctcttccctctacatgtgcacagtgcacagcctcccccattattaacatcctgcaccagagtggtacattgttacaatcaatgaacctacattgagatatcattatcacacaaagtctgtagtttacactaggattcatttttggtgctgtataccctatgagttttgacaaacgtataataatgtgtatctaccattatatcatacagagtcattttaactgtcctaaaaatcctttgtgtttttctgtgtgtttattcctccctaccccaacccctgacaaacactgttctttttagtttttatagttttgacttttccagaatgttatatagttggaatcatacagtatgtagccttttcagattggcttctttcacttagcaatatgcatttaaagctcctctgtgtcttggctttatagctgatttctttttagtgctgaataatattacatttttttaaatctgctgaaggatgtcttggttgcttccaagttttggcaatgattaataaagctgctgttaccattcatgtgtgggtttttgtgtgaacatgtgttttcaattcatttggataaatacctaggtgcttgattgccagattatatgatagagtatgtttagttttgttagaaactaggaagctgtcttccaaagtggctataccatttcacattcccaccagcaaggaatgagagtccctgttgctccagatctgcaccagcattttatgttgtcattggagttttgccattctaataggagtgccttagaagtagtggaagtgataataaagatgaatcagacctagaaactgccctcaaggaacattctaataggtcagacaagatgtgcacattgaaaataattatacagggtaggaagtgggtaaatgccagcagagcgatattagacaatgtattgtaagcattcagggatggagagattgtaactgcaaagtgtctcataaggaggagctggtcattaaaatgggtatagaagggtgagtcatatgtggatattcactgttgttctgggttgaggttggtactgagatgagccctatgggtagggaacagtttaatcacaggtatggaaatgggaaagtgtaggggcatacaaatgcagaggactgctaggtagcagtggttttcaggcattgagagaaatgacacaactagttttgtaggcattgtagataaaagttcaggtttggaatcagatagcctaggttaatggctgggcatggtggctcacgccagtaatcccagcactttgggaggccaacgcgggtggatcacttgaggccaggagttcaagaccagcctggccaacatggtgaagccctgtctctactgaaatatacaaaaattagccaggcatggtggtgcatgtctgtaatccaagctacttgggaggctgaggttggatctggtagatgttgaggatggtgagagttgtgaaagatcattggatttggttgcttagaggatggcctattaaatacaagaggtagattgtgagtggttggtaaagatagtggaatcaccattttaactaaggatcagaggtaactttttgagagtgctgcttgtctggagcctccctctgactgttttgtgtcaggactagagtgtgatttatgaagattgtcccacattgcatcctagccagattccctgacttattttctttcccactttatgttaaaaaactggagaagttgctagaggataattgcttctcattttctctcaattcttccagatttaaaattgcgtatgataaaactgaatagacttttgcctttatacctaaatgagcctggattttcaacagtgattatgacaaattgatgttctgaaataagttggccttttgagaagaaaaaaatgaaattatagatcaaactggtcatttgagtctgtttgatggctttactcaacaaaacaagcaactctgtgttggtcctccggtgttacttttcaactcttataagctattaaaggaaagagtgagatggggaagcaatctgtagaaacccaagggatagagcagagttatttagggtagatccgtcttgtttgtagggcaagaagcaggaagcagtggtaagtaattggagaaggggtggaagggctaataatggatgtagaaagattacaagggaagctaaaggaggcttgaattgaattatggaacaggagagtcttactgatatggattcctccatatgagtttatatatagcaagaaggtctttttttaattgttcagagtattatagtaactttgatttacatatggaaaattagaagggaatatggcattcataattcaaattattttgagttggaattataaaaagagagttgtaatttacagaaaatttagtagtatctaaacatgtctcagtggttctcttaagaaattcttttactttaagttttggtgccagtttatcctttatttttcttcttaagttccaactcctttatttcatacgtttctagagctagactacaagggaagtaattcaagcctgtgtctactcatgttggagacaattggaatggggataaaacctgttttttgtttgatataaattataaaaatatatgattttttaactctttttttaaaattctgattcttgtagtagattccagacttactctttatattaaaaaaatttaaacaatttttttatgcttttaaagctagagaggggactataaaaatcagatctaagcacatatcttaggttttctggagtgatcctgacatttaggtattttgtgcgagtcagacagtctgtccttgtgtttggcttggaaaacatgtttgccgtaactagagctagtctctaaaataggtagctgattaaaaggtcacaaatagagctataaagaatgacaacctaacaaatgagtcactgtggtatttgttttttattgtctactcaagatttatattaaaaatatttttcatgtcatcgtttcctttctaatgcagttttcaacttgaccaacaatgtggatttggacaacaccaaaaagaaaatggagatataccaaaaggaaaacaaagatgttattcagaaaaataaattaaagctggtcggttgctaagtattttcttcttattttgtcttagaaacaaatgtttccacatgatactttaaaaagccatcttcctttaaaccagttacatttatagaaaatttagctgaaatttagaccagaaatatgaatatatgctgtataggtatgtaggtaggcaggcacacattactgtagcaaaaaccactttgacagcattatgttagactgtgctttcttaaggaagtggatccgtaagataggtgattgttaacgctagttttatctgcctgtataatcttctggtaagtgagcatttggacagtggtcacaaaacactggaggctcatttttatccttggacattaatttctctaaaggagagagaaaacccagacagacggtgatggagctaccaagagggagataaaacaaaaacactatttattagaaactaaaatgaattcatgattagatcagaggaacacatttgtaaactaaggttaactttggtttctcaattagttaccttttttgttttaccgaaagagtaacattgctagatataaatatgattttggtttgttttagttgatctcatgttgaagtttgttttgaaaatatctcaggagtcattattattatatgtattagaatgtattctataaagaaaaaattgtatgcatgcaaaggagcaattgtctaatttatacactttagctatcatttctatagtacagtttggctttctagttgtaggggaaagcagaggtaattacgtttgagatactttatcaggattttgtaataatcagtgaaaaggatacaagtatatttggatcacatagcttatattttcattttgtatttagaagagacttcctccttgtagtcttatagtgttttatatcagcatttctttcctgctgtaaaactctcaatgaattgatactacattttcattccattcatagctagcctagctttcttttaaaagtatcttatttctgagagcatcagtatgtcattaatgttactctctttgcctagtaaccttctctgggaacatcagaagatacatgcaaaataggtatgcgtaggtaaaatgtttcattaaccccaggtgttggtattacagatgtgagccaccacttttatcatgaaagggcgttacattttatcaaagccttttcctgcatgtattgatatgattatgtgattttaattctttattttgttaatgtatattaattgattttgtatgtcaaaccatctttccatcccaaggataattcctgcttggttatgttgtatgatccttttaatgtgcagttggattcagtttataagtattttgttgagaatttttgcatttttgttcatcagggatattggctcacagttttctttccttgtggtacctttgtctggttttagtatcagggtaataatgctggcttcataaaatgagtttggaagtgtctccctcttcaattttttagaaaggtttgagaaggattgatattaattcttctttaaatgtttggcagaattcaccactgccgctttttctctgttaggaggtgtgattactgattcagtgtccatactagttctaggtcttttcagatttcctgtttcttcataatttggtcttggtaggttgtatgtttctaggaatttgtccatttcttctagattaactgaagcgtaatataattaagtgttggtgtataattgttcatagtagtctcttatgatccttttatttctgtggcatcagttgtaatgtctcctctttcatttctgattttgagtcttctctctctttcatagtcttgcaaagagtttgtcaattttatattttgaaaaaacttaattttgttaattttttctgttctttttctgttttctatttcatttatttttgctctaatgtttgttatttattttaatcctttgttctgcttactttgagctcagtttgttattaaatttctagctccttgagatgtaaagccaggttgttatttgagatctttcttctcttttaaagtaggtgtttatcacaagaaacttccttcttagtactgcttttttgtatccctcaagttttggtatgctatgtttttgtttttgtttgtcctgaggtattttctaatttcctttttgatttcttctttgacccaatgattatttgagtgtattgtttaattttcacatatgtgcatatttgtgaattttccagttttccttctgctattgattcctggttttattccattgtggtcaggaaagatacttggtatgatttcagtcttcttaaatttgttaagacttgttttgtgacctaacttgtgacctatcctgtagaaagttctgtgtgtgcttgggaagatcgtgtattccgctgctgttgagtagaatgttctgtatatttctgttagttgttataacagaaatatacagaattataaagttgtttaagactcctatttccttactgatcttctttctgaaagttccatccattactgaatgtgagttaagtctcctactgttactatattgctgtctatctctcccttcagttgtcaatgtttgctttacatatttagttgtttataattgttatatctttctatatgttgatccttttatcattatataatgttctttgtctcttttgacagttttttaattaaagtctattttgtctcttattatgctctttgtttcagtgaatggtgccagcattcatccaagtgttcaatccatatttggtcagtctttatattctgttgatgatcactccttatcatttttaagcctcatccccactctaattagattattactttatttagggctcttatttctattctttctttttttttttttttttttgagatggaacctcgccctgttgcccaggctggagtgtaatggtgtgaacttggctcactgcaaccttcatttcctgggttcaagcgattctcctgcctcagcctcccgagtagctgggattacaggcatgtgccaccatgcctgactaattttttgtatctttagtagagacagggtttcaccatgttggccaagctggtctcgaactcctgaccttgtgatccacccgccgtggcctcccaaagtgctgggattacaggtgtgagccgctgcgtagggctcttatttcttatctgggttatttgaatatacttctaactagtcctcctattgtcagtcttgaacccaattgatctttatgtataccttactgcctctagtcatctttctaaactcatccctcaaattcccttaatatgttcccagtggccttagtatagcaaaattccactagtatggtataacagaatagttgttttatttaatagtaacgtgtctacatgaaataaagtaaattctattttcttcaatatggaattgctacattattaaataataagtgactagtgtgttttatgcttccaataaagaaagtattagagtgtggtatatgattgctcttggctcctaaatttattccacgccatatataaatttttgttttagactcgagaacaggaagaactggaagaagctttagaagtggaacgacaggaaaatgaacaaagaagattatttatacaaaaagaagaacaactgcagcagattctaaaaaggaagaataagcaggcttttttagatgagctggtatgtattaatgctaattgtgattgtaaaaaacattcttcaggatttacctttcctagtaggctggatgatggcatttaaagggcttttccacagtgtttgtaatctggttcacctttagttttgttggttatgtattgatatcagtgtatttattgctgaataagaggttgccctccatccacactgaacaatatgtttttatgctcacaattctgtgggttaggaatttaagtggttcttttgggcttttctgcttccctaatgtattctcaggacacctctccatgtggttttgatagcgacaggaggcagccaaatgcctaggcagatagggacgggtacccagagaaaccccatctccatgttgaagacagtttaaaacctgaaagccaagctacaagttaaatccttggaccagattgagaacttgtcctcctgtttggtgtgctttcctctgattgatccccactcttcacctattttatgtatatctaccctttcctaattggttttctacactgtcatgcccatctttgagtagtgtcttcacttcaaccttttttgcttactcataagctaattcagcacattctcctcatcctgtgcctataaagaccccagactcagtaagtagaggaagagacaacctgacttcggggaagacgacttgctcttcctgtcccctctccagctcccctctctgctaagagctgttttcatcgctcaataaaattatcaccttcgccatcttttaaccatccctgtgacctcattcttcttggatgccagacaagagcttgggacccaccaagtgtgggtacccagaaaggctgtcacactggcactttgcccttcctggtggagagcagctgccctaggtgacaaggccagaagccaactgagctgccaacacactgttgtctgatggcagaactaaaggagcactgtaacacttcccctggggctttggggttgtgggccccctcacctgggcactgccatgttccccttgaggcaacatgcctggtctggctgtgggccccacgtagagtttgcttctgtgtccgtgcctggggcggatggctgggtcctgcacttgcttgcttgtgtctggtctgactgcgggccccatgcaaaacttgttcctgtattggtgcttggagcagctggctagatctgcgctgactcacccacgtgctccctcccacatagagttgagtgcagtgggtctagtagaggggagtccttaccgtgaatctagtgaaggggctgactacatcagaaactgcatcaatttctgtaacagtgtgattgtacttctcacatgttggctcagggttacaagagagaatatcccaagaataaggaggtagaagatgctaacattttagggcttgggctaggaaactggcacagcactgattccaccatattagtaaaagagcccactcagttacaaagggaatggatatagatctcacctcctaatgggagtgtgatggccatctttagtccacacagtatgtactggggaaaactatgtttttctagaatttggcataatataaattcatttgggatactcagtctctatcccaatgtgagtttagtgataagaattatgaaaatgactttcattttcatattgtagtttgtcttacccttatgcctatttatttatatcatgccaactactatgaaggatttaaagtgatttcctagataagagtattgtttgtggacatggcactacttactttgtgtaactctaagaacgatgttaaaatgaggttctagtatattttacttctatatttttaaaaagatttttgtttaatatccattttattttcagatgagagagtgacattataactgagatgagccagtatattcttgatagattgtttatatggctttaagctaactgactaaaatacattgtttctgaagcacttttctcctgattaatactatttttctaataatgagctcattttggctccatgctgaagtttatattgactgtttactttgtgacaatatattttatatttttgcataaaaaaatagtgtatttttgcttgaaagaaatagcggggtttttgcaaattattgttttccagcaattagcttcctaggtagtcaaccttgttagataatgacagtaataataactaaggtttatgaagtgtttcatggatttattactatattatttgatacttataaccctgtatgatattgatgacttcacaaaccggaaaatcttcctctccaggaaagtctttttgcattcttctctttccctttatgttcatataatttatttccctgaggcttttgtgtttgtgtgtgtgtgtgtgtatgcagtgttaatacacttaactttcttgtctagttgataatgctattatcctatgattggggaaaatatgtatatatgtgttcttctactgtgcttttgccaaaaaagcatttaagtcagttaaccaggagtaaaaaaagagaaagcaagattacttaaattataaggaggtgagaaactaaaggaaaaataagggtaagggcattcatgaggcttagatagaaaacactgtcataaaactctattttctatgactggaatgtgaatttggctctaaaaatgaggacaccagcatattaaatagaataatgacgccttccctagcaactttcattagttctttcttgaaactattaagtggcaggtatggctttaacagtgaaatgacatgttgtattttatatttttgtagctgtttggtgagaaattaaaaactttaaaaatgaattagtaaattgatgttactaattattagtatatagttactaattataattgttttattgaaagattcttccccttatcattttatacaaagagttacaggctcttttttggataatgcttctcttctatataattaattgaattaatcccaaatatagaactttgatagaaaatatgcttttaacattttatgttccatctaataaaaaaagtttttagattttattttgaggttagccagctttgcataacaattattcttgcatattctttttccctttttttttttgagatggagtcttgctctgtgccccagctggagtgcagtggcgtgatcttggctcactgcaacctctgcctccctggttcaagcaattctttgccttagcctcccgagtagctaggattacaggtgcctgccaccatgcccagctaatttttttgtatttttggtagagatggggtttcaccatcttggccaggctggtcatgaactactgaccttgtgatccacccgccttggcctcccaaagtgctggggttactggtgtgagccaccgcgcccagccgcatattcttttagtctttaaagtactgttttgctgcctcattgagctgctattgacatgaagctcccctttgattcagtgaggcatgaagcaagatgtgaaactaccattgttgtacattgtgtgtaatctggagttaatattgatttttgtgagttctttctcccacttcctgttttcttcacctgcaagtcattactgcacatactttcctcagtgtttagatcatataacatgatgattaaataattcttagtaatttactgtattcattagtgcaattaattacaacagattggtttagaataccactgcagtttgaatgtctggttttcatttttaaacttatttttagattttgttatgtttatttttcagtctttatacaatgttataaatgttaaaatactttaaatttttatgactaatgaattcattaaatttatttttatcctcttgaatccttattaactaagtaaaagaacgtatttctttttctgtatatgttcatgtgtgagattttgtttaaaaaacaatagcatttgtaaatatgtctagaagcttaattcttataattaatctctggacctaatttacacaagtactacttattagaatttttttcctcctgtttttggttctggtctttgtgccaaaagtcactttttaaccttttaaaaagtatttgcattatattatactgtatgtgacgggattttaatgttatggtcttaatgtttatggcttagtatttgcagtaatgttggctaaaaggtccatttatttaatcctaactgtaaattcaattttaaaaaacagtttggaaaaagatttttaaacaggtcctggcttattaaatctttttatattcctgtttgaaaattcgcttcagtttatgtcttaaattttgtatgggctaatattgttgtcaaacgcagtaggtgatttttattagaaatattgtttgccagatggcttgcttaaagtcagttaaaataatcttttaaaaatggtcattataaagcttttaatgagtattacaggcagttcttactaaaatttctttaaatattaaacagtgtgccttcaggcaattaatacaggttagggaaccttttaaggtaaaatgtaatgcaaagaatgaaataacttgaaaggctaaatctgcatgttagatattccccagagcatgcatgtttcacatagtttattttactccattaatattttttgttgttggaactcctacttaattctagtttaacacttagtaaggcttccaggcttcaaaatttgagtgctaaaatagaataaagtaggttggaactaaattctgtgcttcaatatcaaaagtgttttagatccttagaatgtttgtttttattagatttcagctgtttaccaagacactttaacattcagttccttttatgtgaatgtgaaaccaggattaaaacaagctaaagtcttgactagcaactttttttttgaagttaatacgttgcttttatgtaagaatttttgctttttaaaggaaataccagttaaagaagagcacttgaattgatttagagtataaattgaaaagcaatacttttaactttttagctaaggaaatttatttttcttttgttagtttctacatgtgaaaagatagaatagcttttaaaagatatttttttgatcacagcccattaaaaatgttctttaattttatattttattataaaattcttaatgtaaatctagaatagctgcaaggaatcttagcaatacagttactcatgcattactaatgctttggtgtagaatataaaaggtattctagtatattctcctcgtactatatttcatcacttttccttcattattgttaaagccaggtcttaatgattttgctccttaataagtttacatcttataaataaataaaatttgtgttcttccatttactattaaaagttttaaactttgtaacattgctcttgcaaaacacttctattataaaatcttgatgtgcaactttattctaggacaattctattgaattaagttgcttatttgagttatttctatactgtaaccttaaaccaattcctttaagtctgttaattaaccacatttgtgcctaaaaaattattaagttgctagatttggaaagaaaattaaaatctgtatgtttgctttgtgctgtgaaatgttaacaatagagtttcttcaggatcaaattctgtgtagtcactattttaacatctatagcctctttgaacaatatgttttagcacattatcctggtataggagataaaaatgtatttgaccttcatctctgtttatgatacagaaaattctcaatctctctctctgcttgtgtgtttgtgtgtgtgtgtttgtttgtgtgtgtaggaaagagagagagagatctcttcttcctcctggtacgtccttctgcatatgtttttggattcttatttaactgaaaactcagaaaggaaaatgtctggatatcatttagtttagaccttaactccacagcactttaaagatgtaagaggacttcttgttaaacagaataaataacagtctacatataaaaattagtaatttgcttatggtattaaaatgtgtctgggtgcttataattaatatattaaaatgtttaactgtcattttgttacttaagttagaaaacatagacttaaattttaaaagtaagttagtaaaggagaaaataaatatacttttggttgtacttacaatagtttcattgtgcaaaatagaacaaggatcatttccaaacggtctcaggtgaaatctaatgggaaacaatttcaaactggtctaaatttactggtaaaaagaatgcgtcttagataaacatctgatctaagttatagtactttgtactactctttttgtgattagcttatttttttcgttttaataaatgtggttggtttgctagttgaaataggaacttttaatgtggattttataaaaatacttgtttgcaggttattttgatttatgaatctacaacagccttttcttattatggaatgttaatattttttgtaaagtgtcctccataatgtgaatatttagtttgacatgaaatgcttatggaaaagacataatttaaaataaaagtcttgttgtttttagttttccctttttacatttcttattgaacttgaactattcttacaggagagttctgatctccctgttgctctgcttttggctcagcataaagatagatctacccaattagaaatgcaacttgagaaacccaaacctgtaaaaccagtgacgttttccacaggcatcaaaatggtaagccttattttaattgcttgtttgaaagatattttttcaaggattatgctttataattttacacgatttctatagtaaaccgaaatgttcagatgtttaagaacagtgtctgatctagttttaggtgtctggaaatatggatgggtgcagtatgaggaaagtgaaacaaataattttcagagtatacaacacaatttttttgtatgtgaattgggtttgtatgactttcttactctacttacatttttaagcttgtagtgtagaaaaaaatttataaatattgtttggagagtagttaccatctgcagatatgaaatgggaaagcaaatgtatcaattagtgttttcttctaaacagtcttcttcacatatatatttttaaaaactctgaaagccatttttagtttctagactgatgaatagattaatttgggtttcaaaaaatttattttatattgtattgttatattttattgtttattttagcattcaagggaaagattttataagccaatgatgtttttgtatacttttacaggtttttttttttgtttagaaaatatatactttggcatattaactttaacatgtgtttaatatttagatgtttgagatgtagccactctaaatatgtagcattcaaattcctaattatcttttaaaatagtctcattagagtagtataaaatgtggttagaaaagataaatgtttgaggtgatggatatctcaattaccctgttttggttattacatattgtatgcatacaggtatcaaaagtaccacaaaatatatgcaactactctgtatcaattaaaaactggttttaaaaaagttgtggcagcactacaaagtcatggttacggatttggactttgaatccaaacagacctgagttcaactctcaacaacccatttatccagcggcttgacatgaacaaattactttgcctttccaataagcctttttttcccatctgtggaacggtgatgataatactgatctcataaacgtgttgggaaataatgtgaacaaagtacacagtatagtacttggcttattgtaagctctcaataattgaggttagtttttattgataataacgagttgataacacaaatggctatactaattccctaaatctttacctagtttttatatacataaaattcatttttatacatagttttaaaattcaagatgatggaggttgcagaatctttgtttggcttttatcattatatgcctgcatttcaaagtcagtgttaatgacatgcaatattgaagtggtgggagtttactggtaaaagaccagtaaactcagtaattttcaagaataaagtctagtattcagatgacacaatgtagctacaagcctcaggaatgtatcccctattgtaaattgagcatgatgagtatgcaagaacgaatgcctcaaaacattatcaaagtatattttaaattagagataatactctaattttaagaggcaaaggaccgtttctttcctttgacctcaatggataaagtcatatttaattttactgttgcttccactttagcaaatgtgtagcagctgctcctattttctagttctcttccttttatagtatatataatattaaaataagatctggcttacagtctaagtagaagatacaagaactcatcttaagtcttttgcaactttttttttttttttcagttgctgactatagaatttgaaaatctagatacttcggtattaagttggctctacttttaaaatttatcttgaatttacccacttctctccacctcttatcatcttaggataattgccatcatttctttagtggactatcacagtaacattccacctggtgtctctattcatctgtgtaccccataatctagtctataagcctttgggtggtttcctaaataaatgaatgatggtaaataaacaatattaaacaaatcagctcatcacctccttgcttactatcttcctatgtcttcccagtacacttagaataaaattcagaatattatctactttctcacctctgagaaagtgacatttgtactaagaagtcaatggtaaaatggagttagccatgcaaaaatacaggcagagaaaagagcagtaaagaaggcctaaggtaagaaacagcattttctagaaacagacaaaagatactgttaagagaatactttccctactctgccttgctccttatgctcaattcacactgaccgtttgactattctatctaaagtatctttctcctgcccccatccacattatgttatgctttttaaaattttaatatagagacagggtctcactatgttgcccaggctggcctcaaactcctgagctcaagtgatcctcctgccttggcctccaaaagtgttaggattacaggcatgggctaccacgcctggcccatgttatgctttttaaccctttataacatatatcactatcagaaagtgtcttatgggtacactgtttaatgtttatctttaccactggaatataaattctgtgtacctagaatgatgtttgtctctagtacctatttaatgaatgttcactgtggaccttcattaaatatttttaaatgaatgactgaatcttacatattaggctcacatttaatagaatgaagatcctgaagtactttcaagtttctgtgactttatggtgtttactctgtttggaatatacttaactgcttatgaaaactttacttataatttatgcatcgatcaagtgtgattttcatgaaccctcttttgtgtggaatttaattgcatattctgatgcttcccctaacattttatatgtacttttattatatattgtagctcctgccttgtattgcaattggctattttccatgccggtctcattttagatgagcttccttaaggacacaatgtgttctgtggcataactttatgtgttcttgtggggactaaatattgtactatgtaattattcaaaaaatttttttgaataaattattctcatttttcttaacttcagagcattttgctttgccattgggagattcacatttgggtcaagaagaatttgatgcaatgtacagccaaaataaaaaaattgtttttatagatatatctaaatttccatcactctatcatatttttacattccattaccaatgagaattacaaattatgtatttctcttcttctgtgttcttatcttttaatttttacctgtggtatgttttgaaatttatataacctggctagccctcttagatagtcttagtgcttttctttggcctaaagagaggcagcatcagatctacaaccttttttcacctagacagaatagttgctggtggtctttctgtgtttcgtaatgttctatttatttaaaaatgaaatgaattggaatggcgagatgtaaaagtttttgaagatcactgattaataaatctgctaacctgaacatgatatgaacaaaatactctgcaatgtatttccttgaggagattaggaaatatatccattgtggcaaagttgcttcaccagcatactttttaaattatttatttattttaaatttatttttagagacaggatcttgttctgttacttcaagctggagtgcagtggtgagatcctagctcactgtagcctacttctgggctcaagccatcctcctattgcagcctcccaagtaactgggtttacaggctcacaccaccactctgggctagtttttaagaattttttttttttttttttggagaggaggcagggtatagttatgttggccaggctggtcttgaattcctggtctcaagcaatcttggaacgcctcagccttcgaaagtgctaggattacaggtgtgagccagtgtgctcaggcgggagcctactttattttttattttgtttttgagatggagtcttggtctatcgaccaggctggagtgcagtgacacaatctggactcactgcaacctctgtcccctgggctcaagcgattctcccacctcatcctccccagtagctgggactacaggtgtgtgccaccacacccggctattttttgtaattttggtagcaatggggtttcaccatgttgcccaggccggtctggaactcctgagctcaagccacctgcctgccttggcctcccagagtgttgggattacactgtgcccggctgaggagcacacttttaatgatgaaagaagtttcaatctcagctcatcttggagcaaatttaataaacctccctctactctgccttttaaagtattggatgaagaggtgggtcttacaccctggctttaaggtcaacaaccttgaagactgacaaagggatcaaattctaaaactgaaaactcactacttggagtactctccctttagctatccctgaattctgtgagagcttgttagcagcagtgctctctgtttatctgattacttttgagtggggattggggagggggaatgtgttgcacagattttctttttgcctgaaggggtatcttaccctgagtttgtttgtaataatgtttaacattctgctgcaaggcatatagatttggagaggaaaaaaaatttctatctttacattgcctttatgttcttctgaatgtctttctctgagtggtatttaagacttctattacctttaattttctttcttgcatcattaccttttatatctaagaaatcactgtacttgtgggctgggcatggtggctcacgcctataatcccagcactttgggaggctgaggtgggcggatcacctgaggtcaggagtttgagaccagcctgggcaacatggcaaaaccccatctctactaaaaatacaaacattagccaggcttggtggcaggcgcttgtaatcccagctacttgggagactgaggcaggagaattgcttgaactagggcggcagaggttgcagtgagctgagattgtgccactgcaccctagcctgggcaacaaagtgacactccatttcaaacaaaaacataaacaaggctgggcgcggtggctcatgcctgtaatcccagcactttgggagggtgaggcgggtggatcacgagatcaggagttgaagaccagtgtggccaagatggtgaaaccctatctgtactaaaaatacaaaaattagctgggcacggtggcaggaacctgtaattccagctatttgggaggctgaggcagaagaatcgcttgaaccagggcggcagaggttgcagtaagctgagctcaagccacagcactccagcctgggcgacagagtgagactccatctcaaaaaaaaaataataaatcaccattcttatgagattgtgataaatataaaaatgccaagctttgatttgtaatatatgaatatttttcttttccttttatgtatctattcatttttctccccaactgcccatccagctactttctttgaattttaaaattgcctaccttgtttgtcatatgtgtactagctattaggttataaacatcttgagggcagaggcttcatattttaacatagttttatatgattgtggctatgtaggtacttaaataatatcagatattcatgatcagtttcaaactttcaaatgttggaagtattaacacatcttgaaataatgtaaagacaaatactactcaataaggaactaccaaagtatttgaattaggaggcaataaagtatagaagaaagaaaatgggcataacgggattaaatcccagatttaccgttattagatatgtttccatgggtaagatattgctttactcttctgagtttgttttctcatttgggaagatgagaaatgttaacttcatatgattgtttagaatattgaaatctatacataaaatgctaaagctggtgcccaatgtatgctagccatgtggtaaatagtaataattagcaaccataatgttaccattaatgtttgttatttttcgtagttagatatataaatgaattattttataatgcccttgaaccaaatgctgaatattgttataagtattctgtcacatacttaagttatattactctcaatgtgtgttaaaatattggatcacttacccccaccccattggatcaattccagatggataatagaaaagtaaaacatccttaagagagtgggaaaaaaacaagccacaaagtgacaaaagttatttacaacatatgtaactaataaaaggcttagatccagaaggtataaataactcatatatgtgatctagagtctggaacaggcatttctaaaaataggatagccaatcctcagcctcattagtgactggtgaaagaatatgtagattaaaatcacaacacagcactaaatacccactagaatggctaaactggaaataaaaatcacagttggttcaagggaaaggtaaaatttagaatggcatagtatttacatgaattcattagtgtcaattttttactgaatgtggagactgacacagaatacagatgaaagtctaaatgtttatgaagttaagtatttttatagtctttagaaaaatcaatcctgaatgaaggatgaaaagtaacattaagcaactatatcccaggggttgattttgttgaacgcctgctataagccagcatagtctggctgctggatatgcaagaatacagacattacttaagaatttgtgacctatgatagttcttttttataataagtattactttctgtttttatatcttcataaaatagatggtattcctatttttacaaatgtgaaaactgagtctttgagaggttaggtcacatttaaaagatgatgctgaaactcattctctttctattacatctcatttaattaatgaaaatattaataaacttacacattctgattcaggtgtcctctgagagctaagatttgaactcttgtttctaatagtgggctgattgtatgacctaggtaatttaaggggcaggagtcagcataataactttcttttcctgatctgctctacttaaaaaaagtcaaaacacaaaatgaagtcggatgtgctcaacttggagaggaaccaaggaaggatgtataaatatgattaaggtttctggaaatagatcctttgagatgtgacagaaaagactgaatttatttgtttaataaacctagagaaagttgaagggttcaaaatgggcataaaataatgactaagaaatgaggattttattattatatattcacataggtagggttcagtcagtcagtgaacatattttgattaggaatattatgaaggttgtgccggatttattatttgaagtatattttctaggaattaaactgtcagggggtggagtaatgttaggcatagggtcttagagaaattaatgtaatttgtgacttcagaatttaagaaggttctacttatcactattttatgcatgaataggagaaatttttttcttttttttttttttttttgagatggagtctcactctgtcccccaggctggagtgcagtgatgtgatcttggctcactgccacctctgcctcctgggttcaagtgattcttctgcctcagcctcctgcttagctggaactacaggtgcatgccaccatgcccggctaatttttttttgtattttcagtagagacggggtttcaccatactgaccaggctggtcttgaattcctgacctcatgatccacctgcctcggcctcccaaagtgctgggattataggcatgagccaccgcacccggacagaaacttcattttatagattattgtgccctctgtgtggtgatagcttttgaactcttaaagtgagagctacaactttgtttcttggccaggtgttagttattttgatctatttggttcaaatcctgtcaatataattatgcagccttctatttctttatcattttacaaatacttctaattatttttacttagcttatggttatggttactattcttcattacatcattcttagttgaaccagtgaacagacctcaaagttttttttttccctgattcattactagataatttgtgtcaataaatatccatgcaagtaaatcttagtcttttgggaacaagcgaaggcacattggtcatctcataaattaggattgagattctacggctgaggatctggtgcttcttcattctattttgcttgtttgcaaactgaaaataaaatgagtcacaaagataacctatggatgtcaaaagataattgtttttatgtcaaaagataattgttttatggatcacaaagataacctatggatgtcaaaagataaaagtacttaaaaacaaaagaattgtttttaagtacttttgatagtctgtggttggtttggggagtagtatggagaaacataccatgcattaacaaaggggaaaactttttaagtattttaaccctgatgtttgaagagtttaaaaaaatattatctatgggtgagccagaagggagcagagtactcatttgtgatataaattgccttttctgagtgcaacagatagtatttagctgttcgctttcaagcattgcatattcctctgaactcattggaagatctaaccttgataaaatatgtgagttatagaaaattaatacccgttcgtatctgaaaaagaaaataaaaattacattgagcagtcagttatgtcctgtaaagccataagtttgtgccaaacagcttaggtgctttaccattttgccaaagaacaaaaaacaaaacttgaccaggtgttattaatttattctatttttaatatataatttgcacttaggtagtaaatcaagtataacaactaaagaagtcatgtgccctttctcaagtcttgtgatatgcacatagcattaatttgaatctataaaggtattttgaaatgtaaatcaaattaataatagtcttatcagatcttattatggcatataattaactaggtgagtatcaggtgattactttctcttagcttttaaatgtctccagttatgttatttcactaaagttagcagtatattctaattttcacatggatatccctgaagagttacatgtaagtaaatagaaatttggttaattccattctattttaaagaaaatggaggttcttaaaacttaagataatccttggtgagtattttaatgtgacctaaataaaatttttatgaaatgaatagcttcatgattaaaactgtaaatttgaattttgttatttcagaattgtttaaaacaggtcgtccttattatattattagaagtttgaattgtggcttctctactatatatactaattgtttggtcttgggcaaatcactttacctctttaagccttaattactcaactcttaaaaaagagattatgcctacattatagagttcctgagtattttgtgaagtaattttataaaactctcaggatgcctggctcgttgtaaagatactaagtataaataggtatagatacaaataaaaactataatagaccagtaaattgtgattgaaggtagggtttgtgacttataactgttaattttgtaccgtgtagtttttactagttattttatctatagactcctatatagtaggaaaaaaacaactcattttcccctgctgcacatatccagcacagaacacttttggtcaccaaaatgtgttttttttttttggttgttatttcgttttcttttctgtaccacaccaaccatttctgcagcagacaccaataggatttcctacagtttaacccaattctgacactaaccggaattagtgcaaaccccactgggtaagatcccagtaccacacaactgctcccaacttcagacatcaatcgaaagctccaggtggtaacctgtactgttgactaactggctataaattgaaggttcccacgatcccttcctgtggttcaattatttgctggagtggctcatggaactttgggaaacacttatgtctactgatttattataaagaatattacaaagaatacagatggacagctagatggaaaagatgcatagggcaaggtatgtgggaagggacgtgcatcttccatgccctctcggggtgggctaccatcctagcacctccatgtgttcagcaacctggaggctccatgaatcctgtccttttgggtttttatgggggcttctttcctatagccaagattgataaatgactggccactggtgattaactcaacctcctgcccctcacctcttcccagaggttggtggaactgaaagttcccaacacactaattacaaagttggttccctttgcaataagcccctgttctgaggctatccaggaccacccagccatcttattagcatacaaaaagacaccattttggagactacaaacgttttaggagatgagtaccaggaaatgggatgaaaaccatttgtatttcttatcataaatcacaatattacaagccccaaatgcctagtaactctttcttatatattcctatatttctaggtaacaattcaattgttctatggatatttaaatgaaaacactgaaatatttagtgtcaatagttgggaaaattcacaaataatgaattatactctatgagttttatgtaatattctttcctttaccacggtaaaggaaaaattgttgatagtcaaactgttggcttcagaatttatggcagtggttgaatttattccagaaaatttgtctcatgatctgtctagacatgagcataggcagaaataatgagtctggattttcagttatatcagttactttgtaatgaggacaaggtaaaatcagtattctatgagtggtgggaagctttgattcctttagtcccactgagggtaacattaaaggtgcttgcaaatgcagaaatattcttagcctaggatgtagaaataatggttttctgcttaatttatgaaacaaacattttcctacaaagtattctacatactgtatactgcattgcttaatgtaatgaggcagatttcagctttatagataattatattgagtgccaatctgcctatcagtagagttttatcaagttcctataacatttgcaaagcagtggttgctgttggtgttgcggatatagtaattttacaagaattagaattagggaaaaagaaggaagatgtgtttcaatcagtctctgaacattaactcacttaatcgtgaaaactatcctgtagggttgatagtggtattctcatttatgaggagtggagtatggaagacttaaattaaacctagagaaaagtagagtttcagaaaaatggaaaggacgaaggaatttcacatttaaaaatgagtatgtggaagaattgttagcaaaagaatggagggtatgaatttagccaagtttattccatagttttcagtcaggaattttcttctgatgaacttgcacactaatttcaaaacacacattcattctttggttcctagaaggttatatgaaattcagatacatagattcactttgatgtgttagagctttttactagttagtgatctgttgaataagttaagggacactaaaatttagtatttgtaaatgttgaaataaattttctttttttggtgattgttttagagctatgattcagtattttcctgagaagtccggctgccacaaatgtttgggaatcttataaggctccatctgcaaatgctcatgaccagatatttcctgcgatgatttttaatgtaatattttaatttttcagctaagcagacttagttttcctttggaattttatcaatgcaccatcagtattgccttgagttaactgtggtttttgtgttactattatgtaggaaataatattaggtttttctttggttgatcattttgttatataattcctatacaatttttattgctatttattttggtcctcaccacttcttctgcctttttttttttttaaatcacagattgtttatgtatcagaatacaatttgccacaacttcaggggctgtggttaagtttgaaaaccaaggattacattcagttatttttgcatactctctaactttcttaaacatactcaactgaatggatacattcccattctgtcagtgccgtgcctcctgttaacatttttctacactagaagctcttcccatttttgctgagagagtgtctggcatcttctcccagcctccattcctaatggtggctagagctaagaatgtattgctgctttcttttgttcctttttttttttttcaatacttttaagttctgggatacatgtggaggtttgttcttgggatacatgtggaggtacatggagatacatatgggatacatgtggaggtaagttcttgggatacatgtggaggtttgttacataggtatacacgagccatggtggtttgctgtacccatcaacccatcatctacattaggtatttcttctaatgctatccctcccctagctccctgcccccagcaggccctggtgtgtgatgttcccctccctgtgtccatgtgttctcattgttcaactcccacttatgagtgagaacatgtggtgtttagttttctgttcctgtgttagtttgctgagaatgatggtttccagcttcatccacgtccttgcaaaggacatgacctcatccttttttatggctacatagtattccatggtgtatacgtgccacattttcttcatccagtctatcattgatgggcatttgggttggttccaagtctttgctattgtgaatagtgctgcaataaacatatgtgtgcatgtgtctttatagtagaatgatttataatactttgggtatatactcagtaatgggattgctgggtcaaatggtatttctgattctagatccttgaggaattgccacactgtcttccataatggttgaattaatttacactcccaccaacagtgtaaaagcattcctatttctccacaccctctctagcatctattgtttcctgactttttaatgatcgccattctaactggcatgagatggtatctcattgtggttttgatttgcatttctctaatgaccagtgatgatgagctttttttcatgtgtttgttggctgcataaatgtcttgttttgagaagtgtctgttcatatcctttgcccactttttgatgggattgtttgttttttttcttgtaaatttgtgtaagttccttgtggattccagatattagccctttgtcagatagatagattgcaaaaattttctcccattctgtaggttgcctattcactctgatgacagtttcttttgctgtgcagaagctctttagtttgattagatcccaatttgtcagttttggctgttgccattacttttggtgttttagtcatgaagtctttgcccatgcctatgtcctaaatgatattacctaggttttctttcagggtttttatggttttaggtcttacgtttaagtctttaatccttcttgagttaatttttgtataagttgtaaggaagggatccagtttcagttttctgcatatggctagccagttttcctggcaccatttattaagtagggaatcctttccctattgcttgtttttgtcaggtttgtcaaagatcagatggttgtagatgtgtggcgttatttttgaggcctcttttatgtttcattggtctatatatctgttttggtaccagtaccatgttgttttagttactgtagccttgtagtatagtttgaagtcaggtagcatgatggctccagctttgttctttttgcttaggattgtcttggctatacagacttttttttttggttccatatgaaatgtaagtagttttttctaattctttgaagaaagttaatggtaccttgatagggataggattgactgtgaatttctttgggaagtatggcctttttcatgacattgactcttcctatccatgagtatggaatttctttccatttgtttgtgtcctctcttatttccttgagcagtgatttgtagttctccttgaaaaggtccttcacatcccttgtaagttatattcctaggtattttattctatttgtagcaattgtgaatgggagttcactcatgatttggctctctgcttgtctattgttgttgtataggaatgcttgtgacttttgcacattgattttgtatcctgagactttgctgaagttgcttatcagcttaaggagtttttgggctgagatgatggggttttctaaatatacaatcgtgtcatctgcaaacagagacaatttgacttcctctcttcctctttgaatactctttatttctttctcttgcctgattgtcctggccagaactaccagtactatgttgaataggagtggtgagagagggcatccttgtcttatgccagttttcaaagggaattcttccagcttttgcccattccgtatgatattggctatgggtttgtcataaatagctcttgttattttgagatacattccgtcaatacctagtttattgaaagtttttagcatgaaggggtattgaattttgttgaaggccttttctgcatctattgagaaaatcatgtgttttttgtcattggttctgtttatgtgattgattatgttttttgatttgcatatgttgaaccaaccttgcatcccagggatgaagctgactggattgtggtggataagcttttggatgtgctggtggattcagtttgccagtattttattgagaatttttgcatcaatgttcattggggatattggcctgaaattttctttttttgttgtgtctctgccagattttggtgtcaggatactggcctcataaaatgggttagggaggagtgccttattttctattgtttggtatagtttcaggaggaatggtaccagctcccctttgtacctctggtagtattcagctgtgaatctgtatgttcctgggctttttttggttggtaggctattaattactgcctccatttcagaacttgttgttggtctattcagggaattgacttcttcctggtttagtcttgggaggatgtatgtgtccaggaatttatccatttcttgtagactttctagtttatcttcgtagaggtgttaatagtgttttctgatggtagtttgtatttctgtgggatcagtggtgacattctcttcatcattttttattgtgtctatttgattcttctctcttgtttattagtctggataatggtctatctttttcgttaatcttttcaaaaaaccagctcctgtattcattgatttttttgaagtgttttttgtgtctctatctcctttagttctgctctgatcttagttatttgctgtcttctgctagcttttgaatttctttggtctttcttctctagttcttttaattgtgatgttagtgtgtcgattttagatgtttcccacttcgtactgccataaatttcccttttaacattgctttagctgtgtcccagagattctagtacgttgtgtctttgttctcattggttcaaagaacttctttatttctgtattaatttcattatttacccagtagtcattcaggagcaggttgttcaatttccatgtagtttggcagttttgagtgagtttcttaatcctgagttctaatttgattgcactggtgtgtgagagaccatttgttatgatttttgttcttttgcatttgctgaggagtgtttaacttccaattatgcagtcagttttagaataagtgctatgtggcactgagaaggatgtagattctgttgacttgaggtggagagttctgtagatgtctgttaggtccactttctctagagctagttcaagtcctgtatatccttgttaattttttgtgtttttgatcagtctaaaattgacagtggggtgttaaagtctcccactattgggagggagtttgtgtgggagtctaagtctctttgtaggtctctaagaacttgctttatgaatctgggtgctcctatattgggtgcatatatatttaggatagttagctcttcttgttgcattgatccctttaccattatgtagtgcccttccttccttccttccttccttccttccttccttccttccttccttccttcctacctggctcccgccctccgagaaagcgggcgtgtgtctctcattcattcgttcattcgttcaaagtcagttatatcagagtctaagatttcaagcctggcttttttttgctttccatttgcttggtaaatattcctctatccctttattttgagcctgtgtgtttctttgcacgtgagatggatctcctgaatacagcacactgatggttcttgactctttatccaatttgccagcctgtgtcttttaattggggcatttagcctgtttacatttacgattaacattgttatgtgtgaatttgatcctgtcatgatgctagctggttattttgcccgttagttgagcagtttcttcatagtgttgatggtctttacaatttgccttgtttttgcctgtaccagtgttttctttccatatttagtgcttccttcaggagctcttgtaaggcaggtttggtgatgacaaaatctctcagcatttgcttctctgtaaaggattttatttcctctttgcttatgaagcttagtttggctggatataacattctgggttgaaatttcttttctttaagaatgttgcatattggcccccactctcttctggcttgtagggtttctgcagagatccactgttagtctgatgggcttcaagggtaacctgacctttctttctggctgcccttagcatttttccttcatttcaaccttggtgaatctgatgattatgtgttttggggttgctcttttcgaggattatctttgtggtggtctctgtattttctgaatttgaatgttggcctgccttgctaggttggggaagttctcctgaataatatcctgaggagtgttttccagcttggttccgttctttccgtcactttcaggtacaccagtcaaacgtaggtttggtcttttcacatagtcccatatttcttggaggctttgttcattccttttcattatttttttctctaatctcgtcttcacactttgtttcattaaattgatcttctatctctgatatcctttcttccccttgatcgatttggttattgatacttttgtatgcctcacgaagttcttgtgctgtgtttttcagctccatcaggtcatttatgttcttctttaaactgcttattctggttagcaattcctctaaccttttttcaaggttcttagcttccttgcgttgggttatatcatgctcctttagctcagaggagtttgttattatccaccttgtgaagcctacttctgtcagttcatcaaactcattctctgtccagtttgttcccttgctggtgaggagttgtgatcctttggaggagaagaggtgttatgctttttggaattttcagcctttttgcactggtttttcttcatctttgtggatttgtctacctttggtctttgacgttggtgacctttggatggggtttttgtgtggacatcctttttgttgatgttgatgctattcttttctgtttgttaattttccttctaacagacaaacccctctgctgcaggtctgctggagtttgttggaggtccactccaggccctgtttgcctgggtatccccagcggaggctgcagaacagcaaagattgccggctcttccttcctttggaagcttcgtcccagaggggcactggctagatgccagacagagctctcctgtatgaggtgttgttaaacccctgttgggaggtgtctcccaatcaggaggcacggaggtcagggacccacttgaggaggcagtctgttccttagtagagcttgagtgttgtgccaggagatctgctgctctcttcagagctggcaggcaggaacgtttatgtctgctgaagctgcacccatagactccccttccccaagatgctctgtcctagggagatgggagttttacctataagccccttactggggctgctgcctttctttcagagataccctgccaagagaggaggaatctagagaggcagtcaggctacagcagctttgtggcactgccaaacttccctgatgctttgtttacactgtgaggggaaaatcacctactcaagcctaagtaatgatggatgcccctacccccaccaagctcaagtgtcccagttcgacttcagactgttgtgctggcagtgagaatttcaagccagtgtttcttagcttgctgggctccgtgggggtgggatccgctgggctagaccacttggctccctggcttcagccccctttccaggggagtgaatggttctgtctctctgtcattccaggcaccactgggttatgaaaaaagaaactgcagctagctcagtgtctgcccaaatggctgcccagttttgtgcttgaaacccagggccctggtggctaggcacctgagggaatctcttggtctgtgggttgcaaagaccgtggggaaagcatagtatcttggctggagggcaccgttcctcacggtgcagtccctcatggcttcctttggctagggaagggagttccctgaccccatgcgcttcctgggtgaggcgatgccccatcctgctttggctcaccctccatgggctgcactcactgtctaaccaggcccagtgagatgaaccaggtacctcagttggaaatacagaaatcacccgccttctgcattgatcttgctgcaagctgcagacaggagctgttcctatttggccatcttgccctcttttgttacttttaatcagagcctctcctagatgctgccatggtagtttggagcctccactgagtccctactttgctgtctgtttccttttggtctcagagtggtctaggacttatgactcttaggatatttagctcagaggtgttaaatattcttaaaaggagcaagagcttttagctatactatttaagattctgtgggttaacaaagcattataagacggttcttaagattgagaatttttagtaataggcttctaatgaacacatgaaagacctgtagcctttgtaagttgggaaattcctataggaatctctagtaatgcttctcttttattcctgatattagtaatttatgacctctcacttttttttccctctgatcagcctggctagaggtttatcagttttcttgatctgttcagagaaccagtttccagtttttgctttcattgattttttttttcttttttttaggcagtatctcactttgtcacccaggctggaaggcagtgggggcgatcactgctcaatgcaggttctacttcctgggctcaagcagttaccctgcctcagcctcctgagttgctgggactacaggagggcaccaccacacctggcgaatttttttttgtttttaggagagacaggatctccttatgttgctcaggctagtctcgaactcctgagatcaagcaatcttcccacctggcaaagtgctgggattacaggcataagccactacactgagccctgatttttttttcctattagtctgttttccattccattgatatttggtttttattatttcttttcttctctttaattaagatttaatttgctttatttttctagtttctaaaggtggaagggatggcagcagcagtcactgcaaagacaccagctgcagtggggaaggtatggctggcgctgccctgtacatggagccagtgggagctgggaacaggtgggagtcccgccccattctgagatggtggggcaggagccctgtgctcctgctggcagctgcagctgcccacctgtggttgtggatctgggcatccctgcactctcgggggtctgggaagccccactgcccctccaggcttggaagcgcctgctcctgctgcctggccttttcctgctccctgagcctgttccagggtagagcaagttgggccaagcctgggtgtggtggcagcccagtggggtgtgcccatgcttggggcagcactgacctgccagccccctgtcacctcagccccctctggactttggggaatgaggagcatgagagggaggccgatgggtccctctgtgtgaccttgcaggtgcccctcccacaagcagagtgggtaccctggacaacatgattgattgtggcaggaggcagatgggcttctgggtggaaaggggtgagtccctgatgaaatcctacattcaagccaggaacagtctgaagcctggggcctggcctgtcagttctgagtggaatcagcagccccagagtgagaacttactgtgctctttatgagcctgcccgtggccacccatggaccaattagcatgcacttacttccttttgagcccataaaaatcccagacccagccagactcacacagacgttgggactaccagctgtggaaaggagctatccactctgctgagagctggacacttgtctagatgacctgcagagaggagctacccccttccagtctcctcagagctgttcttttgttcagtaaagctcctctctgccttgctcaccttccagttgtccacatacctcattcttcctagatgtgggataaaaactctggaccaggtgaatggcgggactgaaagagctgtaacacaaacaggactgaaatacgtccccctgctcaccatgtttgggggtgatgagaaggagagaagagctgcagctctgcaggaaacccagacctaggagctcccagagccagagctatgacaccctctttggggctctgtggtttctgttatctccaagctttccagtgtcaccatgttcctcttgtccagacgtgggtgcctgcagtggaagccacttgcggtgcatctgatccagcctcaggcttgcatggagaaagtgcctggagctgcccaccctgctgcagcagctggcatgcctggctgtgcgctcttgccagaccctgcactcactcatgcacccgtcactgctctgtgccagactcgcctttggcaggtgtgggatctgggctgatggcatgagccgtgcacagcgtatcaggccgagggggtggaatgagcccagcgggcccaagaaaacttgcacaaaaggtgccaccagccacagaggtttccagctggaaaagcggcatcctgcggatccctagaaagaaacttagattattgatttgaggtttttccaagttttaaattacagatattaaatgttatacattttcttttacgtgtttctttagttacatctgcaaaattttgacatcttgcaacagtttgagtcctctgagaagcagatgccaacatgggtttaaatgtgcaaaaaatctattagggaaaaatgcctgtgtgagaaaatgaaaagggagctgtaggagactaagagagtcatcagactctgatgtaggtttgaccccaagttaagaaagaacgagggtgggtaaaagcatctcatactacagtgtatttctaaggaaagtggtaagttgactggggagttcttgtgccagagttttctgtcagagaagtctcatatcacccaaccagggaactacattagtattcctgccttactcagtcattggctggaagcagcccatgggaatcatggccttggtgtaaatgcagagatggattgcagagtgcagcagctggggcccttgatcccagtccttatactccatcatagttgttattgagttctagttactatagtcaaagaacatatgttaaaggatttcaaaaatcttttattaagattttttttttgagtcagagtttcattcttgttgcccaggctggagtgcaaatggcatgatctctgctcaccacaacctctgcctcctgggttcaagcgattctcctgcctcagcctcacgagtagctgggattacaggcatgtgccaccatacccggctaattctttgtatttttagtagagacgggatttcactgtattagccaggatggttttgatttcctgacctcaggtgatccgcccacctcagtctcccaaggtgctgggattacaggcatgagccaccgcacttggcccagatttttaaaaattgctcagagtgtggtctgtcttggtgaatattgttttgtgaacttgaagataatttctatttggctcttaggcagaatgttttgtaaatgtcagttaggtcaagttacttgatgttaaaatttcctgttttcttactgattctctctctctctctttctctctctccctctctccctttccatttccttttccctttccctccctttgtatctcccctttctgtcctccctctctcacacctttctctctcactctctgtctctcctttgtctattatttttctagtctatattttatgtgtgtactttaggtggctgctattattaagccttcaatttcagtgatcttctgtagtgtctaagctgttatttatcttatttgttatgtttttcattttaaaattgtgtgtgtttttaacacatacaacacataaagttgtgtgtgtttttaacacatacaacacataaagttgtgtgtgtttttaatctttagatgttctgtttgggtcttttttgcacctttgatttctctcatcattcatatttcttctctaccttcatgaacatgtggaatatatttatgctagctgtattaatatccttgtcctgctaatttcacatttctgtcctttctgagtcggcttctattgactgatttttttttcctgaagtgcgttacatatttctgtctttttggaatacctggtaatttttggtattccattaaatattataagactttggggatgcagttaagttagctataatctattatatccttgcaaatcttgcttttaagcattgttagcatgtacaagaacagattttaatgttaggctaatttagctccactttcatggtgatactattctgaagaccctatctgatgccatatgtatttattgagaggtctttttaccttgtttattgggaatatatgaactgtttctgtatgagctttgagaattgtttaatacgttgctttccaggttcatttcttggtgttcagtaatttccactcatgtgcagctcaaaacccagacaaaagttgaggacatcactgtgaaattctctagagcagaggtggacaaacggcagctaactgactaaatcccacctgctacttgttactgtaattaaagttttattgtaacatagccattctcattcatttacatatatttttctgcttttacattataatagcatcattggatagttatgatgcagatcatatggcctgcaaagcctaaaatacttatctgctccttacagaaaatatttgttaactcccactttagagttttttctctgtgtggcattttcctctctggtaatctgccctgcaaattatagctgccctgggatccctgaagtctgattttcgtctccttgattcctaggctctgtttgggttacttctctatgtattatagcctggaaatggcccccatgcaggaagccagggcaatcaaagggttcatttcatttgtttttcttcccttggggctcacagttctgtactggctgttactcaatttctggaaaccattgattcttattttgttcagttttctagttgcttaagtggggaatggtcaatctggtcttgttattgtataatggtcatatgcaggagaagcagcagaatattttgagacttgtttttgttgttttgtatatcaagaattagttgctttatattgctatgtaatattccatttgtttgaatataaatgctcctcaatttatttgatggggcatgtctagataaacccatcataagttgaaaataccataagtcaaaaattcatttaatatacctaacctgctgaacatcataatttagtataggcttccttaatacaagtactcagaacacttacattagcccagcatcatgagagagcatcctattgcatattgctagcccaggaaaagatcaaaattcgaattacagtttctactgaatgcctgttgattttgcgtcatcatgaagtcaaaaacttgtaagtcaaaccgtcataagtcagggaatgtgtgtatatctgtttagcaattctcttgttggggaatacctgagctgtttatagtttttgactattactagtaaagcagctggctgggcacagtggctcatgcctgtaatcctagcactttcagtcatatttaatgttgtcaatctttttaattttagttattttggtgatgattgatagtatctcattgtaatttagatttttatttcctggagaactaatggttttcagcattttttattcattcgtttgccttttttcttttcttttgggatggagtctcgctctgtcgcccaggctggagtacagtggcgcgacctcagctcactgcaagctccgcctcccgggttcacgctattctcctgcctcagcctcccaagctgctgggattacaggcacccaccaccatgcccggctaatttttggtatttttagtagagacggggtttcaccgtgttggccaggctggtctcaatctcctgacctcgtgatccgcctgtctcggcctcccaaagtgctgggattacaggcatgagccactgcgtccggcctcgtttgccttttttatatctctttttgtgatgactctattaaaatcttatgtccattaaaaaaattgagttgtttgtgcttttactattgatttgtaaaatgttttacaatgtgttgaacataagtcctttgtcagacatctgttttatgaataatttctcttgtctgtggctcactttttctttttcttagtaatgttttttgatgaactgaagttataaattttgatgaagtcagatttatgaatgtttttcttttaaggtaatttttgtgtcctatctaaggaaccttttccttcccccaagtcacaaagatagttctcctgtttagaaactttgtagtttttgcatttatagttgggttcctgatccatcttgtattaatttttatgtatggtatacagtacctgtttgggtttcttttttgcatatgaacatttagttgtatttgtagagaatacttttcttcattggattgctttcacatatttggtgcctttgttgaaaatcaattgactgcatataagtttaggtctatttctgttttccttattctgtttcaataacttattatcttgattactatagtaattcttgaattaaggtagtataagtgttccaattctttttctttttcaagatttctttttgcatatccttaacattttagattcagtttgtcagtttttacaaaaattcttggtaaaagtataattgatattctgattggatctatagatcaatgtggggagaattaagatctaaaatactgagtcttccactacatgtacatggtatgcttcatttatttagggcctctttatctcagcaatgttttgtagttttcagtggtttgtgttagacttattgtcatttttttccctaagtattttatgtgtgggatgctcttttcaaggaaatagttatttcaaatctcattttctattgcttaatcctggtatgtatatttttacattgggcttgcgtgcgatgagcttttctattttacttattgagtagtcgtttttagattttttaggattgtttatataaacaattgtgttaactgcatttagagacagttttacttctctgccttttatttctgttacttgccctattgcagtgccttattccccacctaagagagaaatcatttagtcttttgacattatatgtcatactagctgtagaattttcatgaatgtctttcatcagattgaggaaagttccttccatttctagagtactgaaatttttgaaaagttatgagtagatgttgaattctgtcaagtgctttttctgtgtttattaaatatcatttttcttctttatactgttagtgatttaaattgattcatttttatatattaactttgcattcttgtgataaattctacatggttatgatatatgtgaattcaatttgataatatttttattaaggatttttgtgtctgtattcatcagggatatggctctatacttttcctgtagatgtctttgtttagctttggagtaatataatgtttttatcagtaatgctagcaatggttttgttagcgtcattggcttcacttgaaagtggggtctactaccttatgtttgaaagagtttgtatgaaattaatgttttttttttatgtgtttctatagggttcagtagtgaaaccatctgggactctaatttgtttgtatataggttttttataaactcagttaaaaaatctactcagcttttctctattttttttagtaagttgtatttttcaaagaatttgagaatttcatctaaagtgtatttgttgacataaagttgtttataatattttcttaattctttaaatgcctataagagttacactgctaatttttagcaaattcccagcactctgcctttaatcttgattagtctaggtagatgttgttgatctagtcactgaaccggttttttcttaaacagttattgaagtataatttacatacaataaaatccactcacattaagcatatgatttaataattttttagtaatattaaagagatctgcaaccataatcttgttttagaatagtttatcacctgcagaagatgccttgtgatagttgatagttacttctgctttcactccgagccctaggcaaccacttctctactttctgtttctgtatagttatcttttttgacattttctataaatagaataatacaaaatgtagtcttttgagcctagcttctttgacttagtgtaaagtttttgtgcttcatccttgttttagtgtggctttgttagactttagtatgaggataatattgaccccataaaatgttttggaaaatattcccttgtcctctgctttctagaagagtttctgaaccattggtattattttttcttgaaatatttgatggaatttaccagtgaaccatctggttttggcttttattaatgagaggatttccaaatactgtttcaatttctttactaataataagcctattcacacttcctttttctatccccgtttctttttccttcctctcttttccctccctctcttcctttcctccccttgcctccccttccccattctcctattcctttttctttttccttcattccttgtcttgatattttgagtattcctagaaattggtcagtttcttctaagttgaatttctgtagggtcaggatcacgttcactcttttatttcttattttggtagttttgttccttctcttttttttcccttggcacatcaacctagcggtgtgacagtcttgttgatcttttcaaagaatcaaccttggttttaagaatttttaaaaaattttttttgatttccatttcattgatctccattctaatatttatggttgtccttctgcttataagctttgctcttcttttcctaatttcttaaggtggaaacttgggttatttatttgaggtctttcttcttttctaaaaataggcatttaaagctataatacctctacatactgcttttgctacaataatatgttgtattttcatattcatacaattggatacatttttaaattttttcttgtgatttcttgtttgaccatggattatttagaggttgttgttctaatttaattccactttggtttgagggcatgctttgtatgatcccaatttttaaaatttaccgttacttatgttatggccaaatatattttttattgtggagaatgttccacaagtacttgaaattttattctatatttgggaagaatgtgttagatgttagttacatcatgttgcttgatggttatgttgaagtcttctgtgtccttacagattttctgtctagtttgtctatcaattattgagtggagttttgaaatctctgactattattgttgaattgtttatttctctctcaattctgtccagcgttgcttcatgtattttgagactccttttgtatgtttataatttttatatcttcatgatattgacccttttatcattatgaaatgcttttgtctctagtaacagtttttgtcttaaagacttgttttatttgccgggcacggtggctcacacctgtaatccccagcactttgggaggccgaggcgggcggatcatgaggacaggagatcgagaccatcctggctaacacggtgaaaccccgtctctactaaaaatacaaaaaattagctgggtgtgttggcgggcacctgtagttccagctactcaggaggctgaggcaggagaatggcatgaacccaggaggcggaggttgcagtgagccaagatcgcaccactgcagtctggcctgggtgaaagagtgagacaacgtctcaaaaaaaaaaaaaaaaagacttgttttattttagtacagctacttcagctctcttatggttattgtttacattgtttatcttgtttcacacttttgctttcaacctattttatatctttgattctaatgtgtgctggatgtttttcatttggatagtctttgtttttatagtgttcaagctatttacgtttaatgtttgttttgtatatttctcatggtgctttttgttcttctcttcctcatttattgctcttttttgtgttaaatagatattttcttgtgcacatttaaattattttctttttactatgcatatttttaagtgtttttatattggttgacctagggttacaatatgcatattgacttattacaattgacttcatattaatactaattcagtgttagtaatatgtagaatatttaattctgtatagcttcattccttttcctctcctggagagtgccattgtcatatgtattatattttatatgctgtaagattaaccatacagttttacaggtttttttttgtagctgttttgtaaatttgttaagaggaataaagagagaaaagtttttattcagtcttttagatttgtctatgtaattacctcttgagtattcttcatttctttgtgagaatttgagttactgcttggtatcatttccttttagcctgcaggacatctttactatttttacagattcctcagtctttacctgggaatgtctttattctgcctcagttttgtagggtagtttatttggataaagaattcttggtttagtgtttttcttttagccgtttgaatatatcgttccactaccttctgacttctatggtttctgatgctaagtcagctgttagtctcattgagggtccattgtgtgtgataagcattttctcttttgctgcttttaagattttctctttgtgttcatctttctgtatttttagggcccagcagggctttaactttactaattttgtcaccctttttgggctttagcatgaactggtagtttagattttcattgtgttttaaaaatagttacagcctgaatttatttttatatgattccctcaagttttatataattttcctcaagcttttattgccatgtaattcaataatacctctctgaggaatgactacttaagcatctttgttataagaaatggtgataccgtgttaatttttttgttttacttcatgttgtggcgttatgtactgttgctttcagatttttttcttgcttcatgggatttcataaacatatcccctatagatgtatttactctatatatgtcacataaaaacacatataaaaataaggcttataataattaaagtattgacttttctggaggactatataatcttaataagatgttttccttttgataaatattgaatgataatctttaagactaggtaaaagataccatagtatatttagtatttgcattgagacatgtattagtctctttaagagttaatgtctataaatatttaactctggactatgtcactgtcaagtaatattttgggctagagttccccactgagtatctaattttgttgccttattcttttagaagtgttactgtgagcaatagccaggcaactgaaagaaagaaggtgagtgggacccaaaaagaaggacaaaaacagatggaaaggaaataaaataataagaaatttcttaaacagtgtttgttttggatagttttcttgttaagcacatggaaatactttgcacatttgagaatcactgacttacatgctattttggagaaacagcaaatcactcatgtaatataaacacaattatagatttctttgctgtaattttttcatttctggggcttacttttccgtaagatacaaaacgttccttcttacagatcattgcttaacaatatatttggaggattgcaaatttaaattgaatggtacaattaatgcaataaatgatagatattcaaaatttctgaatcctgatagtcttgttgagttatagtctgctctaaagatgaatgttactaatgagaatggactttttagtatacgcctaaagtcaatataatgaagtgttttgaactgcctgtggtcctagatttctaatatgtctgttattatactaataagatcttaagactgaagagcattttatagtattcagtgaacttgcatgtaaatatgcactgtggatattattaattcccttcttttttttacagatatgatcactaagcacaggtggacagtggaaatcagagtgagagtatatggctgtagattctataattctttttccattgtaccaccagtaaggaatttgatacagaaaataatgttagatactgaacaaataattttttcttcggtaggaggtcctatattgctgttgtgtatccttagtttctttctttctttttttttttaaatggggtgtcactctgtcacccagtgtggagtgaagtggcatgatctcagctcactgcaacctccccatctcacgttcaagtggttctcccgcctcagcctcctgagtggctgggattacaggtgcctggcaccacaccaggctagttgttgtatttttagtagagatgggatttcaccattttgaccatgctggtatcaaactcctgacctcaggtgatgcacctgcctcagcctcccaaagtactggaattataggtgtgggccacctcacctggccttatttagtttctttaatgaagattattgatatgatatggctgtgtaaaatagtctttttatttctgtattattgattttcattttagaaattagatccataaatgtaattacttctgatgcatggccttttatccttgaaatggtaaataacacatactttttcattgctgttacccattctagcaaagtttcactgttttatcaaaggtattcaagttattttccatgttctgcatagtagtaacatgtacttttccactaggagcatttgagttgagaatgagaactaatggggaataattgtagcctcctgttactatgtttcatggcacaaccaagagacttttttccttgcctttatacagaagataggcagaatagcagtgagataggtgttgggttttaatgtttgagagcttcaaattctggctctgtgagttatgcttttgggacttgggcaaataaccttattcatgtttggaataaccttacagtgtattgtttgtgagaataagataatataatgaaatgctcaatctttgagcagccttcttagatgttgtcaaatgcaaagatgagttcctccatggataacatggtagattaacttaaaaacaagcaaataaaaagaaaccaagaacagcaacaaagtaaaaagaaagagagtgattaggtgactggctccaaatataagataaacatttcttaaatctggatgtagaatctgccaaaatgttaagttgtcaaaaaacaaagggaaaatgatctgttttaagccataaataggctaatcagaaataatgacatggtctggtaagaaatattaatgacttttaaagtcattaaaggattacttaaaggataattgcattttccagataacagggaacctaaaactaactttattcttttttgggttcatactttatgggaatttctattaagcagattatcatctagtgaatacatgaaaagacaaacattggtctggtcatcaagtagaattactgggagcagtaaacaagaatgtaaagtaagtcaaagccttggatgaactcatccaagttaagaaacaatctggtgagatcttgattaaaattctgctgttaaagaagctgcttaagtacttatgaatttgtacttctttgtactaccatggtgattaatgtcaatgcatttttctcggcaaggatacacaggcatatctggttttcttttgcttttctttattgtgctctgcagatactgcgtttttaaacaaattgaaggtttctggcaaccctgtatggggcaagtttatcagccaccatttttccaacagcatattctcactttgtgtctctgtgtcacactttggtaattctcacaatatttccaacttttaaattattattattaatatttttattttactttaagttccggcatacatttacagaacaattgcaggtttgttacgtaggtacacatgtgccgtggtggtttgctgcacctatcaaccaatcatctaggttttaagctctgcatgcattaggtatatgtcttaatgctctccttccccttgcctgccacccaccaacaggccctggtgtgtgatgttcccctccctgtgtccatgtgttttcactgttccgctcccacttatgagtgagaacatgcggtgattggttttctgatcctgtgttagtttgctgagaatgatggctttcagcttcatccatgtccctgcaaaggacatgaactctttcttttttatggctgcgtagtattccatggtgtatatgtgccacattttctttatccagtctatcattagtgcgcatttgggttggttccaagtctttgctgttgtgaatagtgctgcaataaacatacgtgtgcatgtgtctttatagtagaaggatttataatcctttgggattgctgggtcaaatggtatttctggttctagtttcttgaggaattgccacactgtcttccacaatggttaagctaatttacactcctaccaacagtgtaaaagtgttcctatttctccacatcctctgcagcatctattgtttcctgactttttaatgattgccattctcactggtgtgagatggtatctcattgtggttttgatttgcatttctctaatgaccagtgataatgagccttttttaatgtttgttggctgcataaatgtcttgttttgagaagtgtctttcatatcctttgcccactttttgatggggttttttttgttgttgttgctgtttttttcttgtaaatttgtttaagttccttatagattctggatattagacctttgtcagatgggtagattacagaaattttctcccattctgtaggttacctgttcattctgatgatagtttcttttgccatgcagaagctctttagcttggttagatcccatttgtcagttttggcttttgttgccattgcttttggtgttttagtcataaagtctttgcctatgcctatatgatgaatggtattacctaggttttcttctagggtttttatggttttgggttttacctttaagtgtttaatccatcttgagttaatttttgtataaggtgtaaggaaggggtccagtttcagttttctgcatatggctagccagttttcccaacaccatttattaaatagggaatcctttccccatttcttgtttttgtcaggtttgtcaaagatcagatggttgtagatgtgtggtgctacttctgaggtctctgttgtgttccattggtctatatatctgttttgttaacagtatcatgctgttttggttactgtagccttgtagtatagtttgaagtcaggtagcatgatggccccagctttgttctttttgcttaggattgtcttggctatacaggctcttttttggttccatatgaaatttaagtagtgttttctaactctgggaagaaagtcactggtagctcgatgggaatagcattgactctatgaatttctttgggcaatatggcctttttcatgatattgactcttcctatccatgagcatggaatttctttccatttgtttgtgtcctctcttatttccttgagcagtgatttgtagttctctttgaagaggtccttcacgtcccccttaagttatattcctaggtattttattctatttgtagcaattgtgaatgggagttcactcatgatttggttctctgcttgtctattgttgctgtgtaggaatacttgtgatttttgctcattgattttgtatcctgagactttgctgaagttgcttatcagcttaaggagtttttggggtgagatgatgggattttttaaatatacaatcatgtcatctgcaaacagagacaatttgacttcctctcttcctattcaaatactctttatttctttctcttgcctgattgtcctggccagaactaccagtactatgttgaataggagtggtgagagagggcatccttgtcttatgccagttttcaaagggaatgcttccagcttttgcccattcagtatgatattggctatgggtttgtcataaatagctcttgttattttgagatacattccaccaatacctagtttattgaaagtttttagcatgaaggggtattgaattttgttgaaggccttttctgcatctattgagaaaatcatgtgttttttgtcattggttctgtttatgtgattgattacattttttgatttgtgtatgttgaaccagccttgcatcccagggatgaagccaacttgatcatggtggataagcttttggatgtgcttttgaatctgtatattcctgggcttttttcacatagtcccatgtgtctttgaggctttgtttgtttcttttcattctttttttctaatcttgtcttcatgcctcatttcagtaagttgatcctcaatctctgataccgtttcttccactttacagattcagctattgatacttgtgtatgcttcacgaagttctcgtgctgtgtttttcagctccatcatgtcatttatattcctctctaaactgggtattctagttagcagttcttgtaactttttgtcaaggtttttaactttcttgcattgagttagaacgtgctcctttagctcagaggagtttgttatttcccagcttctgaagcctacttctgtcagttcatcaatctcattctccatccagttttgtgcccttgcttgagaggagttgtaatcatttggagaagaagaggcattctggtttttggaattttcagcatttttacgcaggtttttcctcatcgtcgtggatttatctacctttgatctttgaagctgatgacctttggatggggtttttgtgtgtgggtcctttatgttgatgttgatgttgttgctttctatttgttagtgcttctaacagtcagtcccttcttcggcaggtctgctgcagtttgctggaggtccactccagaccctgttcacttgggtatcaccagtgaagcccgcagaatagcaaagattgctgcctgctccttcctctggaagctttgtcccagaggggcaccgacctgatgccagcctgagctctcctgtatgacgtgtctgttgacctctgttgggaggtgtctcccagtcaggaggcacgggggtcagggacccacttgagcaggcagtctgtcccttagcagagctggtgcactgtgctgggagaattcctcttgtcaggatcagctgccctcttcagagctggcaggcaggaacaattcaatctgatgaagctgggcccatggtcaccccttccatcaggtgctctgtcccagagagacgggggttttgtctgtaagcccctgactgggctgttacctttctttcatatatgccctgctcagtgaagaggaatgtagagaagcagtctggccacagctgttttgctgtgctgtggtgaattctgcgcagttcagacctcccagtctccttaacactgtcagggaaaaccacctactaaagccacagtaatggcagatacctctccccgcaccaagctcgactgacctaggttgacttcacactgctgtgctggcagcgagaatttcaagccagtggttcgtagcttcctaggctctgtgggagtgggacttgctgaatgagaccacttggctctctggcttcagccccctttccaggggagtgaatggttctgtcttggtggggttccaggtgccactgggttataaaaaaaacctcctgcagctaggttggtgtctgtctgctcaaacagctgccccattttgtgtctgaaacccagggccctggtggtgtaggcacatgaaggaatctcctgatttgcacattgcaaaaaccgtgggaaaagtgtagtatctgggctggatagcacagtctctcacagcttcccttggctgcgggagggaggtcccccagctccttgcacttcctgggtggagcgatgccccacccttgcttctgttcaccctccatgggttggacccactgcctaaccagtcccagtgagatgaactgggtacctcagttggaaatgcagaaattaccttccttctgcgttggtctcactgagagatgcagactgtagctgttcctgttcagccatcttggcccctccccccaacttttttattattatcatatctgttgtgctgaaatatgatcaatgatctttgatgttaccattgtaattgttttaggctgtcaggaaccacacccatataagataggaaacttaatcgataaatgttgcgtgtgttctactccaccaattgccccatctctcttctctctccttctcctcaggcctccctattcctttagacacaacaatatttaaaataggccaattaacaaccctacagtgtcctctaagtgttcaagtgaagagaacagtcacatatgtctgactttaaatcaaaagctagaaacgattaagcttcctaaggaaggcttgtggaaagccaagatagccaaaagctagtcttcttgtgctgaacactgagacaaattgtgaatgcaaaggaaaagttaaaagtgctactccaaaagaaacgttcttgaaggaaattaaaagtgctgctctagtgaacacatgaatgataagaaaatgaaacatgctcattgttcatatggagaaagtttcagtggtctgggtaaaagagcaaaccagtcataccatattcccttaagtcaaagtctaatccaggttgtaatccctaactctcttcagtcctatgaagactgagagaggtgagaaagctgcaggagaaaagtctgaagctagcagaagttaattcatggaatttaaggaaagatgccatttctataacataaaagttgctacccggaacaacatatttttcagtgtagattaaacatccttctactgaaagatgatgccatctaggatttttgtagctaaagagaagaagtcaatgcccggtttcaaagtttcaaaaggcaaggctgctgactctctttttagaggctaatgcagctggtgactttaagttgaagccagtgctcattcgcttttttttttttttttgagatggagtctcactctgtcaccaggctggagtgcagtggcacgatctcagctcgtggcaacctccgcctcctggtttcaagcgtttcctctgcctcagcctcctgagtagctgggactacaggcgctcaccaccacgcccagctaattttttgtattttagtagagatggggtttcaccatattggccaggctggtctcgaactcctcacctcgtgatccgcccgcctcggcctcccaaagtgctgagattacaggcatgagccactgtgcccggcctcatttgccattttgaaaatcctagggtctttaagaattttgctaaatttactccacctgtgctctaaaatgggcgcaaccaagtctaggtgacagcgtatctgcttacagcatggcttgctgaatatttgaagcccagtgttgagacctactcttcagaaaagatttctttcaaaatattactgttcattgacaatgcatctgatcactcaagagctctgacagatgtacgaggagatgaaggttgttttcaaaatgtcaacattactagttgatattttggaagtttcggaagaagttaattccaacccccatggaaggactttgagcagttcaagacttaagcggaagaggtaactgcagatgtggtagaaacaataagagaactagaattagcagtagagcctgatggtgtaactgaattgctgcaatctcatgataaaacttgaatggatgaggagttgcttcctagggatgagcaaagaaagtggtttcttgagatagaatctactcatggtaaagatgctttgattatttttaaaattacaacaaagggtttagaatattatataaacttagttgataaagcagtggcagtttttttttattattatactttaagttctgcggtacatttgtacaatgtgcaggtttgttacataggtatacatgtgccatgttggtttgctgtccccatcaacttgtcatttacattagttatttctcctaatgctatccctcccccagccccccatcccctgacaggccccggtgtgtgatgttcccctccctgtgtccatgtgttcgcattgttcaactctcacttatgagtgagaacatgcggtgtttggttttctgtccttgtgatagtttgctgagaatgatggtttccagcttcatctacatccctgcaaaggatatgaactcatcattttttatggctgcatagtattccatggtgtatatgtgccacattttctttatctagtctattattgatggatgtttgggttggttccaagtctttgctattgtgaatagtgcctcagtaaacatacgtgtgcatgtgtctttatagcagcatgatttataatccttttggtatatacccagtaatgggattgttgggtcaaatggtatttctagttctagatcctaaaggaatcaccactctgtcttccacaatggttaaactagtttacactcctaccaacagtgtaaaagcattcctatttctccacatcttctccagcatctgttgtttcctgactttttaatgattgccattctcactggcatgagatggtatctcattgtggttttgatttgcatttctctaatgaccagtgatgatgagctttttttcatgtgtttgttggctgcataaatgtcttgttttgagaagtgtctgttcttatcctttgcccactttttgatggggttttttttttttttataaatttgtttaagttctttgtagattctggatattagccctttgtcagatggatagattgcataacttttctcccattctgtaggttgcctgttcactctgcagtggtagtatttgagagaattgactccaattttgaaagaagttctgtgcgttaaatgctttcaaacagcatcatgtgctacagagaactctttcatgaaaggaagagtaaatcaatgtggcagacttcattgttgtgccattttaagaaactgccacagctagtccaatctttagcaaccaccaccctgatcagtcagcagccatcaacatccagacaagaccttccaccagcaaaaagatgcaatttgctgaaggttcaaatggttaacattttttagtaataatgtattttacattaagatatgtgcactgtgttttagacataatgctattgcacacttactagactatagtagagtataaacatagcttttacatgcattaggaaataaaaaatgtgtgtgactcactttatggcaagggtctacaaccgaacctgcaatatctccgaagtatgcccatatctgcctttcgtaagaattgtgtatactagaaagtcttaagggacaaggaatctgtagagaagtaaagttctggttaagcttttgtgagattattactgtgtttgtgtgcattaatagatacattgaattttgtccttgtcacatatatttcatctgtcattcatgtaaggtgtatacttcagtggatttatttggagacccaggcatatctcttgcctattttggtgctttggactatcttggtaggtcatgagatgtctagccataggtaaggatattggcatggggatttaaaaattcagtggttggtaggattggagatgatctttaatattatgtctacttctgagattccatgaatttcattatttatagacattcacattacccaggttttctgtgcctttccaagtcctcatggaattcctcatgctactctaatttgagtcattgtgaaagatgttagtgacttttgagaatcagatttttacattgggaaatatgaagatgaaaaaaattggcccagataatctctgttgacacttactaaaaatttaaaaacattaatcaagacaaaaaatgagaagtgaatggttcttaactcatttctttaaacgcactactgttttttattttgttcaagaaaaaaagtttcacaattttttttaagcaatagtataatcagaaccagaggtctgctgagtaaaatcatgcagttcagtctctttcctcttgacaccttactgataccaggaagttttgattgtgttatatgtaggttggtgacttaagatcaggcatcactcttaaaactcatagtaggtttgagtggagtgttttcaattaagagcttattgatactatgttatgggaatatataacgcctgggaaagttactaagtgctgggtaagaatgcaaaagacaaaatgcgaaaaagctataatttaagaaattttaaatttttgcccaaggctaggcttaactttaagaaagatcaagttttctctcctgaattgttcccagggcctgagactaaatttatgataattaatgtgttttgtatattgtcagtcttaaactgtaacatcatttgtaacattgtttctgcaggaagatgccttgagttctaactttcaggcttttggaagttagtgattttatcttgtaatattaaacaacagtctgtagagatgtgcaaaatattccctctcttcctgcttctcttcctgttgatgatgatgatgaagtaataatagtgggtagcattttgtagacagttcttttatatcctttaaatttatttatttaattctttacaagtaaaactgagacttttttctttttcttttctttttttttttttttttgagacagagtcttactctgtcgcctaggctggagtgcagtggcgcgatctctgctcactgcaagctccccatcccaggttcacgccattctcttgtctcagccttctgagtagctgggactacaggcacccaccaccacacctggctaattttttgtgttttttagtagagacggggtttgaccttgttagccaggatggtctccatctcctgacctcgtgatccgcccgcctcagcctccaaagtgctgggattacaggcgtgagccaccatgcccagctgagacttttttttaaagttatttttgctcaaggtagagctaggatttgactgttcagaactctaaagccccatgcttttaacattgtgttggtctaagggcacatttaatatggggagtcataggctgatagtgtatatgcttgtgttcttgctggtgagaagatatatagatgggaaagctgttgtggtatgaagaaacaaaataaatatagaataagattgttctttaagttatttgttggttaacctgtagttaactcattacttcaccaagaatagttttgggtattatggaaatcttgaagcacatgtatttcaaaatgagttagaggccttaggcatttaaaaaataccaccagtgctgacataatatgagaacatagtgtaggatcttgaggcttttttttacatatttaatgaatcttttatagatattatcaatttttatcttgtctcatgtagtgcagattaatattatgaatatagttggttagtaatttccatgctaatttatatctatttgaagatataacacttgaaaaacacttaaaagtaattgcttttttccaaaagattgtatatttccagaaaaaatgttttctgttttagtaataaatgtaaaaacgttcaaactcatgaacatttacatgaattcattggatatagggagactgtattaaggatataaattatttaaaacattttccttagaactggaacaataaggttatgttgttcaaaatgttaaagtttaaagaaagaaatttctttgttaagggaagacaaagcatatttggcactatgtatgaacatgcctgttttgctcactgtggagctcccaatgcctaaaatcatgtcattaggtttttttcaccattaaaaaaaatcagtttaatattgaattatttttttaaaaaaatttgtgaaaaggtctacaggcatcttaaaaattgtctgtacacttgctattaatgaaaaaattagaagaatttcgagcaagaaaatattcacctgaatcaacatattttagtgtccttaatgttgagcaattagctgataagctagtttgaacctgactttcaggatagaatacttttgaggttgtatttgtttttttgctttcaacaaggcaagtcttgatgctagatcaattagcaaatcttgaagaattaacttaaatggtgtggtaattcctgttattagagatatttcttagaactcatgaaattcctccctcccacatgatatcagatgtgttgagttgagaaagttgctgggcagcagtcttgtatatcagagtccagttcaaagttgttagaatgagaagtgtttttaaaatgttatgggaatgcccgaattacaattgaactttgaaattaaaaagaaaacacaagacagtataaaaataaagacctatgagagtgttgtagcaagttgggctttttgtaacctaccgtttaaaatacagatctttgaaggcaggtttttactaattattttattactttgctcttgctaaagacagcaaggcaagtaattatcctcagatctgaagattaaaagtcttatgatttttaaataaatattaagcaaggagagtaatttttataactgttagcacatatgctttgtgtgctagctttttcctaatgtaaaataaatctgaatatgccatacgattggtgacaaataaaaaactctttgtgcaattaagagaaaatctgtttatttaagagctctcaaaggttgtaaaagattatacttggctgtatgtgaaggataaatgttgtgaaataatgccccttagttccccttttataataaatctcagctgtgtgttcagcacaagggctcagtgccaaaaagaacaggttcaacttgtccgtgaggatttgcaccacagtaaagtgcacaactgcttttgtagaggtcattgtggaggtcagggcatgtacagttgaatgaaagcaactttagaaacatggtagatcatagagttacttgagattcaaaaatcaatgttaacttaaaacattaaaaagatggaaaatcataagaaccttcaaatatatttttatctttatctacatatgttaatatgttttcatacagattaaaaataatttctttggcatcttgtgctagtatagttttaaggatcttcaggatattttataattgccaagatttggaagcgttgactattttaatatttgttaaattctttagagtgttcacataacgaaggtaggatatgatggtggtagaacaaagtgtgcagggatatgtgcatggtgggagtaaaggcaggggagtgtggatgagttttaataaaaatatgggtgtaatctggaaaatgtctctacaagtcatatttatcttgagtttgtgatcgaaagattcgaaatttaacaacaacaacaacaacaacaaagaaaatgcagtcttaaacagtatgattctttttcctaaatatctcaaaaatacttttatacatttgtgataaatagaaataaatgagaaatagaatgtggagaggctgtaagatcccaggactccagccagtgcattgagtttcatataaagaatacctgaaaagatataactaagtagatgcatagcttacctggggttatattttatctagagctgtacttcatgactcttttctcgtttctttttggtgactattttttaaaaaatggtgatcatagcaaaatgacaggcaaccattggtttcagtgtggggattaattagtaatctttagaatgtgcttcagcaaatgcagctgattggcagtagcatctgtctcaacaactgacggaatgttagtacttttatcaagtaattttcagaagggctccaaagctgttttactaaactctctcatatgaactgctttctttgtcctctagggcattgttttactaaatatacctatccatgaattaactaattagtgaaaggagggctataaaattgttatttttttaattttaaaaaatggacacaaatgtgatagtctgtgtattcttgtatttgtgggaccaccactatgctcactgatcacacacctatgttctcagatgaaaaatttataaaggattgtgattttgctgtattgtttttgtagttcgtctcataaaacatgtctcttaattatgaagagtgatttgttaaagtacaataaactgtgatttaaaggattgattagtatagtcagctttctagaaaggcaatttacttctgcattgccaggaattactcttcttagttgaaatagcctttttactaaactggttcatatttcaaaggatatgcagtttaacattcattaacagacaagccatcaattttatattgtttgaagaaaatattatttttgcttgttataaaaacaagacaacttctaagtgagtatctaatgaggttgtagcacatctcagtaaagatgaaatttgccttaatctgaatgtgttatggaaaaattgagtgtaaatattttctaaaaatgaattgatatgctttaatgaactagagtagctttcatttaaaaagtacttatatactaatgtttttttaaacaaatgagcacattatatttaaaaatgtttaataaatataatatattttaaatgaaaatttaaatagatactgttaaatgcttgaaaatagggacagttatggtggtatactttctgctatatcttcacagtgcctaacatctaccaaatgtttaataaataaattttcatattttagttctataatagagaagtgctttgtggattttagcaggatagggtttaaaatctgagtaggttacttggtcttggagagcttcagtttcttttcctgtaaaacaggtaaaacatacttacctcaaatgtgtatgtaatgcctaacacagtgcttggcacatagtagatgttcagtaaatatttctgtatcattttagtgcaattgcactgttagtaatccattccatatctgcctgactttaataaaagacaatttatgtgaaatttcaggtgagaagggtatcaagtcagtgtcttaaatattctgttcttttctgcattttagagtagatttaattgcatggtggttttatgagtgtgatagcggtggtggtggtgtttgtgtgtatgtgcatttggtttggggaagttagattgggatggttagagtattcatagtgtttgttgtttctttttaggacagaagaaaggtaaaatcagtgacagtctggcttaggtcttcacttattttctacaatgggaatggcaaaacaactactccttctgttgttaaatgacctcaaatagaacgaggacatttgttatgtaggtttttttggagatagggtagatgattagagggatcattttaaaacatttcttcattcatgaaacaaatattcctgatacataccaactactgtactaggcacagaagagtcaaatctaaataaaatgtggtctcttaaattattcagtctctataatggcgtaaagaaacttctatcttttcacggaaaaatatttctgctttagaagactactaatcttacatggtatttttgttttgcttatgtaatagtagtagtatttgtagataattttatataaagccatttctatattacattaggaaatttggacttatgtataagttgtcattgttggataaagttcacttatagtgccaagttaggaattcttggaaattatttttgaaattagtaaaagaaagtgagctaaaatgctctatgcctgaaagtttttacagaaaatttcttgcgaatactgtttttcttaaaattaatgcagactcttttaaaggaggcaggttttgtctaatcagatagtctccttgatgtttttcttttctgatctttttatagaaacagatatggtttgctggacactatgtcctcttggcaacaaatggtagtttggtaataagacaagcatcagagaaataatgtaaaaataatacttttcaacattgtatcacatttatcagtgcccaaggaaaaaataaaacctataacaacaaaaacaaacaaaataaacaaaatatttttcttgtattttgcttttcctttaagctactggcatatttccctattttcatttgtcttataagttaatgaaaataatgtttgcctagtgtttcttcttccttccattccctctttgtattctggcttctgttttcaccactgtactgaagctcctctgggtattgaaattccgttcactgggaacgctctttcttcccctccatttcagggctgtttcagccttcagaggttctcccaaatttcatttcttccatgaactctgctgaatgaaaattcaaatgcttgtcatattcagtagaatcatatcgtacatgcatttaatttgcttgaattcaactaaagttgaaaacaacaaaagtagcaaaaatgcctctcttctccaaggtaaagaaaaattttgaaacagcatagatgccaaatgtaagccacctacttaggtgatctgttccaatgctagaggagaaactagctgagttagatttacataaagagattaaaatatgcacagaacaatgtacagtatactttataggcaatttgagggatttttgaggggttattttgaccttttttttttttttttttgccttaatctaactttagaacggaatccttgtgcatgtcacagtatagctgtgttgaactaagtcagtcatataatttaggacccttctaggtaacactttgatctttctcaaatgtttcacatgtggaactaactgagggaaaatgactagcttagttcctttcctatttttatttttgcatttttcagggagggaaaaatttgtacgaatgaaattatagtcaaaacagtttaaagcagagggagacaatgctgttccttttatgttttgtgttctcctgtagttttgagactcatgcctttctcaaaagtaattgtatgtgaccacaaatatatcactgtagttagtgtctatatgagccttattagttctaagccaatacaaggaatttataggaatgcttattaaatatccagagtttagttgtaattatatattatttgaggatctttaatgatactaaccttttactagtgatcttttaatggaagatactatttcctaatttttttccaaccttttcaaaattggttacttttcatttttgaagttcttaaggaaaaatttatattgatataataagaattctaaaattagagttgaaatattattaaaggacatttttctgtgtggaacactaattagagtatgtgtttaaggaggagattacaaatgaatttggctaacaaatctttaaggaatttcactgtagtaaacagattttgatgagtttccagggctaatttgctagaaacattttcagagacttggcttgccaagtgaagatgtatttagagccattttatttctaatgttgagcaagaaacttaagcccttagctagatagttatagaaatttgtctttgatgttttcaagcatatcatgtgtatttgagtagaactgaacgttgctgaagagctagaaaaatatggtgctgtgtctgcaggatgaaacctctttttttattttgaagaagccagttttagaagaaaatttttgtgaaaattggtaatctaactattaggcatcacattttaaaagacaaagagtgctcttaaaggctgatttgtgcaagtatgtcaccattagaatgcttaaaagagcctaccatatatgtatcttttttaccgttatattctgcttattcccaaacatacattcagaaaaagaatgtagtctgatgattctaatagagttgggaatctgggtcttagtcttgtgcatttttttctactggctgtttctttagtatatgtagaatcaaattactttacattaaatttgagggaaattttatgtatttttatgatacattgtgagtcagtggcttatttccacttagtggtcatgaaatgatagcaagttagacttactgtttcagtctcctcacttatacactccccccttcctcattgcacatggtgaaaatgaaacatagagaaattaaatgttgcacctcagttcattctagtttagagacagtgccaggagaagtacatagttacatctcagcctgtaggccctgtccctcatttgtctttttactgtttactttacattttgaaagaaattagagaaaaatcatttatatggggaaaaatgaattatacttaccatgaaattgtgtgctaccaggaagttattaccatgcagctgctgcagtgatgacaggctgacatcaccctataatgaccagaacagcatagtataaaaatctctctgcttgcttctaaaataaattgaaaacaactgaattaccaaagaaatgttactcagaatgaacagcttatagacagtgccaggtatattctttaagtactctatcccattgcaaaaatatgtgtaggcacacacactattagaaaatatattcacatccatatacatatgtacaaatagacatatatgtatgtgtatatacatgcatacacagcacacatgtccacacatatttaaattattagaacattaccaaaacagaaatagtcattcagaattacttcaattgattttctaaaaggctgcttggagatactttctttggaaatagtcactagaattacagtagtttaaagctaccagaatgaaatattctggtttctgattccacttagtaaggtaacatattctgtagaatttgacagatttaacattgtgagaggactcagttcatgaaacaaacactaccatcttttttgttgttgttgtaattaaatgaccctaagaaataaaagtggaatgcacagtctcactgtaatgtgatttactaggatatgagctccctgagggcaggggcttgatctgttttgtttcctgatgttcttttcagtaggtggttatatttgttgtatgaatggatgatgaatgccacagagtaagcacaatgttttgttatttgaaattttgttaaaataactactaagatgtctggaaaacacattcacagcctaggatgaaaagcatccattgactgtaatgaataagtgaaaagaaaaaaataatcaaagtctagagaaggtagaaatttatttcttatgtactctcatagtacacaagactatgtaacaaaattccaattgtttacgcttagtaagagcattttaaaatttatggaaacgtgatcatcttgcagttgccttagtgttcatactattacatcacatgacaacttttttatattgtgttattttatacatatatatatatatatatttttttttttttttttgagacggagtctcgctctgttgccaggctggagtgcagtggcatgatctcggctcactgcaacctccacctcccgggttcaagcaattctcctgcctgagtaattgggactacaggcacacactgccatgcccagctaattttttttttttttttggtattttaatagagacggggtttcaccatgttgcccaggctggtctcaaactgctgagctcaagcaatccgcctgcctcggcctcccaaagtgctaggattacaggcgtgagccactgcacctggcctatattgttatatttttatattattcgttaattcaacaaaatattgagcagctttttggtgccaagctgctcagtgaggtacctatgacagtgagcatgagcatagggccttacactctaatgggagacagattcaaaacagacaattacacagagtttaacaggcttacagggcttattggcaaatatgttgaagatgagggtagtttgatggataaatgtcattaagcaagatagatcaattaaaagagttctgaatttaaaattgtgttaaaggatttgcagaatcatttaacctatcggcctaaattgtcagcactttgtaattacaacctcttctatggtacttaacagaaaaccatatactgattggtatagaactggattttcatgtttagtatttttattattgtttatctcaacaatctatatactaattgattatttttattgccattttcattaaataataatgtattttctttaatagtgttattctaaatggtttgttgcattctaaatgtgtgtttctattttaacatagtatgtgtttagagttaacacaaaagatactctgctctttatttggtgagaaagcataatgataatatttgtagtgtatagattaacagacaaatcttagtaaattataaacaattttttgtagtagcttttaaactttctaagaaaagttaaataatacatttcagattattaaaaatacagattattaaaaatactgccatgtataactacccgtgtcagcatttgcattgttcttccaatgttcctatgttgctctatatggaaatgagctgaattttagaaaaccttttttctcataagcttatattttttgactagcaaatgatggaaatatagggctctaagctatattttagaaaagaaacaggttccattttgttacattgtagaggaataaaaacactaattatatatactactgaatgtacagtttgcatgcgtttccccccaggtatgggtattacctaaagttgcatggttttctgtggttcttctcactacatttttacttttaaagccttatttctttatcaattatataacaacagtaacaaaaacagaaagggctttagttttgtgccgtacttttcaaagtcaggaaaatgtacctgaattacttaatggtatttttcaagactcagtgctaagacctcactctttatatattcccccacacccatttcttattcttgtgaccttgcctgtcattttgatgctgatagcaaaatttcttttgagtttattttatatttctagctgcctttactgaacatttctacttggatattttataggcagcaatggtggattgatttaaaccaccatcttaaactctttatttttaatagctttatcaagatataatttacttaccataagaattacttatttaaaatatacaatgtattgattgttagtaaatttacagaattttgtaaccatttcagtaatccaattttaggatgttttcatcactccaaagaggtctctgatactcatttgcagacacaacacattcacacttctagcccacagcaattgttaatctactttctgtctctgtaattttgccctttctggacatttcctagaagtggaatcatgtaatatattggtccttcacatctggcttcttgtagcataacgtttttgatgttcatccatgttgtagcatgtaccaatatttcattcatttttattgttgaatagtaataaaattcagcatattgtgtgaatgtttaataaaggaattcatattcatactatatgaatgtaccaccccattttatttatccattcacaattggtggacatttagattgtttccactatttggctgctattaatagctgctatgaacattcatgtacaagtctttgtgtggtcatatgttttcatttctcctgggtagatacttataagtggaattaactaagtcataaagtaaatttacttgtcactttaagaaaaactactgaactaattttcaaagtggctgcatcattgtatactctcatctgcagtgtccatgggttccagtttcttcacctctgcactaacactttttattgtctgtcagtttggttgttgtcattcaagtgagtgtgcatttagtgtgcatttttctgaatattattgatgttgagcatcttttcatgttcttattagccatctggtcttttaaaatcttttgccacttttaattgggtcattttgtctttttattagtcaattctaggatttttttttttttgacacagagtttcactcttgttgcccaggatggagtgcaatggtgcgatctcggctcattgtaacctctgtctcccaggttcaagcaattctcctgcctcagcctcccgagtagctgggattacaggcgccggctaccacgcccagctaatttttttatttttagtagagatggggtttcaccatgtcggccaggctggtcttgaactcctgacctcaggtgatccacccgcctcggcctcccaaagtgctgggattacaggcttgagccactgcacccagtctctaagaattctttataggtagtattctgaatttgatcgaattataaaatatgtggcttgcaagtattttcttctggtctgcattttgtctttttaaaattttctctttttattagtatgttttgcattgctatgaaggaatacctgagactggataattcattaaggaaagatgtttatttggctcatggttctgcaggctgtatgaggaagcttttactcatggtggatggcacagggggagcaggcacacgtggcaagagagggagcaagagagaaggaagtacctcttaaaaaccagctctcacgtgaactaatagagaatttgcttattgctaaggaaggacacaaagccattcatgaaggctccagtcccatgacccaaacacctcccactaggcctcaccttcaacatgaggattacatttcaacatgaaatttggaagggacatgcatccatcctacattactcttccacctttccctttcctagttttcctgcctctgttaatcagctctctctggttttcacattttgcttcccacctcagctatagcagattgctaccgattcttgcagttttaattataattattattcttttttctcttcccccccattattactcagatctagaccatattactttaaccttaatcactaaaatagctaccgacttgacctacttgattctaggctcttctttctttggtgctattatatttttctttgctgtaaatacatagccatttttttttcaaaactaacaaatattccatgatctattttaaacattttataatgaaaaatttcaaaaatagcaaagttggaaaataagacaatgaatactcacatgcctaatacctagattcaataatctgtaatattttggtattacatcacacacacatacacacacacacacacacacacacacacacacacacatatatatgcactttttttcccctgaaccgttctaaagtaaattacaatttccatgaaattttacttttaaattcttcatctggcatctctcactgaccttttcctgcataggacattctcatacataaccataatgccataatcacaccgaacaattaacagaaattctctaatatagcttaatacccagtctatattcagatttccccaattgttgccaaaatgtttcatggctgttttttcccttccaaattagtactgagccagtgactctcactatgtttattaaacatcttaattctgtcttaatcttgaatagctcccatccactttatactttgtcatctttattgttgttgtttctcgtgacattgacctactgaagaaaccaggccacttgtcttgcagtatgtttttttctgattttttctctgtggcattgttcaatagtagtttttttatagccataaatataaaatatacccattttatacccattttggacaattcagaaaatagtgcaacaaagataaataatttcatcacctagggatagtttttctttagttttcttttgcagttgcagatttactttattttattatgttttatttgagacaagatcttgctctgacactcatgctggagtacagtggcacaatcacagctcactgcagccttgatctcctgggctcaagtgatcctcctgcttcagcctcctgaggagctgggactacaggtgaacaccaccatgcctggctaattttttttttttttttttgtagagatggctcactatgttgcccaggctggtctcaagcacctgggctcaaactatcatcccaccttgatctttcaaaatgttaagactacaggcataagccactgtgcctggctcttaggcagattttaaaaatagtttagagcataatgatcatgtacttaacattttactaatttctctttaaacatgattttaaatggctgcacactgttttatgttataattgaactgatgtttacttaaactgatgtttacttattgattgaacatttagtttccttttagtttttgacaatataaactgtgatgaacagacatgaataagaatttgattatatttctcattgctttcttataaattattacagatggtattactaggtcaaaatatgtgaagattttaaaggtttactaaattgcttttcatccagaaagcaattccataatttgctctcttaccagcagtgtattcacgctctcttttcatattaaacattatttatttatcatttatttagtaatatgctggagataaaacattctgacattgttttgacagttctgatttcttacccatttgagttcaaattagccttggagtattttctagctgtaatttaagctatctatactgattcattctctgcccacccttctttctccatattcctgtctctgctcaggtttacttattgtctcaggacacaacatactgctctggtaatatcgctgtcctccccattgccttgcttttgtagactttgtcctctgaggtctggcacaagttgcactgtttcattcttccatcttttattgattcttcctctcaatattcttcctctcaatattctttttcttcctattctatctttttctcccccttgatattctatctttttttctgttctgtctttttcattcttccatcttttattgattcttcctctcaatactctatagcacttaagtctataccataccatttggcacccaaccaaatttaattcaaatataacttataattagtatatcatgcactttgagttctttaatttgaatcctcctttttctgataatttagaataatatctatcacccttactgtttgggtggaaatatcaccaataagcacttttcatctaaaaaacttttaaacacccttttcctcccagtcacttaaaacccttaatactttctcatgtgacctgttaagccattatctgctctgttggtgattttaaaaatttaaaaaacatatcaatgagtgtaagtcattgttctctaagttctgccccagctttaggcttgagaaccatggcatctatctcatgagttttttccgagggaaagatagatggaatgttggaagggcagtttgtgtgtcatttatgaactttgtcttatcgtacttatggcaaacagaactaccactgagtaatgtttatttctctctaaatgttatagttttaaaaaatactcctttttgagcctatggtattttatgtacctgagctactagaatttatataaaaaattggtttaaaccacctaggatttacttacggccattaaaacttttaaattgaacaaccatgattatattatttaaaaataggatattaaaaggcagtgtgtggaacccacactgggcagtaattgagagatctaactctatgtgaccttagaaaaatttacattttgaggataatagcttccatatccacaaaatgaaggtgttaggggaaaaaagcacaggctttacaatctgacagacttggcttttaatcatcaaactgccattaactacagtatgatcttgctcagtcacaatatctaacccccgtttcctcattcataaagtatgattaagtaccattaatagtacttaatcgtactttattaaatagtaacgtttcatgaaattattgtggatgctgagatatacatacaaaaccctttagcatagtgcctagcacagaataaataatgttaactattcttattcagtgacctttttggctattgtaaatgatgtccccacaaacttcagagaagactttgaattataagacatcataactttagtaatttgggtattgttgctaatgtttaggtaatgattagttttagtatgttgttttccagtgcaattacttaagaaagcttgtcttccttaagtattatcttccttggaaggtaatccagctcttgaaaatacccattctgtgtgagcctttctggaccttgctgtctaatttctgaaatgcacacggagtgttggtgagactgtaaatgtacttctttaattgtcacagtatttttcctttccctcacttaccctcctctcttttactcctctcccctcccttttacccccatagctaaaacatgtgacaccaatgctggacattttttatcaaatggcaggagaatttagtgtctgacaatttatgaagaagacactttgaaatagggatgtcagaacaagtctcaaaatatcccactcaggcactgtcttcttaacctatgcaatgctctctgaatcattggtctgaaattggattattctatgatagtataagatttagcttaacagtttcatgtttatttagaaaggctgtggaacatggaggttaggggttaaaatactatgaatgaaatttctgacattacactttttttctctttttcctgtgtattttaattctagcaaagcaaatgaggaaattagaatatccaaaactcatttaaaaaaattgtggtaaaatacatgtaacataaaagttcatgtaatcccttttaactgtacatttctgtgacattaagtacatccaaattgttctgcatctatcaccaccgttcatttccaaaaatttctcatcttcctcaactcaacctgtacccatgaaacactaactgctctttcccatgttcctagtctatggtaaccactgatctactttctgtctccatgaatttgactactttggaaccttctattagtggagtcatatactttttgtccttttatgcctggcttatttcatttatcataatatcttcaggtccatccatgttgtcatatgtcaaaatttccttcctttcaaagactgaataatactctattgtatttatgtgtatatacacaccacatattgtttattcatttattacttgatggacactgcgttgcttccacatttttgctactgaaaataatgctgctgtaaatatgcattggtgtacaaatatttctttgagaccctgctttcactttcgggtatatacccagaatccatccaattgttggatcatgtggtaattctgtttttaattttttgaggacgtgccataccgttttccacagcagctataccgttttacattcccactagcaatgcacaagagttcagtttctctatatcttcacaaacatttagcattttctgtttttctttttaataatagccatcttaaatagccatgggtgtgaagtggtatctcactgtgctttgacttgcattgccctaatgactagtgatattgagcatcttttcatatacctattggcaatatgtatatcttatgtggtgaaatctctgttcaaatccttcgcctgtttttggtgaagtacttttgacattacagtgtcagaggtgcctattacaacgtgcctgtaaactagctaggatgatgctacatactattgaacttgttgaagagagaaactgtaatccagatgcaaggatcttcaatggttgtttctcactgctacaattgtattttatgacttttaagtcatgacttttaccttttttaaaataataaaatagataatgtgtactgtgcatccaacttagtaatttaggggaaaaaggaaactaagggatgtagcaacaaaaaaatttataaactagaaattggaggaattaataactgcaagaatggtttataaaaagttatgaaatagagaaattgatagaactataccaagaaaaacaagagaactagggttaaaatcagcaaacacagactatataaaatgtaggtatttttataaattagaattctatgcccacgtggatgatagatatgtaaatctcaatgtaatgatatatacctgagtggcactttattttgctcaaatatgatctgtagggtctttgtattttagttatccagtagttctttcttctcagaaaaatagagtggatgttttcatccaatttagttttcagcataaaattttcttattttatttgtatatgtgtgtgtgatgtgaaataaatacacatttggtaagttagtttgatatcatgtaaagacttcagagaatagatatttatgtggcacaactttgcagagaataattttattagctttcttccctaatttgagctttcaaaaaaaacaaaaacaaaaacactgattaccgaaaatgtcaaagttgtttagtaaaaatagaaaaatgtgaggatagactatgcttgtacacaagggaactttaaaaagtttgtggaaaatggaattaaaagataaatataaaaaatataaactttagttctcaatataagctccatcaggaacaagacacttttgtaagcaatgataccaggcatttagttcatccctaaataactgagggtcctaggaatttaactatgtcagcgaaatctttttttattattattactgaagaaaaatgggttccttttacaaattttttgaggttaggaaacaaaaagaagtaagaaggagccaagtcaggactgtaaggtggatacctaatgatttcccatggaaactcttgcaaaattgcccttgtttgttgagaggaaatgagcaggagcattgttgtggtggggaaaggactctggtgaagctttcctaggtatttttctgctaaagctttagctaactttctcataataataagcagatggtattgtattttggccctccagaaactcaataagcaaaatgccatgagtattttgaattgtgagttttttgaattgttgctatgacctttacttgtaaccagtccacttttgctttgactggactacttccacctcttagtagacattgctttgattgtttttgtcttcagtactggtaaaggcatgtttcatctcctgttctttgaagaaaggcttcaggatcttgatcacagttgcttaaaatttccactgaatgcactgctcttgtctgcagctgatctgggtgcaacagttttggcacccattgagtggaaagtttgcccaactttaatttttcagtcagaattgtgtaagctgaaccagctgagatgtctatggtgttgcctattgtttctgctgttaatcatcagtccttttcaattagggcatgaacaagtttttttttttttcctcacaaattgatgcagatggtctgccactgagggcttcatcttcaacattttcttgctccttctcaaaatgagttatccatttgtaaactgctgatttctttggggcattgtccccataaactttttgtaatgattttgccattcttccatccagtcttcaccatagatgtttgttcttttttcaatttagtagaattcacattgctctgataggagcttttttcaaatggtcttatgcttctttgtgcttccaactaggtgctgttcagacatgttataacaagttaatacaagtttgttttggtgcaaatgtttttaaaatccatgcatagtttttaaataatatgtatttttcataaactttttgaagtctcttgtatttgatgacttctaccatggacattgaacaactatactgtttaacgctaaatctgaatttaatgatggatttggttttcctcttttaaatcatgtgtaaatgactattaattctattatgtgggttttggttatgctgcaatgcattgtacccatggaacagcacaactaatggctaatacttctaatgtgaggaatttaattcatctttaaaatgattataaataagtagcaatatgaaaataataataagaggtattaagttccttcatttttctaacagggtcaacatatttcactggcacctattcacaagcttgaagaagctctgtatgaataccagccactgcagatagagacatatggaccacatgttcctgagcttgagatgctaggaagacttgggtatgtgtcctaaagaactttacattgaggagctgatatgtgggacttattgctgttcttaactgacatgttaacattcttagattttcagtttatagaactttactgttttgtgaaaaatgaacagtactcaataccaaattgttttatttagtacattaatttttctgtggacttgttaggtctcttgagattgagcctggaatacattcgttcttttagaagtctgtccttggcagccatattgaaatggcgtttattttcagtcatgagtgtttttttcttttttaaagaaattggggcttaatttagttagtagtaagccaataaaaatatgaattgggctccttgccatgaaaaagggtagatttactcattgtgcactgtctacagtgaaactacatttatgagccatgagccatgaaatatattttgttgaaaggtataatgtaaggctggccctgtggttcaacagtcatattatatatatccattctggaaatgaacctgggatcctggcttttgtgagggatggagagatggttatagtctctctcatgggagcaagtgggtatttgtatacttgaaaagcgcaggcacagatgttgctagatggagcaaatcatttcttggtctcattttaaaatgtgaactattgaatgaaaggctgatccagaaactgttgttgcttaacaaaagaaaatagtggaaagaatatactatgaaaaaaaagtgggtaaatcgagtccaagaaactaaaaagcaatagaaaaagtcagagaccccaagaacaaaaacaagaaagatgaaacaaataataaaacctacatgcatcttcaaaaacaaaaccaaaatctggaacatgttgcataatattttacatgtgaacatcaaggctccaaggtaaagttacatttaaatgatatttaatatcttaaggctaaattttattcagttctttattctcttaaagtcctacagcctacaagcatgaagccaacaggatgtaaaacaacctaaaaccccctttgagataacagatttattaaacaattgtcttaaatgctaaaattgaagtttgaagagatagacaatattgcgttttataatgtaaaaagttatacatgatgtagacatttatttcttatctcttacaaagagccagaatcgtgtatctttaaaataaatttacttcaaaatctttacttttaatgtccgtgaagttcacgtgtttaaaatagtactcctctgttactaggttttgcattttccaataattttgtcaaaatttttcatatacagattttcttatgtccgggtagctttcttctgttcctagaatgttgaattattattatttttttcttgagacagagtctcactttgtcacccaggctggagtgcagtggtgcaatcttggctcactgcaacctctgcctcctgggttcaagtgattctcatgcctcagcctcccgagtagctgaggctgcaggcatgcaccaccatgcctggctaattattgtattttttgtagagacagggtttcaccatgttggccaggctggtctcgaactcctggcctcaagtgatctgcccaccttggccccccaaaagtgctgggattacaagtgtgaaccactgcgcccggcccatcttttaatatactgaattcagtttgctggtgttttgtcagggattcttgcattagtgttcataaaggatattggctcatagtgttttctagctttattaagatataattaaaaaagaaaaattatatatatttaagatagagaagatttttttaagtattaatttttgtgggcacatagtaggtatatatacagtgggctatgggagatattttgatacaagcatgtaatgtgtaataatcacattaaggtagatggtatatccattacctcaacatttattctttgtgttacaaagaatccaattatattattttagttattttcgaatgtacaattaaattatgattgactatagtcaccctgttgttctatcaaatactagttcttggccaggcgcagtggctcatgcctgtaatcccagctctttgggaggctgaggtgggcagatcacttgaggtcaggagtttgaggcaagcctggccaacatgatgaaaccccgactctactaaaaatacaaaataatagctgggtatggtggtatgcacctttaatcacagctacttgggaggctgaggcaggagaatcacttgaacctgggaggcagaggttgcagtgagccaagattgtgccactgcactctagcctgggtgacaaaaacaaaaacaaacaaaacaaaaccaaaaactggttcctattcattctaactatttttttttctacccattaaccatccccacatcctctcccacctcctcactacccttcacaacctctggtgaccttccttctactccctatcagttcaatttttagcttccacaaataagtgggaacatgctaagtttgtctttctgtgcctggcttatttcacttaacataatgaccaccagttccatgtatgttgtttcaaatgacaggatcgcataccttttttatggctgaataatactccactgtgtatatgtaccacattttctttattcagtcatctgttgatggacatgtagattgcttccaaatcttggctattgtgaacagtcctgtaacaaacatgggagtgcagatgtcattttgaaatactaattccctttcttttgggtatatacccagcagtgggattgctggatcatatagtagctctatttttgttttttgacaaacctcgaaactgttctccatactggttgtactaatttacatatccaccaacagtgtacaagattttcttttttccacatcctctccagtactcgttactgcttgtctttggataaaagccatttaaactgggatgagattctatctcattgtagttttgatttgcatttctctgatgattactggtgatgttgagcatttttacatatgactgtttgccatttgtatatcttcctttgagaaatgtatgttcaaatcttttgcccatttttacgttggattattacattttttcctgttgagttgtttgagttccttacatattctggttaataatgccttgtcagatgggtagtttgaaaatattttctcccattctataggttgtctctttgttcatcgatttcttcgctttgcagaagctttttaacttgatgtgatcctacttacctatttttgctttagttgcctgtgcttgtgggggtgttcctcaaaaatctttgcccactccaatatcctggagcgtttccccaatgtttaattttagtaggttaaatagtttgaggtcttagatttaagtgtttcatcctgatttgatttttgtatgtggtgagagttaggggtctagtttcattcttatgcatatggatatccagttttcccagtaccatattttgaagagattttcttttcccaaatgtatggtcttggcacttttgtcaaaaatgagttcactgtagatgcatggatttgttttgagattctctattttgttccattggtctctgtgtccatttttatgccagtaccatgctattttagttactatagctctgtagtatttgaagtcaggtaatataattcctgaagttttatatctttaaagtttctttaaagatagctttggctattctgggtcttttgtgattccatataaattttaggaattttttaatttctgtgaagaatgtcattggtattttgatagagattgcatttaatctgtagattgctttgggtactatggccattttaacattattgattcttccaatccatgaacatggaatatcttttgtgtgtgtgtgtcctcttcaattttttgcatcagtattttatagttttcatagtagagatctttcacttatttggttaattcctaggtattttattctagctattgtaaatgggattactttcttgatttcttttttagattgttcactcttggcatatagaaatgctgctgatttttgtgtgctgattttgtattctgcaactttactcaatttgtttatcagttctaatagtttttttgtgaagtctttaggtttttccaaatataagatcatatcatctgtaaacaaaaataatttgacttactcctttctgctttggatgtcctttatttctttctcctgtctgattgctctagctaggactgccagttctgtgttgaatagcagtggtgatagtgggcattcttgctgtattccagatcttagaagaaagactttcagttttcccccattcagtatactagctgcaggtctgttatatatggctttcattatgttgaggtaaattccttttatacccaggtttttgagggtttttaccatgaaagaatgttgaattttattaaatgcttactcagcatcagttgaagtgatcatatggtttggtcctcactctgttgatatgatatatcatattgattgatttgcatatgttgaaccatccttgtattcctgggataaatcacatgtggtcatgatgagtgaatgatctttttaacatgttgttgaattcagcttgctagtattttgttgaggcttgcaaacactatcttataacccattattttaagctgatgacaacttaaggttgatagcataaacaaacaaacaaacaaataagcaaaatcaaaactagtaaaaactctacactttaactttgtccccttgctttttaactttttgttgttctatttatatcttattgtactacgtcttgaaaagttgtagttattatgtttaattgatttatcttttagttttcctacttaagagtagtttatctaccatgattacagtgtgggaatattctgtgtttttctgtgtacttaccattaccagtgaattttgtaccttcaggtgacttcatattgctcattaatgttcttttctttctaattgaagaaccccctttagcatttcttgtaagacaggtctggtgttgataaaaaccttcagcttttgtttgtccgggaaagtctttatttgtttctccttcatgtttgcagaacattttcaccggatatactattctagggcaaaagctttttccttcatgccagtctcttctggcctataaggtttccactgaagagttcgctgccagacatattggacctccattctatgttatttgtatattttgtctttctgcttgtagaattctttatccttgacctttgggagtttgagtgttaaatgctttgaggtattcttttttgagttgaatctgcttggtgttctgtaaccttcttgtacttgaatagttgaatattgatatatttctctagatttgggaaatgttctgttattctccttatgaataaacgttctaccctcatctctctctctgtctcctatttaggccccataactcttagatttgcacttttgaggctattttctagatcttttaggcatgcttcattgttttttattgttaattttgttttgttttctttgactgtattttcaaatagcttatattcaagttcactcttctgcttaatcaattctgctattaagagactctggtttttgtttgtattttcttgatgattagtgatgttgagcagcttttcatacaccttttggccattcatatgttatctttggggaaatgactattcaggtcctttgcccatttttaagttgagttatttggttttgtttgcctttgagctattcaagttctttatataatttgggtattaaccctttattggatgtatagtttgtatagtttgcaaatatattttcccaatgtgtaggttggtttttcattttgttgtttatttcctttgttgtctagagctttttagtttgatgtagctctatttgtttattttcagttttgttgcgtatttggtgtcttatccagaaaaccattgccaaagttaacatcaaggatctttctcactatgttttctcttaagaattttatggtttcaggttttatttttaagtctttagtccattttgagttgatgttttttaatatggtgtatgataagggccagtttcattcacttgtatgtgtatagttctctcagtgccattgactaaaaatattagcctttttccattgtatgttttcatgcccttatcaaaaattagttgactgcagatgtttgggtttatttctgggctccctattctgttccaatgtgtatatgtttgtttttgtgtcaataccatactatagctttgtaatattatctgatatcagcaaatttggtgtttccaactttgttcttccttttcaaggctgttttgttttttgtgggtattttgtggtttcatgtgaactttataatttttttctatttgtattgaaaatgccatgagaatgttgatagggattttgttgaatctgtatactgcttttggtagtatggacattttaacaatattcctctattcttacggacatgggatttgttgccgtttatttatgttgtcttcagtgtttcatatttttcagtgtgtacagctttgacctcctttgttaaatttgttcttaagtatcttaatctttttgattaatcttttgattagcctttgaaaaaggctaatgtaatgttttgattacattacattaaaggctaatgtaatgttttgatttttttcagatatatcaatattagtataaagaaatatagctgatttttgcatgtctgttttgattacaaaaaagctaatgtaatgttttgatttttttttcagatacttcactattagtataaagaaatatagctgatttttgcatgtctgttttctatcttgctactttattgaattcattttctaattctaactttttggtctaatctttatgattttgtacatataggatcatgtcatatgcagagaggcataattttacttcttgatttcctatttggatgtattttatttttcttgtctaattgctctttataatacttccaattctatgttgaatgtaattgatgaaagtggacgtccttgtcttggggtcaggcaaaaactgaaaacttttcctctgttgattataatgttaggcataggcctttcataaatgacctcaattttgttcaggacattttattctaaacttattttgttgacagttgttatgaaaagattttgaactttgtcaaatgctttccctgcatatatattgagatgatcatgtggtttttatttttcattctattgatgagttgtataacattgatttgcattttttttgttgttgttgttacatatcagagctgttttttttcttgtttttgtttgttttttgtttttattttattttattattatgctttaagttttagggtacatgtgcacaatgtgcaggttagttacatatgcatacatgtgccatgctggtgtgctgtacccattaactcgtcatttagcattaggtatatctcctaatgctatccctcccccctccccccaccccacaacagtccccagagtgtgatgttccccttcctgtgtccatgtgttctcattgttcccacctgtgagtgagaacatgtggtgtttggtttttgtccttgcgatagtttactgagaatgatgatttccagtttcatccatgtccctacaaaggacatgaactcatcatttttcatggctgcatagtattccatggtgtagcagaactgcaggaaatagagacacaaaaaacccttcaaaaaattaatgtatccaggagctggttttttgaaaggatccacaaaattgatagaccgctagcaagactaataaagaacaaaagagagaagaatcaaatagatgcaataaaaaatgataaaggggatatcaccaccaatcccacagaaatacaaactaccatcagagaatactacaaacacctctatgcaaataaactagaaaatctagaagaaatggataaattcctcgacacacacaccctcccaagactaaaccaggaagaagttgaatctctgaatagaccaataacaggctctgaaattgtggcagtaatcaatagcttaccaaccaaaaagagtccaggaccagatggattcacagctgaattctaccagaggtacaaggaggaactggtaccattccttctgaaactattccaatcaatagaaaaagagggaatcctccctaactcattgtatgaggccagcatcatcctgataccaaagctgggcagagacacaaccaaaaaagagaattttagaccaatatccttgatgaacattgatgcaaaaatcctcaataaaatattggcaaaccgaatccagcagcacatcaaaaagcttatccaccatgatcaagtgggcttcatccctgggatgcaaggctggttcaacatacacaaatcaataatcataatccagcatattaacagaaccaaagacaaaaaccacatgattatctcaatagatgcagaaaagcctttgacaaaattcaacaacgcttcatgctagaaactctcaataaattaggtattgatgggacatatctcaaaataataagagctatctatgacaaacccatagccaatatcatacagaatggacaaaaaatggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaaggtacaaaaatcacaagcattcttatacaccaacaacagacaaacagagagccaaatcatgagtgaactcccattcacaattgcttcaaagagaataaaatacctaggaatccaacttagaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaacttactttaaagttcatatggaaccaaaaaagagcccgcatcgctgagtcaattgtaagccaaaagaacaaagctggaggcatcacactacctgacttcaaactatactacaaggctacagtaaccaaaacggcatggcactggtaccaaaacagagatatagatcaatggaacagaacagagccctcagaaataatgctgcattatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagatctaaaaccataaaaaccctagaagaaaacctaggcaataccattgaggacataggcatgggcaaggacttcatgtctaaaacaccaaaaaaaatggcaacaaaagccaaaattgacaaatgggatctaattaaactaaagagcttcttcacagcaaaagaaactaccatcagagtgaacaggcaacctacaaaatgggagaaaattttcacaacctactcatctggcaaagagctaatatccagaatctacaatgaactcaaacaaatttgcaagaaaaaacaaacaaccccatcaaaaagtgggcaaaggatatgaacagacacttctcaaaagaagacgtttatgcagccaaaaaacacatgaaaaaatgctcaccatcactggtcatcagagaaatgcaaatcaaaaccacaatgagataccatttcacaccaattagaatggcaatcattaaaaagtcaggaaacaacaggtgctggagaggatgtggagaaataggaacacttttacactgttggtgggactgtaaaccagttcaaccattgtggaagtcagtgtggtgattcctcagggatctagaagtagaaataccatttgacccagccatcccattactgggtatatacccaaaggactataaatcatgctgctataaagacacatgcacacatatgtttattgaggcactattcacaatagcaaagacttggaaccaagccaaatgtccaacaatgatagagcggattaagaaaatgtggcacatatacaccatgatttgcatttgttaaaccaaccttgcatcccaggcataaatttacgtactcatgatgtaaaatcttcttggtatgttgttgattgcatctcttcatctgagatactggcttttagttttcttgtagtctctgtctggcttttatatcagaatgtatagtcagggttctctagagggacagaactaatagatagatgtatatatgaaggggagtttattacggagtattgactcacacgatcacaaggtgaagccccactatacaccatctgcaagctaaggagcaagggaggaagccagtccgagtcccaaaatctcaaaagtagggaagccgacagagcagccttcagtctgtggccgaaggcttgagtgcccctggcaaaccactggtttaagtccaagagtccacaagccgaagaacttggagtccaatgtttgaggacagaaagcatccagcatgggagaaagatgaagtctggaagactcagcaagtctgctctttccaccttcttttgcctgctttattctagccacactggcagctgattaggtggtgcccacccagattgagaatgcgtctgcctctcccggctcactgactcttgttagtctcctttggcaacaccctcacagacacacccaggaacaatactttgcatccttccatccaatcaagttgacattcactattaaccatcacacagagtatagaatgagttagggagtgtttcttcctcttcacttttttagaaacatttgagaaggattggtgatagttcttctttaaatgtttcatctaggttacccagtttgctcatagttctctcatataatcctataatccttttaatttctttagaattggtaataatggctccactttcatttctgattttagtaatttaagtcttctctcctttttccttagtctatttagcatttctgattttactaatttaagtcttctctcgttttttcttagtctgtttagctaaagatctggtaattttgttgatctttttgacagaatcacctcaatttatttatttttctcttttttctattctctattttgtttatttctgctttaatcttcattattttcttttttctgctagttttaggtttagtttgttcttctctttctagttccttaagtgtaatgttagattgttgatttaagacttttcttgttttgtttgttttttttttgagacaaagtcttgctgctctgttgcccacgccagagtgcagtggcatgattcagctaactgcaacctccgcctcccatattcaagtgcttctcctgcttcagcctcctgagtagctggaatttacaagcgtgcaccaccattcctggctaattttttgtagttttagtagagaccgggttttaccacgttggccaggctggtctcgaactcctgacttcaagtgatctgcccaccttggcctcccaaagtgctgggattacaggtgtgagacactgtgcttggtcagatttttcttgttttttaatgttagcactcatagctataaattttcctcttagtactcttttgctgtgtcccatacgttttggtatggcttgttcttgtttttattcatttccaactattttctaattttccttgcgattttttttgaaacattggttatttaatagtgtattgtacgatttctacaaatttgtgaattttctagtttttcttccattattggttgctaacctcatcctgttatgattggggaagatactttgtatgatatcaattttttaaaaatttattaacacttaaattatggcctaaaatatggcctgtcctggaaaatgttccatgtgcactttagaggaatgtgtagtgtattttcttgtagttgagtatagtgttccatatatgttttttcagtccagttggtttattctattgttcaagtcctctgttttatttatcttttgtctagtttttctatctattattgagaggggagtattgaaggctttaactattattgtaaaactctccctttggttcatatgttttgatggtctgttattaggtaagtaaatattttaactaatatgttatgttcttttgtcttatgaacacttaaagttgaaaatctgttttgcctcatattagtatttacctctgttctgtttttgttactattcgcatggaatagcctttttcattcttttacttttaacctatttgtgattttgaatccaaagttagtttcttgtagataacatatagttggatcatggttttatttattttttatgtattctaccaatttctatcttttgattggagggtttaattaagccacatttaaagttattactgataaggatggtcttccatcattttttatttgttttacatgtgccttatagctttttctcccttatttcctatataactgttttctttgtgtttattttttagtgccacattgaaattctttgcttatcctctattgtgtatattcttgagctattcttttgtcattatgatgattacatttattatcctaagttgtagcactctgaatttatacaagcttaacttcagtaacatgcaaaaactctgcttttaaacagttctgtcctcaccccttttagttgacagcaccacagaattacatctttatatattgtgtgtccaagattattaataaattatttttttaaatgtgttagtttcttaaattatgtagaaaacaaaatgtgagttataaaacttagtaataatactggcttttagactaatttttttaaaaaagatattagtctcttaaatcttacaatgttataccttttgattatcttttttacttacacctcttgtatgctctattttgtgctttttaattttttaaaaaagtttgttttaaaagttaggataatttctcttgtcccatcttcaagttcacttattcttctattttgcccattctgctgataaggccatcaaaggaattctttttaatattgcaatttttatatctagtattttcattcactttttaaaaatgattttcacttcttaaattccctacctgttcatacatattatccaccttttccattagatcctttaagttattaatcatagtattttcttaactcctcctcttatctttgggtttgattctgttgactgttttgtgtcctcatgatacatttgttttcctgtttgttttagttattatttgaatattggacattctgtatgacagaatagtagattctgagataaataatatttatgcacagaaatatttacatgcctttttctgctaggccattagtgtcaagagctgagtattctgtattttgatcttggttttggttttttgttgctccagttcctatcaatgtaccacaggcttcaaattcatctagtcacaatttattgccaccttgcttttagtgtgaggcctggagtgctggaaggagttttctaggttttcttgttctaccctctagttttcaacaggctctgtaagcctgagccacagagggcttctctcttggtgttgctcccctatagtagattgcccttgctttttacttagaataagtcttatggtgggaagaaggtttttcttgcttctccttttccaacgttagtcataggaggacctgtgtgcctgaggatcaggatggtgctttcttagtgttcctatttctttcccagaggccaacaatttgtatctgttacttcagggtacaggtggcttttctgtccctccccagactcgcaactgaagtttgtcttgttttgttgcaggtggggaatcttgggcacagggctgtttcctgcctctcccctagacttatgctttgcatcagtgtaggaccctaggtgtgagttggtttcctgcctttcctcagtggttggtttctctttcctgtttcaatgtaggactaggaatgcgggcagtaggttttctacccctcctccattggcacccaatctttgctcctccgtagcagtggaggcttggatgttttttttttttaaaataatttatttcctcttgcatttagtgcttcattattgctgattttattgggtctgtttcatggaatatcctcctcatctttcttttttagtcttctatggtggtggtacttcttagaacatgaagatttaaataagggttagaattccctgtaaagtaggtttagcctgattgtctattttttcccagtaagttattaaattaaataaacttgggcaacactttgtttggagccctttttgtgtttctttctgcctttacctctatgggttggagttttaaatgtaggatgtgtcctttagataaggtataaccttagtgttcttacttttcccaagtttttcatacttaacatctgatttgaagggagggaggagcactttttgtgtgtttgtgtgtgtgtctgttggtggtggtggtggtggtagggccttcatcaagcattgaatatttataatacaattagttccaagatcctagaagtagacttttgtctttgtccataaagactgtacatacattttatatctacaacagttaaaaaggcaaattgttacgattacaaataaacatgtatacacttcaagcagtaaatcttggccgtaacagtttcttttagccatctgtggctaaatagtgaaggaatttagataattagtagtgatatcagaattgctaaataatttgttttttttggtccaggaactatttatctaccaaaatagaatgtgtaactcatacttcccttctcttcagtcttctaccttgacaaagggattacattctatacagaggactttagttattagagccaggattagctcaagctttctctttgttgatatattgtggccttatacttagatatgtgccaaagtaaatcctaaattgagttcttgtatcagaagttaactttcttttctggaattattatctgaagctatctgctttcttattgtttttcttattactgtagacctaaaaatatatttttacctaactaaatttttagaaacatttagaaaggaactgaagaagttgctttgtgaagtgacttttcaaagaatgatttgaggtgctgttcataaggtatgaggataaggtatcagttttgtaaagctgtaatattttcacattcatcctaacagttgtccatgtcgttgctagaagattacatctaataagctccagttatccctttacaatggtctttcccccaacccaaaacttctagcctctagtgctctctcctttcctttccttattgtaacaaaatttccattttatattctgttttcctacaaagggaactagtttaatttctctagaggcaaatagagaatacatcaattatctcagccatgtgtggtagctcatgcctataatcctagcactttgggaggctgagttggaaggattgcttgacaccaggagttcaagaccagcctggtcaacatagtgagactctgtctcaacaaaacaaaacaaaacaaaacaaaagaaatcatctcgtttccgttttccaatatctgcgttgaaactatgtgacatggtgaagttaagagtagtacagtttttttgtagctacaccttatttgtttctaaaatgtggacacaggcactttcaagataattttaattatgtatttttgggagtggatgacataaggtcttgggaggcattggtctcccaagaactatatttttgttcttttataaaactttgataaggaataaaaccaaaagaatactgcgttgagatttttaggtgattgttactgagatcttttcacaatgaagttagttaaactagagaaatagatgaagaatatttgtgaatttctcattcacagggtatcattagtaaataattataactcaaattgtactggcagtactcttctggtgtgctcaaaacaatacataaacatgttttattctgtgccagtgggagcaagcagtgggaaaacttaactgctaattgaaattccctagattatggccatagtggttagtttaggaaagtctaattgattgtcaatgtgagactctctttttaataatcatctagctttctagttaatattttactaccttccactcaaagaagagttattcccttaattgatacaaatcatgaacatttgtgacacaactagattcatccatttcaagttattaatcaaatataactactgtcttcttttttctttttgaaatggagtctctattgcccaaactagagtgcagtggcgtgatctcggctcactgcaacctccgcttcctgggttcacgcaactctcctgcttcaaccttctgagtagctggaaaaacaggcgcacaccaccatgcctgtctaattttttgtatttttagtagagacggggtttcaccatgttggccaggctggtctcgaactctgaccccacgtgatccacacgcctcagcctcccaaagtgctgggattacaggcatgagccaccgcgcctggccataactactattttcactaagtatacaagtgatttatttaatgtgagctgttcatttgtgaatgattatggaaataaaaaaaaaagacttgttggcaaagtgttgaatagataactttattgttattattttatttctttcatgtactccagcagataaagataatgtaccttctgaacctactcttaaaattcccaagaaatcaattgacagattagttataagtaagaaatttaaaacttgattttaaacatttataatttatatccgcatgattttttgtaaattttggtttggattcttagaagttcatataacattttaatgaatgtttatgagtaaatttctgtattactcaaatacttgaatagtgaaaaataattaaaaattacagagtatttaaggtagatataaatttgtcatatatatggtttcaggcaaactttgataccggccatgaaaatactacatgatgaaatatttaagtagtttcatataagagttacggttttattaaaagcactgctagtttatatttatgtaaatatatgcattatgtaaatacataatttatatatatctttaaatttctgtgtaaaataatcatatgtaaagctgagaagtaagaatgacttctctaatatgatatttcagaatgcctttctcagttttatgggaatatctattactttcattctatgacatgttgtgacatttttatgataaaatatctttatttaaggtgtgtattcttaaattttccttatgcatgatttaaatgaagctgtttgctaccaaaattctgcagaatgaaatttttttcttttactgatacataatattttacatatttatggggtacatgtgaatatttttacatgcatagaatgtgtaattatcaagtcaggatatttggggtatccgtcaccttgagtatttattatttctatgtgttggtaacctttcaagtcctctcttctggctacttagaaatatataacatattgttgctaactgtagtcaccctagtctcttattgaacattagaacttatttcttctatctaactgtaagtttatactcattcactaacctctctttatttttcctttccgccctcacacccttcccagcctctgctatattctagtgtctatctccatgagatcaagtttttatgtgagtgagaacatgcaaaagttgtctttctgtgtctggtttattttacttaacctgatgaactccaattccctccatgttgctgcaaatgacgtggtttaattcctttgaatggctaaatagtaatacattgtgtgtgtgtgtgtgtgtgtgtgtgtgtgtgtgtgtgtgcgcgccacatttttttaatccatttgtccatagatggatacttagattgattctacagtttttgctattgtgaatggtgttgtgatgaacatgtaagtgcaaggtgtccttgatatactgatttcttttcctttggttagatacccagtagtgggattgctggatcatatagttctattttaattttttgaggaatctccatactggtttctgtaatggttataccaatttgcattcccaccaatagaatcctcttttctctgtatccttaccagcatgtgtaattttttgtctttttaataatagccctgctaactggggtaagatgctatctcattgtggtttatatttgcatttccctgatgattagtgatgttgagcattttttcatatacctgttggcatttgtatgtcttcttttgaaaaagtttctattcatattctttgcctactttttaatgagattacctttttttattgttgaattgagttctttgtatattctagatgttaggtccttgtaagatgaatagtttgcaaatattttctcccaatcaacatcttgtctcctcactctgttgattgtttcctttgctgtgcagaagtttttagtttaacatagttccatttgtctatttttgttttacttacctatgcttttgaggtcttagccataaaatctttgcctaaaccaatgtcctcaagtgtttcccctttgtttttttctagtagttttatatcatctggtcatacatttaagtctttaattcaccttgagttgatttttgtatatggtgagagataggagtccagttacattattctgcatatgaatatccaattttcccagcaccacttattaaagaaggaattctttccccagtgtacgtacttggtatcattgttgattattaattggccgtaaacatgtggctttatttccgggttctctattatgttccactgatcttgtagaatgaaatttttatcttaatttcatgtagagcttgtctttatactgctttgtggtagctacaatgctctatcacaaagcaatacaaagatatagatgcacgtacttatttctgtcttatgttgacataactggcataagttctgtactatcaatcagcaaactttaaaaatgatttttaactgtgaaggtttaatgtcctgagtcacaagacatgataatatctattattatatcatcagtagtgaaaataattgtagtagttatgatgatattgaattaagtcagttaattagaacctgatggtaattagaagaaaatttcttgcttgatctctattagcagagaatatctaactattattatatcatcagtagtgaaaataattgtagtagttatggtggtattgaattaagtcagttaattagaacctgatggtaattagaagaaaatttcttgtttgatctctattagcactattaattttgttttcttgtgtggccatagactgcattcataaaaaccaacttgctgagcaaaagtaattgattatcacaaatctattactcttattggcaaagcaattaaaaaatctatgactcttgaagaaatagaatagggtccagttcacaaaaatacaggtgtacctcattttattgcatttcgttttattactttttgcaaatattgcaagtatatcaatgctgtttttccaacagcatgtactcacctcatgtctgtttttcacatttggttaattcttacactatttcagacttttgcatgattttatctgtgtggtgatttgtgattagtgatcttttgctgttactattattgttttggttgccacaaactgtacccatataagaaggtgaagttaataaatgtgtgtgttctgactgttcttctgactggctgtttccccatctctctctctctctctctctctctctctctctctctcttaccttggacttccctattccctgagacgcagcaatattgaaattaggccaattaataaccctgcagagggttctgtgtgttcaagtgagaggaagggtcacatgtctctcactttcaatgaaaagatagaagtgattaagcttagtgagcaagatatgtcaaaaaccaaaataggcaaaagctagacctcttgtgccaaacagccaagttgtgaatgcagaggaaaagttcttaaaggaaattaaaagtgttgctccaatgaacacatgaatgttaagaaagcaaaacagcctgattgctgctatggagaaagttttagtggtctggatagatcgaagaagcaagaacaatcccttaaaccaaagcctaactttctttaatcctatgaaggctgagaaaggtgaggaagctacagaagaaaattctaaagctaacaaaggttggttcatgaaatgtaaggaaggatgccatttccgtaacgtaaagtgcaaggtgaagcagcaagggctgatgtggaagcttcagcaagatctaccaagatattgatgaaggtggctactctgaacacagatttttcaatgtagatgaaacatccgtctattggaaggagatgccatctaggattttcatagccagaaagaagtcagccacttatggtagctcacacctctcattccaggattttgggaggctgaggcaggcagatagcttgagcccaagagttcaagagcagcctgggcaacatggcaaaaaatacaaaaattagctaggcatggtgatgggaggtagctactcaggaggctgaggtgggagaatcacctgagcctggggaggttgaggctgcagtgagccatgatcatgtcactgtactccagcctgggtgaccctgagctggagtgtagtgatgtgatacagtgagagcctgtctcaaaaaaaaaaaaaaaaaaaaaaaaaaaaagtcaatgcctgtttccagagcttcaaaagcaagtctgactctctttttaggagcaaatgcagctggtgactttaaattgaagccgatatttatttgccattttgaaaattgtagggcccctaaaaagtatgctaaatctactctgcctgtgctttataaatggaatgaaaaagccaggatgacagtgtgtctgtttacagcatggtttgctgaatatttgaagcccactcttgagacttactgcttcggaaaaaagagatttctttcaaaacactgctactcattgacattacatctggtcacctaagacttctgatggatatgtgcaaggagatggatattgttttcatgactgctagcacaacatccattctaaagcccatggatcaaggagtaattttgacttttcagtcttgttatttaaataatatgtttcatagtgctatagctgccatagatagtgattcctctgatggatctggatgaaacaaattgaaaaccttctggaaacaattcattactctagaagccattaggaatatttgtgcattaggaatatttgtgatccatgggaggaggtcagaatatcagcattatcaggaatttgaaagaagttaattccaaccccatgtttgagattttgttggaagaagtaaccgcaaatggggtgaaaatagcaagaaaactagaattagccgtggagactgaagatatgactgaattactacagtcttataataaaacttgaacaaatgagaaactgactcttagggatgagtaaagaaagtggtttcttgagatggaatctgctcctggtgaagatgctgtgaacattgttgaaatgacaacaaaggatttagaatattatataaactgagctgataaagcagtgatagggtttgagaggattgcctctaatttttaaagaagttctgctgtaagtaaaatgctattaaacagcattatgtgctacagagaaatcttttgtgaaaggaagagtcaatcaacgcagcaaactttattattgtcttattttaagaaattgctatgacctccccagtcttcagcaaccaccattgtgatcagtaaagcagatatcaacatccaggcaagagctttcatcagcaaaaagattaggactagccgatggcccagaggatcattatcatttttcattaatacataatctatttatttgggattttaactacatttgcaaaatcattttttatatataatataatcacagcaatgaagactgtcatattgatggtcctatttatacccaaggactgagaattatgcaaggaatggatacaacggggtagaatattgagggccatgtctaaattctgcctactacaagcgagataggttttctcttgctacttatctttctcaaaatattctaagcatttttatacatttatactttgaagtaaactttgttggcaaaagcaacaaagcactccataattgtttcaaaatttgtgtacatttgaaaatttttataaaatactgtgaatcaagtaatgaaacatcaaaagccaccaacaacttagctaataagatacatccatccccctatatagtaatcaaacaccaatccttttgggattgtacctggaatttaaacttacaatctgatcagagaagaatgggcatttaaaatatacttagtttttatatatatcacacatttcttggaaattaattttcattatattctacttttgatgctgttgtgataaagttttcatcatgctttctaactggttcttgctgttatatatgaaaactattaaatgtaattttctacataatattttactgaattctaatagtttctatacctagttctattaggtaaatatctgggtttttatctaggagtcagtcagctgaaaaaaaattttttttcttttcaatgctatatttgtgactttaggtttatattttattgtattttggctagaacttgtagaacttttagaccaagtataattctaataactgtagtttctttctgtttttttttctggtgaatgcctcaagtgtttcatcattaagtattatattcgctgtttaagtgttttttttgtatcacatatatgtattttctaaatcacaatgaaggaattgcatcatgaatatatattaaatcttcgtcttcacatttaattttattgaatgcttttatgcatctattgatgtagtttttgaacctaatggtgtataatattattaaaaattttttcaatagcaagtacttcctatattcctagatagctacctacctaaaatagcgtttgggaaaggtagaatttcagctgaaaacttcaagttcaggaaatttgttttaaatggattagtttacgttctaccagtgaaaaataattgaggcaatctataatactttaaaaatcttaacacttaagaaatttaaatttaatcagctatatgaaagcataattcacatacaataaaatacctattttattgtatattccaatgagttttgacaaacacatccagtttgtaaccaccagcacagccacgatatagaatatttgtataatctgctttcactgtgattgtgcttttttctggaaatcacttagaatttttacatatgaaagtgttacttatattccaaaatttccatgagagaatgtggcattctgtatactgctttttggtcatagtctttaccttcgtctttaccttataatattgacttattatatatggattgtgtaagaatggtgaaaacgtagttgtttcatttaagttttgttttgtttttgatgctacccatgtaagtttttttttttttttttttttctttttgatggagtttctctctgtcgcctggctggagtgcagtggcacaatcttggcctactgcaacttctgcctcccaggttcaagcaattctcctgcctcagcctcccgagtagcggggactgcaggcacccgccaccacatctgactgatttttgtattttttagtagagatggggtttcaccatattggccaggctggtcttgaactcctgaccttgtgatccacccgccttggcctcccaaagtgctgggattacaggcgtgggccactgtgcccgaccttaagtttatatgttagttttacagaaagtcttggggcatcagaaaatcaaagaatgtggaaaaatacaaaaatcacaaaaaaactgcaatatgcatgtgtatataacatataatttatactatacttggtggtaattatgaaaatattactaaattaatttttttttctggttatgacagcaaaatgtctttagtatttgtttttttgtttgtttgtttttgggggcatttaaattagaaatgaactcacatatctaacatgaatctttgtgcttaaaattctaacctggctctagtcttgcaagttttaaatcttttttatgcagttatggaaaaaatatgtttctgcttgaagcagttgtcaaacaagcttctttcatcaacagtcagacacagggcagctgaatgaggctgtttagtctagagtgaatgctcatgagattacaaggtcactgaggaaatataattgtgtagttggttccagaatagttttttgtagtgaggacttaaattataacatcaatttaaaaatatataaaatgagatatattctaaaattaatctcagaaagaaagcactaagttaaaaaaagtaaattattacaataaaatgttttaatttatatttttacaggacccttaaaaaagcagattcagtttattattggactttgtttacttctcccgtatcatggtagaattcagtagatcccgtggatcttatttaaaattgtctccattgggaaatgaaacctcattgtatagctcaggttaactgagaaaacaatagattgttcagcagttcctttttttttttttttttttttttttttttgacggagtctcgctctgttgcccaggctggagtgcagtggcatgatcttggctcactgttcagcagttcttttacttttgttattcatttggttgtcagttagcaaatagctatgaagtgcctactgtgtgccagttactgttctgggtgctgagaaaacagtagtgagccaaacagaggagtaaatgtctactatcatgaagcttaaattctcctgtaataaaaccaacaataacagtacattattgaatctgttaagatgctgttagatgtttctatgaaagatctaacatttgagatgaaacttaaaattcaactgtaataaaaccaacaataacagtacattattgaatatgttagatgctgttagatatttctaatattagaaacacctgttagatatagcagataaaccagggttttccagagaaagaatcaataggacatttagagatacataagaggatgttcatgtttggaattggctcacatgattatagaggctgagaagtcccatgatatgctatcagcaaccaggagaaccagggaagttcatagtataactcacgctgaatccaaaggcctgagaattaagggagccagtgatgtgactctcagtttgaggttgaagtcctgagaatggagacttagcgggggtggaggtgaaagtcatggagtatgaaggcccaagaaccttgagttatgatgtccaaggacagagtaaatgtcccagctccagaagaaagagtgaatttacacttccttcgtttttttgctgtgttcaggccctcagctggattggatgacatccatccacattggtgagggtgtatattttgtactaagacttttgattcaaatgccaatcttttctggaaacaccttcacagacgcacccagaaataatgttttaccagccatcaggagatcctttagcccagtcaagttgacacataaaattctatatgataattagtactttgaagacaaataaaggataaaaggatggatagtgattggagtagtgtgctatttttggtgattgaaatcttttgtaagatggtattttagcaaatacctgaattagcaaagaaatgagtcatttgatatccttgggagagtcagcaggaactgtaaatgcaccagtgggaatatgaataaggaagaggaaggagtgcagaatgtctggagcaggagtaaatatagggaatggtaggagaataggttcagagaggtagcaggtttttatgtaagggggcaggctagacctagttgatgatacaggtctttatagaccatggtcaagacttgggtttttactttgaaggagatgcgaagtcataggagaattttgaacagaagttgccataatattactttcatctagaaaggtctgtcatcagagagtagatggtgggcaatggtggcaaggggcagcgtgaatgcaagaaaatttgcagtagtcctgctaagatggtagtggcttgtcccagcatggtagcagtatagttcataagaaagtggtcagattatggatataattttgatagcaggggcaaaataatttttgatggattcgttaaggggggtatgaaaaagagaagattacttccaaagtttttatctgagcaaatggttgctcctagggttttatctgaacaacaaagctgcaagcaataaggggttgtgttgtttatagagattttttaaaataataaaactgaataaaagtctttttaaaatgaacatgtactgacagttctaaacaatgttggttttcaaatactcgtttctgaaaaaatcttttgttggtccaagttctcaaaaatcactgtaattacttttaaatctaatagtatatatgtaagctattaacatctttatttctcgttctttaataacattttatgtatgcagaaattagttcagagaactttgagttttacagtcatccccaagctccacctttccaccccccaaccccaatagccacaaacttagctatatttagcctcactcaagagtaaatttatatggttttggaatttttcaagctcctttctaacaaaatttctatttttaactcccctatggtactacatattgctgagttagtacatttgaagtaaacagtgttagctcagtgattataaagatgaagaaacagctggacacggtggttcacacctgtaatcccaacaccctcgaggcaggtggatcatgaggtccagagttcgagaccagcctggccaacatagtgaaacctcgtttctactaaaaatacaaaaattagccgggtgtggtggcacgcgcctgtagtcccagctactcaggaggctgaggcaggagaatcgcttgaacctgggaagcagaggttgcagtgagctgagaccatgccattgcactccagcctgtgtgacagagcaagactctgtctcaccaaaaaaaaaaaaaaaaaaagatgaagaaacagaacttaggttctgagaagttttatttgtgtttaaagttttcaattgtggggacatttgaaagttcctagaatcaggcctaagcgggcagatcacctgaggtcgggagttcaagaccagcctgaccagcatggaaaaaccctgtctctattaaaaaaatacaaaattagcagggcatggtggtgtatgcctgtaatcccagctactcacggggctgaggcaggagaattgcttgaacccaggaggcagaggttgcggtgagccaagattgtgccattgcactccagcctggacaacaagagcgaaactgtgtctcaaaaaaaaaaaaaaaaaaaaaaaagttgctagaatcaattttaatgaaacaaagattgcaacagtattgcactttctagaattaattgtgaaataaaattttttatattctgccaaactcatccttatcactaagatatttcctagttatttgaatatctgtttcttcagataagaaacttttgtaattaaaattaacaaaaagtattctccaggtgactatgagcagagataaattgatgaatctaactataacatctattgaacataactatgtaaaaacaaccaattttaatgcactcattgacaaatctgcagaagtcaaagctcaaaacaaattataatgtgatagtccattttgtgcttataaattgtgccatttttaaaaaattaatagatattttagtttgttacttctttctttcatgatataaagattattttacatttaaatttttttattggaataattatgtgtacaaagtgctataaaaggaaagcctcactgtgtgctttttctggattgttatttttttctttattttttatttttattatactttaagttttacggtatatgtgtacaacgtgcaggtttgttacatatgtatacatgtgccatgttggtgtgctgcacccattaactcgtcatttaacattaggtatatcttctaatgctatccctcccccaaccccccgaccccacaacaggccccggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctataaaggacacgaactcatcactttttatggctgcatagtattccatggtgtatatgtgccacattttcttaatccagtctatcattgttggacatttggcttagttccaagtctttgctattgtgaatagtgccgcagtaaacatacatgagcatgtgtctttatagcagcatgatttataattctttgggtatatacccagtaatgggatggctgggtcaaatggtatttctagttctagatccctgaggaatcgccataccgacttccacaatggttgaactggtttacagtcccaccaacagtgtaaaagtgttcctatttctccatatcctctccagcacctgttgtttcctgactttttaatgattgccattctaactggtgtgagatggtatctcattgtggttttgatttgcatttctctgatggccagtgatgattagaattttttcatgtgtctgttggctgcataaatctcttcttttgagaagtgtgtgttcatatccttcacccactttttgatggggttttttgtttttttcttgtaaatttgtttgagttcattgtagattctggatattagccctttgtcagatgagtaggttgcaaaaattttctcccattctgtaggttgcctgttcactctgatggtggtttcttttgctgtgcagaaactctttagtttaattagatcccatttgtcaattttggcttttgttgccattttttttggtgttttaaacatgaagtccttgcccatgcctatgtcctgaatggtattgcctaggttttcttctagggtttttatggttttagatctaacatataagtctttaatccattttgaattactttttgtataaggtgtaaggaagggctccagtttcagctttctacatatggttagccagttttcccagcaccatttattaaatagggaatcctttccccattgcttgtttttctcaggtttgtcaaagatcagatagttgtagatatgtggcattatttctgagggctctgttctgttccattggtctatatgtctgttttggtaccagtaccatgctgttttggttactgtagccttgtaatatagtttgaagtcaggcagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcactgagcagtggtttgtagttctccttgaagaagtccttcacatcccttgtaagttggattcctaggtattttattctctttgaagcaattatgaatgggagttcactcatgatttggctctctgtttgtctgtgactggtgtataagaatgcttgtgatttttgtacactgattttttatcctgagagtttgctgaagttgcttatcagcttaaggagattttgggccgagatgatggggttttctagatatacaatcatgtcatctgcaaacagggacaatttgacttcctcttttcctaattgaatgccttttatttccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcccatcaatacctaatttattgagagtttttaagcatgaagcattgtcgaattttgtcaaaagccttttctgcatctattgagataatcatgtttttttgtcgttggttctgttaatatgctggattatgattattgatttgtgtatgttgaaccagccttgcatcccagggatgaagtccacttgatcatggtggataaactttttgatgtgctgctggatttggtttgccagtattttattgaggatttttgcatcaatgttctcaaggatattggtctaaaattctcttttttggttgtgtctctgcccggctttggtaccaggatgatgctggcctcatacaatgcattagggaggattccctctttttctattgattggaatagtttcagaaggaatggtaccagctcctccttgtacctctggtaaaattcggctgtgaaaccatctggtcctggactttttttgattggtaaactcttaattattgtctctatttctgagcctgttattggtctattcagagattcaacttcttcctggtttagtcttgggagggtgtgtgtgtcgaggaatttatccatttcttctagattttctagtttatttgtgtagaggtgtttatagtattctctgatggtagtttgtatttctgtgggatcggtggtgatatcccctttgtcattttttattgcgtctatttgattcttctctcttttcttctttattagtcttgctagcagtctatcaattttgttgatcttttcaaaaaaccagctcctggattcattgatttttttaagggttttttgtgtctctatttccgtcagttctgctctgacttagttatgtcttgccttctgctagcttttgaatgtgtttgctcttgcttctctagttcttttaattctgttgttagggtgtcaattttagatctttcctcctttctcttgtgggcacttagtgctataaagttccctctacacactgctttgaatgtgtcccagagattctggtatgttgtgtctttgttctcgttggtttcaaagaacatctttatttctgccttcatttcattgtgtacccagtagttcaggagcaggttgttcagtttccatgtagttgagtggttttgagtgagtttcttaatcctgagttctagtttgactgcactgtggtctgagagacagtttgttataatttttgttcttttacatttgctgaggagtgttttacttccaactatgtggtcagttttggaataggtgtggtgtggtgctgaaaagaatgtatattctggtgatttggggtggagagttctgtagatgtgtattaggtccgcttggtgcagagctgagttcaattcctggatatccttgttaactttctgtctcgttgatctgtctaatgttgacagtggggtgttaaagtctcccattattattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctctcttgatctttgttggtttaaagtctgttttatcagagactaggattgcaacccctgcctttttttgttttccgtttgcttggtagatcttcctccatccctttattttgagcctatgtgtgtctgtgcacatgagatgggtttcctgaatacagcacactgatgggtcttgactctttatccagtttgccagtgtgtgtcttttaattggagcatttagcccatttacatttaaggttaatattgttatgtgtgaatttgatcctgtcattatgatgttagctggttattttgctcgttagttgatgcagtttcttcctagccttgatagtctttacaaattggcatgtttttgcagtggctggcaccggttgttcctttccatgtttagtgcttccttcaggagcttttgtagggcaggcctggtggtgacaaaatctctcagcatttgcttgtctataaaggattttatttctccttcacttatgaagcttagtttggctggatattaaattctgggttgaaaattcttttctttaagaatgttgaatattggcccccactgtcttctggcttgtagagtttctgccaagagatcagctgttagttagtctgatgggcttccctttttgggtaacctgacctttctctctggctgcccttaacactttttccttcatttcaactttggtgaatctgacagttatgtgtcttggagttgctcttctcgaggagtatcttagtggcgttctctgtatttcctgaatttgaatgttggcctgccttgctagattggggaagttctcctggataatatcctgcagagtgttttccagcttggttccattctccccgtcactttcaggtacaccaattagatgtacatttggtcttttcacatagtcacatatttcttggaggctttgtttgtttctttttattcttttttctctaaacttctcttcacgcttcatttcattcatttcatcttccaccgctgataccctttcttccagttgatcgcatcagttactgaggcttgtgcattcatcacgtagttcttttgccttggttttcagctccattagttcctttaaggacttctctgcattggttattctagttgtccattcgtctaatttttttttcaaagtttttaacttctttgcaattggtttgaacttcctcctttagctcggagtagtttgatcttctgaagccttcctctctcaactcgtcaaagtcatgctccatccagctttgttccgttgctggtgaggagctgcattcctttggaggaggagaggcgctctgatttttagagtttccagtttttctgctctgtgttttccccatctttgtggttttatctaccttgggtctttgatgatggtggcgtccagatgggtttttggtgtggatggcctttctgttttttagttttccttctaacagtcaggaccctcagctgcaggtctgttggagtttactggaggtccactccagacccggtttgcctgggtatcagcaggggaggctgcagaacagtggatattggtgaaccgcaaatgctgctgcctgatcattcctctggaagttttgtctcagaggagtacccagccgtgtgaggtgtcagtctgcccctactggggggtacctcctagttaggctactctggggtcagggaccctcttgaggaggcagtctgtcggtgttcagatctccagctgcgtgctggaagaaccactactctcttcaaagctgtcagacagggacatttaagactgcagaggttattgctcttttgtttgtctgtgccctgcccccagaggtagagcctacagaggcagtctggcctccttgagctgtggtgggctccacgcagttcgagcttcctggctgctttgtttacctactcaagcctgagcaatggcaggtgcccctcccccagcctcgctgccgccttgcagtttgatctcagactgctgtgctagcaatgagctaggctctgtgggcgtaggaccctccgagccaggtgcgggatataatctcctggtgtgccgtttgttaagcctgttggaagagcgcagtattagggtgggagtgacccaattttccaggtgccgtctgtcacccctttctttgactaggaaagggaattccctgaccccttgcgcttcccgggtgaggcgatgccttgccctgcttcggctcaagcacggtgtactgcacccactgtcctgcacccactgtccggcacttccctgtgagatgaacccggtagctcagttggaaatgcagaaatcacctgtcttctgcattgctcacgctgggagctgtagactggagctgttcctattcggccatcttggctccccagctttgaatggtgtgtctggattgttatttttaatttcatggttattacagaaaataatttagttgtgtagaggcacagatatggtaaaaaaaaaaaatctgttctggctgtctaatatgctatgtatgcagctgcctaatagagtccactctggggatggacttctgtgttgtaggtagcttctgtgttgaccaaattatcttaatttagtcataaaaaattctacatcctatttggttacattattttaagtaggctatagagccttagggagatttaaaaaagatatccacaaacttaagtagtggtcaagataggtcctatatagaaggttaaaagaagtgcgattattgaagctagaatcaaatggctatactttgggagagcagagtgaacatgggtagcaaatcaaattttagtttatgagggatttttgaagggaataatgtttttggaaggaaaattaccaataagatggcaaaatgtggactagatgaccagccagcgttggctgattattctgaaatatttcaaggtgagagaagatgctgattgattctatgtaggtttgttttttatttgaccgagagcaaggtgctatttcaggtaatttttaatgcagattgctgttcctggattctgcttgtctcagtgtaactttttttactctgcccagcttctaaatcttagctttttgttctactatttacctctgtatttctaaataacatcatcatactgcagttccttggtttccaattttatagctgtctcttgacttcctagtatgagaaatgaagatttagccatctaaaacctcttctctacccttatttcacttgccctattatctcttaatgcaattatattacgttttgaaaattgagtcatcttccctatattcatggtgaatatgaaaatcttattttcagctgagccacatattttaaacttattgtgtttcttagatttcccataatgattgccatgtttttggtgtctcttcacatttttcctttggctttaatcagcaccttgttcacctcatcaaaccctaaaatctaccctatctagggctacggaatatgaaaagaaaatagaatctcaccatttgttgcctcttgctttgtttcagcctccttacccaatgtaggtgttacttcctggcagttttattaatagcttagtctctcctgtccttgtgtttgaaggcatgcagtgtagctgctttgctaatttgtgatgggtttagcatcagattttttggaattggtacttttaaaatgttttaaaaatatcctgccaaagaatggttagctgtctttagatttaagtgaaattcagtcaactttcatatctcatgccttgaattttacctcaaacttaactaaaaagaaagtaaaggagtcagaagcaatagtattcttactgtcctgtttactgcattcatcggttcccagctctgcataccagagcgggagaggagttgcaagacacatttggacagctctcatctccctacaactgagtcaacagcaggagggtatttcttggagcgctgtggtaacttttccatgaagcaggtcttcttccttaggaaggcttagttgttgcctttatcccctcatttgttacagttaacatctatagcctgatgttggctctatcacttccatctgttttatgagcttgctactgttgttgctttgaaaggtggttttgtttatttgttacaaataatttatccattatcatcttaaccctcaactttaacatttaaaaatgacatattgaagagctgtattatcagtgttttttagactgtaggttatatacatttttaaaaatagaataaaataaaaagtaaactcaccaagggcattatataaatgtaagcattgggccaggtgctatggctcacgcctgcaatcccagcactttgggaggccaaggcacaaggatcgcttgagcccaggagtttaagaccagtctgggcaacataacaagatctcgtctttacaaaaaatgtaaaaattagccagggatggtggcatgcatctgtgttcccagctacccaggaggctgaggtgggaggatcacttgagcctaggaattcgaggctgcagtgagccaagatcacaccactgcactccagcctgggtaacagagtgagaccctgcctctaaaaatttaaaaaaggccaggtgcagtggcttatgcctgtaatcctagcactttgggaggcggaggcaggcgaactgcctgaactcaggagttccagatcagactgggcaacgtggtgaaactgtgtctttactaaaatataaaaaaattagccaggtgcggttgtgcatgccagtagtcccaactagtcaggaggctgaggcacgagaattgcttggacctgggaggcgggggttgcagtgagctgaaatcctgccactgcattccagcctgtgtgacagagcaagactctgtctccaaaaaatttaaaaaaattaaaaaacaaaaataaaaacaaaaaataacctgtaagcattggcttttaaaacttttgtaaaacccacttgtagtgggtttttatgtaaagtatactgttaattatggtaagaaaagtttgagaaatgctgccctaaacacatagaagaagtcaccgctcaaattgtttctaaagtttagggaacatacttttaaggtctaagggaaattatgtatgagcagaggttggcgtagcctcaggcaaatggagaggtcctctaacttctttcttagggtaggtacagtattgtaatgcttcatggaattttcagtttctaaccctcattttaccaggaaaaatagtcattcctatttattatctaggtccaatgaacccctttattaaataattttacattgtttttatgaataagcagtgtataaaacaattttattagaaaatttaacagatttaaatatagcgcaatcaaatttttattccatatattcttggtttagatggtgtctgtactcaaaattggcagtgcccttcgaatgcaactaaccactcatcagtggtcacacatgaacatgggacatatgcaacttgtatgtgttgaatccatatttcaaatacatctctaatagatttgagttttgtgttttttttgtttcttttttgtttttttttttatggagtctcacttttttgcccaggctggagtggagtggcgtgatctcggctcactgcaacctccacctcccgggttcaagtgattcttctgcctcagccttccaagtagctgggattacaggtgtgtgccaccacacccggctaactttttgtatttttaatagagacggacggagtttcaccatgttggccaggctggtcttgaactcctgacctcaagtaatctacccgctttggcctcccaaagtgctgggattataggcgtgagacaccgtgtctggctgagcttgttacttcttctggttccacttgcatttgtatcatcaaaattcaatttggattcaggctttcaaatacatcagcaggtttaagcttatcattatctcttactctttttgtctttgcttgatcaaaatttaaaacctttgaaaactttgatggcttgtaatttggttgaaaagaggaccaccatcttttttattccataattgcaaaagattctcacttttagatttgtgaacaccagttagaaggatcaatccaattaattgttctttttttttttttttttttttttttttttgagatggagtctcggtctgtcgcccaggctggagtgcagtggtgcgatcttggctcactgcaagctctgcctcccgggttcacgccattctcctgcctcagcctcctgagtagctgggactacaggcgcccgcaaccataccgggctaattttttgtatttttagtagagacggggtttcaccgttttagccaggttggtctcgatctcctgacctcgtgatccacccacctcggcctcccaaagtggtgggattagagtcatgagccacagtgcccggccaattgttcatttttacatgattttctcccttccaaatacctttatgtggacacttgccaatatcatttatacacttaaaaaatgtatcaactaaattatggtgcacaaacatcataaaagatgaaaggatgttgacacacgtacttttagcaaaatggatggtcaaggttcttgttccaaattattgtggaatgaaatctatcttgtttaatgactatccagatgagaatatatatatatatatatatatttttgtccttaaaaatacatacttgagtgactgcaaatgggcatgagggatctgctttgaagtgatgaaaatgttctgaaattgggttgtggtgatgattgcttaatgatgtaaatttactaaaaatcattgaattgtgcacaatatattggtaactcatagatttttgagtttgggaagttttttgttttgttgtttagttacatgttaggtgaaactaaccaagtgaaggggcaagagaaggcagagagatggtgctatacacagctgatatagggttggaggctgaatgctacacaccgagagagacagacacacagacagtctgctcagcatgtcagccaggcagcattctgggacttggacagttggttggtgtgccagagccggcaagaggtctggctcagagctggagaggaccaggaaccctggaggctccctggtccaacgtcctggttggcatctgcagcagcacctgggctcagctcagatcactcagggtcttgtgggcaaatttgggtggcagaaaggctgcctcgtgcacatctgatttatagtatttcagttatgtatgttccaccagcttctgtgtcagctgtcgcacggactcccagaacttggtgcttgggttttgctgcacatcatgaagctaatctggccactgcggtaggtggggatggtgcagtaggtgcagcccaccatgggaaagagtggcatgcagaattgctgcgtctttttggtgaggtccaggtacagccactggcagtcacctgggcagcagagaatgccatgcttctttagggctgccctcctgaggactgtcttcatgaactggtagtaggattccttgaagaggtttttagcaaggcagtggggtctgaggagtcattgataacactgaaggcatcctaattctgtttcatgaattcaaacccatcacccatgtgtaagttcagctttgagcaaaagtagccaacagctttgcctggcaggaacttctgagagacttggatgacatccttatcattctcacattggaccatagacttcacagaggggtactacctcaccttgcacaggatgcccttgttcctgtcctcaataatcaccgccatttgtaggttggggtggctgcagagaggcaggttgactataatctcctggtaggagaacttgttcctctctgtatactggatgatgccatccaacgccatcatgttgccataggtcttactgcagatgacaaaggtatcctagtactgtgagcactggtcgggggcagctgctccacctgcagtgacaaggcatgggtgggccacagactgcatgtcttgcagaatcagtcctataaatggcagtggggccagaggctgggggcggccattggggctgggcttcatggcaggtgatccacagcactgtgggaccagcagagcccaagcccaccaatagagtttggggagattaaaaaaaaaactttgaaaagattaatctaggctatcattatctgagattttacttacatgattatttttatcatcacaattagtgtctagagggctactttctgcatctttacactcttatgatccaccttatattcacctaataataatgaaatgtctttgtcttttttttcctttccattatggattgaaaacagaaaaatcttgattttttttgggacagtctcgctccgtcgcccaggctggagtgcagtggcgcgatttcgtctcactgcaacctctgcctcctgggtgcaagcaattctcctgcctcagcctcctgagtagctgggattacaggtgcccacctgtaatcattacaggcccaccactgtgcccagttaatttttttgtatttttagtagagacagggtttcaccatgttggccaggttggtctcgaactcctgacctcaagtgatccacctgcctcagcctcccaaagtgctggaattacaggcattgagccacgacgcctggccttatattctcttaagaactactttcaagtagagatgactttattttcattaagtttgtagaaattgtatttctatttagagagactaatttttgtttttaaaaggaaaaacaatcaggagattgagttgttaggaaattattagacatgtatagcttggtgactctttcaacctttcaaatgtaaaacatgttggcttttgggttaaagtactctggtaatttatcgttatcatgttctatgattgtaacctaagtctctcttcttcttctgtctccttattaactgagatataattcatgcttttaatttctctaagtccttctaccatgaattttctagctaaattaaacgtaggaaacaatacaataaggaaaacataaacctaagaaatattagatgttacataaactgttggagattgtcattcactcctattttcagaaatagagattatgataatttaaatttgaaggagaattcatacaatataatgtattaagacatgttagcgttttctcttgaggtctctcccagttatcttggagtcacatgtatctgttaaaataaataaattcattgggtattccccattgtaaaagtaatatatgttcattatagaaaaattttgaaaatataagcaaacagaagaaaaattaccatgtttctactgttgagttattgatttttataatatagaaaatcataagccataagtggtctctgttcttaggaaatataaacccatcacccctatgctttttttcttggcactttattaaatgtcacctctcttcctcctgctttggagtggcactgtcttaagttaggaagccactgttactactccccaaacagttcagcagatgaaaactagatagttggttctgttggtacaaaataaaaatatatttaaactttgtttctaataatattaaattattttaacacgatcagaatgcccaaagtagtcattattctgacgtgaaggtaatgttgccatggttttttgtttctctttataactggttttaaatgtaaaaacataaatcctaaagaacaggaatggaaaatggggatggttttcatttgctacaatttcctgtgagacatggctctaaacaagacccatatttacacaactcaatatagttttacatacagtgttgtattcagcacattttaaaattctttaatttcacttttcagtcattggtttaatactttcatagtaaatttgtttaataacactaggtgaagtttgaaataatttttgaataattttacagtagaaacaccagttaaatcacccttttggtaataaatgtcggaaaaaaagtaattatttttgctgccactgcaaaatcaattgtgtaactgttctttttaaactgacttttacattactaaattttaaacactcctgtaacttgtcagaagcaggttttggttaatagatattttcagtgatgtaatgggaacttttggcagtgagtcagaatataatggactatgattaatgttttaataagtagttttctattgctcatgatgtaaaggagaaatggtttcctgcttggatggataggagaatagcaggtgtgcatatagtgtttttaaaaaagaattgggatacttttcttagagtaacattaacatttttattcggttaaaatttattatagagatgcatatgttaccacagaaatctgaaattgatttggaacaataaaattaggagatgattaccaatgttgtagttaaatcttttattttttggccttttgttttctttgaagctttaacttgaggtctctgtagattgatcttggttcttactataagctgtaaggaaatcagggatctctacagggtttgatgtttctgaaataaatttcttaaaacttctaggggagggagaggggacaaaaagaaaaaaaaaactttcaagtttttctcttaaggctaggaaatacagattgttagtcaaatggaatagtgatcaagtaagatttctccattgccaaggccacaagttcaacgtataaactcagtagttcagaaatttggaaagttaaacccaggagattttgtgtcagtcttggaatctgagaaagtttataaagacaaactggaagaaatattagtataccagacttgaaggtttgattcacagtttgctttcatttttttgtgatttaattttggcaacttatatgcagtaagtatctgttattttgttgtaggtgaagagtcctagggctcagtagatacattctacttgggaatggtactttactaccatagatactttctttcccatatttgtgaataaaattgagcatttgttcaaatgtacactttcctggaataaagtttatggtttttattcctgtctcaaagggatcctgattcccaatagaggacctagagtagtggtctcaaaccatatatcagaatcacctagagggttttctaaaacaaagattgctgggccccaccttcagagtttgtgattcagtagggctagagtgagaccccagaatttcatttccaacaagttcctaagtaatgctgatgctgatggttaaggactatactttgagaaccactagcttaatcttcgttaatagccttctagaccttttttgttatattgcatatttttgttattatacatatttaacaaaaatgcttctgttacatttgctacctgtcttaacctactatatcttatctttacattttatactttacattaatactttaaatgatacatgtttatccattgcatcatttacagtatttcataacataatttatttaaccagtcttcaattagacatttaggtcagttttcatttgttgtttttataaatagaatcttgctaaatttttatgtgatcttctaattatttcattagcaaaaaatccctggattaacggatggacatggcatggcacggtggctcacgcctgtaatcccagtactttgagaggctgaggcaggcggattacttgaggccaggagtttgagaccagcttgggcaatatggtggaaccttgtttccacaaaaaataaaaaaaattagccaggtgtggtggtgtgcatctgtaatcccagctactctgcaggctgagaacccaggactgcactccaacctggatgacagagcgagactgtcttaaaacaaaacaaaacaagataaaaacagtagatatatttataaggcccatttgaggtgtaagtgacttaacatccctggcacttgaacactaatgaatattatgactgccactttaaaggaggcagaagaagtttaaaaagtaaaacaaaaagtttgtttcagaaaacaagcattttacctctgtttcaaatagtctaatttttttagtgatgaaaacttctgagaccagtagatgtttgtaaataaaaaacatttatggcagtctttgtaactgtaatgaaactggtagagagtaataatagcctgttttttgtttgtttgtttgctttgggggatatttgcaatacagtttattgatatgtcacatacatgtaaagtttataattcaccccagaatttatattactaagtttgtgctagtattaaagagcttttcaaattcagtgcctgtttaaaaaaaaaaaaaaaaaactgtactccatgccttgaaaatagcaaaactgtgatatagattaaggtggggaagcatttttttttctatttagagctataataagaaaaaataaattgagacagtggtttttaatttgaaaaagagaaatgaaatatttattcatctacttttaaaatgaagaaacaataatatgtatgtgaaatctttcttctgtactgtaaaactagctacacaaataacatcaccctcccttgactctcaaaataaaatactaaacccatacagagaaaactactctgaaagacagctccacagatgaggtcactgaaaggtgtccaacattggggatgttgggtaaagcaaggcagggaatgggtgagtgagggcaaaagctgacaacttggaaacatattaaaagtaggtactagatcaaattcagtctgtcctgttgcattgcctatttctagaacgcatatttataacatgaattagctcacacatgaatggtaaatagtggaatgatatctgtataatgtagattccatattgtagaagctattttgtttgcacatgatttttcccagtaagtaaatgtgttacattgttaattaataatagcagctgaactcagatacagttggctgtccattcatgggtccacatccatagattcaactaacggcaaattgaaagtatttggggagaaaaacaatagttgggcctacattgaatgtgtacagacttttttcttgtcattattccctaaacaatacacgacaacacctatttacatagcatttataatacgttgtattaggtattataactaaccaagtatatgctccctggtgtccaggggggtgaaaaataaattaaataaataaagtatatgagaagatatgcacaggttatatggaaatacagtgccattttatataagggacttaagcatctgcagattttggtatcctgggggtggggttctggaagcaatcccccacagatgctaagggatgactgtatatggaaacaaaaacacaatgggatgcatgaagccacagaggagtaaagagagtgctgtacaggatgtctagttataccatgttcttccttttggcttagttttgccatgcatcctgtcttggaagtgctacttgtggaattcttcccaagttttgctcattttgcttgtttttataacttagcaaccttatcccttccttacacttccttccatcaggttacattcacttttttcttacgtttcttataaaacctatatttactgtatcatctgtttatttggaacttaaccaagctttaaaaaatcaactgtgttaatactttttggaggaataattaatgtttttgttgggtccctggttatgttatctttcatgtctggcttctttcatgtttttgagatttatattgtagattttgtgtggactgtccccgatttcacttctaacttttaagttcacatttggcagaatataagatctttcaagaaaaattatgttatcacagaaatgccagagtaatgttatagaactctggatcatagagtaggtcagtcagaagcactttagcacatagaattgctcagtgtaagaggagatcttttgatggaaattcagtcatgattgtggactttcatcacaatactgttcatttggccctactctctggttagaaatccctagtagttaaaaggtcttctccagttatgaggtaaactcattacctcagaaatcacccttattctacccacaaagagttgttgaaagagatatgaaaaaaacaaaatgcgcttcctactctcacacaccacagtcaatacttctgacgacaggtgttgtggggttttccccccacacaccaaccaaagcagttctccagtccagtagacaccaactgggcgtcctctaattcagttctgttctgacactgtctatctgaagatagtatcatataccacaggttaagggctcagtcccataagactgccctccacttcagatgccagtcaccagtagtaggttcttacctatacttccgaccaaaccagatataaattgggggttcccacaaaccattcgtcagttttgattaatttgctagggcggctcacagaactcaaggaaacactttacttatgtttatccaactattataagggatattacagaggatatacgtgaacagccagatggaagaggtgcatagttggggagcacagagcttccatgccctctgacatgccacgcacccgccacggatctccacaagttcagctgtgcagaagctcatcccaactctgtcattttggatttttatgaaggcttaattatgtaggctctgttgattatatcattggccattggtgattaactcaaccttcagcctcctcccttccctagaggtcagagggtgaggctagaagttccagcctgctaactgcatggttggttccccttgtgaaccaaccccatcctgaggccattcaggaacccataagatttgcttccttcaaacaaaagatgctcctattacccaggaaattctaaggcatttaggagctctgtgtcaagaaatggagtcaaagaccaaatattagaacaaaagattctccttgccaccctatctataagtttattagccctgtgccagggactgtgggcaaagaccaatatgtatggttcttattatttcaaagttaatttacatgttcaaaaggaaaactatatcttctgacttgatgtgggccttcttgagatacatctcctttatcagaggtcatcctttgggacctattgcttatttggccctgtaaaaggcactcagcctgggatactgtttgaggtttagactcaagacaaagggtagacatgcagagtctatgatgctctacccaatttcgttaattttagtgtgctactaccaaagacttaaagctacttttaaaaactttattgaagtaaaatttacataccacaaaggtaacgcattttaaatatatgattcagtgatttttggtaaatttaccaagttgtacaaccatcactacaatcagggccaacttcatgtatgtgtaaccagtacagtctcacagggccccatgcccagaaaggagccctgaattcacaagggtgccctgtacttggagtttaatactctgtggttgtcatcttgaattcttaataattttatgtttagatttatcgttttgtaagtaaagtctgatgggacaattgaacatgctctaggggctttgaaccacgtattcttcccaccttgagacatgttttcgaccaccttctttctgtttctgctcattgttgctgcctctacccacggtgaggctgtggacacagggaaggtcaggactggatgtatgtgccttgtgtgcctctgagggtctgcatttacccaatgagtatctcatgactgagggatacagcattaaatagcaaataaagtaccataacaggtcaagagagagaccctagaagaaaggaaaaaaatgttttcctgctttttaaacaaagtgcctgcattttattttgtaccaaacctgactacagtccagttttagaaccttcgacaaccccaaaagatccatcatgttagtttatagttagccccctttcccatcaccagacttgggcaaccacttagctcttttttgtctccacagacttgcctattctagacatgtgatacaaatggaatcataagtatgtggtttttgtgtctggtttctttcatgtttctgaggttcatattgtagtatatatatccatgtttcatttctttttattgctgaataatactccattgaatggatatactacacgttatctatttgcttatccattcatcagttgatggactttttgattattgccactttttggacaccattaataatgctgctataaatattcatactgtttgcatgtatgttttcatatatcttggatatatacttaggaatgaatgctggatcatgtaacaaatttgtatttaacttttcagaaactgccaaactgttttataaagtggctgtacattttacattcctactggcatgagggtttccattttccacatcctcagcaatgtttattattgtcattttgattataaccattgttgcgagtaaaaattggtatctcattaatttgtctttccctcatggttaatgatattgagcttctttttatgtgtttattacccatccatatatcttctttggtatgatgtctgttcagatcttttactcattttaaagttgggtcatttgttttattataaagttacaaaaagttattttttgattatgtgattttttaaataaaaaaattaatagttaaaaaaagaatgtcattttacaaagcacttgccatatatatatatcttataattctttatatattctggatatcagcattttattaaatataatctgtggctgggcacagtggctcatgcctgtaatcccagcattttgggaggcctaggtgggcagattacagattacgaggtcaggagatcaagaccatcctggctaacacggtgaaagctcgtctctactaaaaatacaaaaaattagccagtgtggtcgcatgtgcctgtagtcccagctactcagaaggctgaggcaggagaatcacttgaacctgggaggcagaggttgcagtgaggcgagatcatgccactgcactccagcctgggtgacagagtgagactccatctcccaaaaaaaaaaaaaaaaaaaaaaatatatatatatatatatatatatgtatatttatattttgtaaatatgttttcctagagtgtggtttgttattttattttttaatgatgtttcttgaagtataacacattgaattttgatgaaattcagcttaccaattttttcttttatggatcatgcttttggtgttgtatctaagacacttttgcctaaccaaaggccaagaagatttcctcttatgttttcctgtaaaagttttgtaatattacctcttacatttgggcctcagatccatgttaaattaatttttgtatgtggtgtgggctaaaggtccaagttcatcatttttgcacagagatacccaatggtcccagtaccatttgttgaaaagaatattctttcctcactgaactccctttaaaaccatgtgttttgcctattatccccagtaattcctagtataagcaaagctttttgattatcgagtcctgaacgttttcttgacctggggaatattgccttttcttttcctgaattacacatttagctgtgagcctatctgtaataataatagtgagcattagacagaagtgtttgttaactctgaggaatttctaattttaaataagaaaattatgaggaaacattttatatctttcctgtcaatttataattaaattttgaaataagtatttattattactgttttacatctagaagggtctctgattcccaagccatgaaacattctgacaggaaccaccctctttcaacctaaaacaaacaaacacctaaccttctaatgccaaaaggtcttaattttatttcactctttaaactcaaattgtttgcattcagaggtcagaaaaatataacatgctttggtaaagtaaaactggcttccttaattacttttccaggtcaaaaagtagaggtcattgaggcagtgtttagttttagttgtgttacaaacactatcatcagtcaattccagagtatttgcttaagaggatatcctccttcgagatctttattactaaagattcttcttccgtctttattattattattattattattattattattattattattattatttgagtctatttccttctctagataagcttttctaagtctgggaacatctcttgttcatttttgtttctccatctcactatactctaccctgtcccctcatacctcatcccacaatgccttgatggcacagatgttctgaaatgacttcttaaactgaagagaatttaagagatataatggagagaagtatgatattgccaagtgccaagattctccttccttctgaagtatattaaatgtaattgtgctgggtggaagaattatgaagaccaattagccataattcctctttcaaaagctgacagtctggaaaagggagattgtcatataaacaagacataagaagagagggtcaaggaacatttcatagagatatggacattcaacttcattttaaaggataagtaagagtctcctagtagcatgaacagaacattccgtcagaacagaaggattcagagatttgacagaacagggtgccttgagggaaatgtaagtagttcagtctgactggagcacagggtttgtaacataaagtgacaagaaactagttaggatcaaatcatgaagaatcttatttatcatattaagtattttgagtaatactcctttccccctttttgttcctgtgtgtcttaaatcaaggttgaaaaccactgctatctcagtaactaggctctgaaccatacactcttagtaataggtagctatggaagacgtttaaataattgagatattcagatttatattttagaaaaaatacttctgaaggcagcagtatggatcatgtatttgagaagcctgaagtaaaataaagtgccaaaataagagagttgtaagcagtgaggatggagttgagggaatggatttgagactgaagggatagaattgaaaggacttggccactgacttcaggtgcagggtaaggaatgagtctaggaaaattccaaggtttttggcttgagtgtctggatggctctgtgatgactttcatagggttcaggcttccttcagagttttgcacagcctatagaatatgccacttagacacaagtctttgtgtgagagctgcagcagggatctgaatgattaaggcagctgctcaggcttgctttctcactactcacttttgttgcctgtgtcagggaaaggccagggagagaaataattggggacagggactgcatttattctgctgccagagagtatgtgcagctgccgcttccttctgattcaccactaccacttgccacagcagctgggctggaccaaaataggtagactgtaaaagattctgtgataacaaagcccattgcagcactgggtgtaacttgaaatgttttttattcatatttctctaacttttttcttatttcaaaaatatgtctgtagatacatatcgtagacctgaattgtatatttaatatgtaagacccttaatatttttgatttagtcagtgtgggagaatagtactacttactttaatgcatatatatatatgtgtgtatatatatggtgtgtgtgtatatatctataacctttgacactctgaaaagagctgcttaattgtcaaggtagaagattttaaaaacatcctcaaagtttttttttaaaaaaacaatggtgaattagttatatactcccttagatactgagcctactttttaaattttttaattcagtcattttgagaattaagtgtgttatttgtccattgaattaagtttgtgtgtaaatatttgccatttctagaatattcatacttcttactcttactaattttttctgataaaaacttcatattataaggatgttagttttaatcaattttatattatcaagttttctagtatatgtctttaatttttgcttgtacaaacctatatattaggttacattagagttctgttatcttttttcttatgtaagtttagtctaaaataagactgacatactagtttttaattcgctcatatttcttaaatttttgtttcatttgtagtataaaatcacttttttagagaataatatttagtttttcttctatccttgtaaaactacagcagccttaaattatgctataggtgttcattgttggttcatcataaaataattaacacttgcattccagaactgtaattccacttagtacagcatttcatttcatttttttaaaagaggtttccatttttagaaaatttggaggttttttccctcctttaaagacatggttaaataatgattaatatagttcaagaaactatcttacgtggagtgtgcaggtatttcagctctgtttttttcttttctttattctttaaatgttagatagattttagtttaccactttagaaaactatttttaactgtttttatatatttatatatctcatactgaatgccaggtaagaattttattctgcactactgacattaattcccaatagttaaacataatagatgaccatacagttgttatctatttcttatcctgtgctctaggatttatcatttttaaagctatgtgttagagatcatacttatttctgaatagctaaatatcagtgtttttgcatcataatttggtgtatactgtgttacattttcagaaaatttgatttgataaatataaccataatcttaaaaacaaaactttgaagatatatgaatcactttgtaaataataataatatgcagtacagtgtaggagttgagagaatttttggaattatattgcctgagttcaaatcttggctgttttgcttggtttataaccctaggcaggtaacctacctaacattctgtgtctttgtttcctcctttatgaaatggagatatctaatggggttgttttgagtactaaatgaggtaatatatggaagagcctagaatactgactggtagaatattgaagtataatatagaaagtccggtcccttagaatctatttgtattatactgattttaggtctattgagattttctacctttcctttctctcctttttttcttcttctaatttgatcaattaggcatatcgacacaatgataaattgttgtattgccgttcttccgtataattttggcatttagttcagtgtagcatttatttcctaattattgaaataaaaattcagtttatctttaaggaagactacttggttttctgatgttttgaagcaaacaaagtagcgggtaagatgttttgtcccagtgattttatttgtgctcttaacaccaagggaaagtcacaggttaaattcttaaaaagaatttaaggaaaaatgtaaagaaaataagggagtacatgattgacaaattatcccatttatttatttaataagaattttagtttttaagaaaatgagatgtccttcctttgttatttaagtaaaaagcataatcacatctaaaacatggatctagacaatcccatagctattgacagtctgaagtcctacccataattgtttgttttccttgtttatctccctgctctaattccgtactatggtattcctttgagaggctctgtcccaccctttgttaccttgtatatagaattttttcacttaaatgaattccccagaaaatctacgcacattgtctggaagatttaagggttaccaggagggatcatattacctatgttaacctaaaaaaagacactagagaaaattatctctaaatatgtttagttttcttgggaatgagaaataaggattataaagtggaatggatgaaagggcaagctacaagtgcattcagtgagggaagagtaaagggaagcttttattagccaaaaggtagagatgtacataagctgcttagaaagagagtttattggtttcagaagttcaaagtccaagttgttgacaattcattcgtagagatgctgttactgggcaagtgttcttccaagagcaacttatctgagttactgccgtcctaaagaatatacagtgataaaccttgtcaaaggcaggagatgcatatttcttacagggattttaggacatcactggaaacagacatgtaagcatgagcctcctttccttggtgccttcctggccctattttgtctgggtctgaaaattgatttcatcctggtatctgcacctttacacccaactgtaaactatgaccatgatatggtttggctgtgtccgcacccaaatcttatctcgaatttccatgtgtcgtgggagggacccagtaggaggtaattgaatcaagggggcgggtcttttccatgctgttctcctgagagtgaataagtctcacgagatctgatggttttaaaaaagggagttttcctgcacaagctgtcttctcttgtctgccgccatgtgagacatgtctttcacctcctaccatgattgtgaggcctccccagccatgtagaactataagtgcaattaaacttctttcttttctaaattgcccagtcttgggtgtgtctttatcagcagcaagaaaatggactaatacagaccatatgtcacattgctcatttcatctcttctgtctttttccttcctctctttctggaacataaagaaattacttcccttgcctgtggaaggcaatttctcccacatttaaatgctcttgggaggggcagaatgcctcactttccctagtttatcaagggtttccttctaaacaaagtgtgtaaacaaatatagaggtgctttccctaaattaaggaattctagtgaagtagattttctgtaccttagtacctttgtatttgtggttgtttattattcattttccatttaacatttcacaagtagcctaacttctttaattttagagaggctttaaatgaagaattttaaatgaacctaagagattatctaggtaaatgtgttttccttttccctaagtttttgttgatgctgtcagttagtttcactatatgtagtcaaaaaactcttgaagaggaccatttgtgttacgtagataggggccatatttcaggcaattgtcaccaaccccacctctctccccctctcttttttttctttcttcctccctccctcatctacctacctagcccccatccctccctccctccctccttcctttcttctttctctctttcttagcattatagttgatattgaaatactttatataaagtgcaagaatgtacttagatgtgacattgataaaaagttgcattttgattcttactgttgcttattcattttccattagttgaaggaactagaaattacttccagatgtgttgctttattccttgtcttcaagaagtagtatcttctcttatttttagtattttaaattcatttaacaaatactgtgagtgtgttatgggcacacaatgtgtttggacattgtgaaaaattcaaaaatatattatggcttctgctcacagaatgacaagtgatggagaaatgccaggaataagagtatgatgcagggtaggaggagaaatcagaaagcaatagattctatatacatagatttgggccctcacagatgctgcttttttcaaacatatagttgaagatgcagtattggatttgaaattccctgtagataaggacattgaacatcaagctgttgccgaattttgctccttagttcagctaaaaccgggctcttgtcacgcaaccagggaaatttaggcatgcagacacattgaaaggtgagtagaacaggatattattaggctaaaagggaaaaaaagaaacaaaaaacccagcacagtgagatggactcctgctaacaggcccccaacctcacaggttgaatcccaggccaccacacaggaactgaggaggccaggatcctccttgctactggtggctccaccccgttcccccagtgcgcatgtgggcatgctcagacaaggtcatgggcaggttccctcatctgcacgaaagcatctgatgtaaacacttgtggggctgttcagagattctccggagaccccttttttgtgtgtgtgcattttttttattatactttaagttttagggtacatgtgcacaacgtgcaggtttgttacgtgtgtatacatgtgtcatgttggtgtgctgcactcattaactcatcatttaacattaggtatatctcctaatgctatccctcccccctccccccaccccacaacaggcccccgtgtgtgatgttccccttcctgtgtccgtgtgttctcattgttcatttcccacctatgagaacatgcggtgtttggttttttgtccttgcgatagtttgctgagaatgatggtttccagcttcatccatgtccctacaaaggacatgaactcattatttcttatggctgcatagtattccatggtgtatatgtgccacattttcttaatccagtctatcattgttggacatttgacttggttccaagtctttgctattgtgaatagtgctgcaataaacatacatgtgcatgtgcctttatagcagcatgatttataatcctttgggtatatacccagtaatgggattgctgggtcaaatggtatttctagttctagatccctgaggagttgccacaccgacttccacagtggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgctgagcattttttcatgtgttttttggctgcataaatgtcttcttttgagaagtgtgtgttcatatccttcacccacttgttgatggggttttttgtttttttcttgtaaatttgtttgagttcattgtagattctggatattagccctttgtcagaagagtaggttgcaaaaattttctcccattctgtaggttgcctgttcactctgatggtagtttcttttgctgtgcagaagctctttagtttaattagatcctgtttgtcaattttggcttttgttgccattgcttttggtgttttaaacatgaagtccttgcccatgcctatgtcctgaatggtattgcctagattttcttctatggtttttatggttttaggtctaacatttaagtctttaatccatcttgaattaattttagtataaggtgtaaggaagggatccagtttcagctttctacatatggccagccagttttctcagcaccatttgttattaaatagggaatcctttccccatttcttgtttttgtcaggtttgtcaaagatcagatggttgtagatatgtggcattatttctgagggctctgttctgttccattggtctatatgtctgttttggtaccagtaccatgctgttttggttactgtagccttgtaatatagtttgaagtcaggcagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacatcccttgtaggttggattcctaggtattttattctccttgaagcaattgtgaataggagttcactcatgatttggctgtttgtctgttattggtgtagaagaatggttgtgatttttgcacattgattttgtatcctgagactttgctgaagttgcctatcagcttgaggagattttgggccaaggcgatgggattttctagatatacaatcatgtcatctgcaaacagggacaatttggcttcctcttttcctaattgaataccctttatttctttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcccatcaataactaatttattgagagtttttagcatgaagtgttgttgagttttgtcaaaggccttttctgcctctattgagataatcatgtgttttttgtcgttggttctgttaatatgctggattatgattattgatttgtgtatgttgaaccagccttgcatcccaggaatgaagcccacttgatcatggtggataagtgttttgatatgctgtgctgctggatttggtttgccagtatttttttgagaatttttgtatcaatgttcatcagggatattggtctaaaattctctttttttgttgtgtctctgcccggctttggtatcaggatgatgctggcctcatacaatgagttagggaggattccctctttttctactgattggaatagtttcagaaggaatggtaccagctcctccttgtacctctggtagaattcagctgtgaatccctctggtcctggacttctttttgttggtaagctattaattattgcctcaatttcagagcctgttattggtctattcagagattcaacttcttcctggtttagtgttgggagggtgtatgtgtcaaggaatttatccatttcttctagattttctgatttatttgcatagaggtgtttatagtattctctgatggtagtttgtatttctgtgggatcggtggtgatatcccctttatcattttttattgcatctatttgattcttctctcttttcttctttattagtcttgctagcggtctatcaattttgttgatcttttcaaaaaaccagctcctggattcattgatttgttgaagggttttttgtgtgtctatctccttcagttctgctctgacttagttatttcttgccttctgctagctttgaatgtgtttgtcccttgcttctctagttcttttaattgtgatgttaagatgtgaattttagatctttcctcctttctcttgtgggcatttagtcctataaagttccctctacacactgctttgagtgtgtcccagagattctggtatgttgtctctctgttctcgttggtttcaaagaacatcttaatttctgccttgatttcgttatgtacccagtagtcattcaggagcaggttgttcagtttccatgtagttgagtggttttcagtgagtttcttaatcctgaattctagtttgattgcactgtggtctgagagacagtttgttatcatttctgctcttttacatttactgaggagtgctttacttccaactatgtggtcaattttggaataggtgtggtgtggtgctgaaaagaatgtatattctgttgatttgggttggagagttctgtagatgtctattaggtctgcttggtgcagagctgagttcagttcctggagagccttgttaactttctgtctcgttgatctgtctaacgttgagagtggggtgttaaagtctcccatttttattgtgtgggagtctaagtctctttgtaggtctctaaggacgtgctttatgaatctgggtgctcctgtattgggtgcatatatatttaggatagttagctcttcttgttgaattgatccctttaccattatgtaatggccttctttgtctctcttgatctttgttggtttaaagtctgttttatgagagactaggatcgcaacccctgcctttttttgttttccatttgtttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcagtatgatgttagctggttattttgctcattagttgatgcagtttcttcctagcctcgatggtctttacaatttggcatgtttttgcagtggctctggagacccctttttatctgcctaggcatttggctgtctcaaagctttattttttgttgttgttgttttgagacggattttcgctctgttgcccaggctagagtgcagtggcacgatcttggctcactgcaagctctgcctcccaggttcatggcattcttctgcctcagcctccggagtagctgggactacaggtgcctgtcaccacgcccagctaattttttgtatttttagtagagagggggtttcactgtgttagcctggatggtctcaatcttctgacctcatgatctgcccgccttggtcccccaaagtgctggaattacagccgtgagccactgcacctggccgtctgtctcaaagctttcttacttatttatctgaattcaatggcttaataaacttatgatgagatatctaaaaggatgggtttaaaattcagttcttccttattccttctcacaaatctcttcaacattacagaatcagaagggtcaaaattagaatagcctgagaagctcaatttaaaaaaaaagttagagtgagatttgaactttagtcatatatagtttctattgaaatatttgaaactctagataatgttaactgtatgacgttcccacctagtgttaatatttgaattattctttaaaagtttttgggaaatgcctgtgttaagtattggtaatttaataaaattccgtttattctcatagtatatagaagttttgttatttctagtttttatggtttttagtgattatgtggtatttaaataataaacaatggtgaatttaacagatcaaaaattcatttaattgtattactgttttgttcctcatctggaaatatttctctggctagtccatttttcccttgatctcttagtccctgtgattcaggaaattgtattaatgaatttatggtcaatactactgactaggatgctttcaataacatagtttaaaatgtagtcacacttatagctagaatggtgaaacaaaagtttgttctccttaaagatttaccttgttaagaaatagtttctgatggctcggcacactggctcacacctgtagtttcagccttttgggagaccaagacaggaggattgcttgaggacaggaattcaagaccagcttgggcaacattgcaagaacccatctctacaaaaatttaaagaacaaaacttagccaggtatggtggtatgcgcctatagtcctagctactcaggagggagaggagggaggatcacttgagcccaggagttcaaggctggtgctaagattgtgccactgtactccagtgtgagcaatagagttagaccctgtttcttaaaaaaaaaaaaagtcaatggccgggcgcggtggctcactcctgtaatcccagcactttgggaggctgaggcgggcggatcatgaggtcaggagatggagaccatcgcagctaacatggtgaaaccccgtctctactaaaaatacaaaaaattagccgggcgtaatggcgggcgcctgtaattgcagctactcgggaggctgaggcaggagaatggcatgaaacctggaggcggaacttgcagtgagccgagatcgcaccactgtactccagcctgggcgacagaatgaggctccatctcaaaaaaaaaaaaaaaaaaaaaaaaaaaaagtcaataaatgaaagctgcttctctattcaaagttagggattgttggttcatatcttcttttccacactccactaaaaaaattttaagctgatgaaaatacttttagggaaacatacttttaaatggaatagttttttctgatataaatgattaccgttaagttgtctgtcttaaagagttcagccaaaaagcacatctatctttatttaaccatttgttgctgctgctgcttattccagtagtgttagcacaggaaaacttgtcattctggacttcttccatcttgccctcaagcagtgcccagaagcaaaaccctaactgggggatagtaagctttacttacagtgccaaaaatcctatcaccatttgctgtcacaagaaaggggcccttattgttatttctctcttaatttttttttttttttgtaaatttggactcttttagtcttatttaaaatagtgatattcatatagtaatctcgcggtactgacatttgttttttccactatcagtgcctaagacaatcgttgacagttattaaaacagtaaggttttctttgactttgtttaagagcctctgatttagcgcccttcttttgcagtgatatttatattaaatcgaaaatttgtaaaaatcagcccatttttatgaataaaaaaatagtagatacaagtttgcaatataagaaatgaccactacaatgcattttagaaattaaaattaaagcttctttaacatatgttaaagtaagcaagaaataagcctctggtaaagctactgaaattttgggattattcattactactgcaaaatcaagtttaacctcactgtcgcagtgcttttgtcagtagagctaaatcataattcacttaatttacagatgtatttttaatgggctgataatctcttagttatcttgtcatttgactttccacaagtttgtattaattgaattagaaccacatgtagtgtgtgtgtgtgtgtgtgtgtgtgtgtgtgtgtgtgtgtgtgtgtgcgcttttttttttttttttttgagacggagtcttgctcttgtcacccaggctgtagtgcagtgccgcaattttggctcactgcaacctccgcctcccagagaaccatgtgtatttgtaaatcaacaattgtggttcctctgatgcatactgaataaattattcagctttcagatttaacttctatagatctgagtcactttctaaattgttactggaaacagtaattgtaaattagctgagtaaatgtgcctttgctaatatgaacactcataaaatttcagagcacttcacagtttcaaagcatcatttcattgattcttaactacaattctaggagataagcaaggcaagtataattattgctgcattcattttacaggtggggaaattgaagcaaagtcatttgccccaggccatatggcttataaacagcagaattagggtcatcttctggctaatctttcaactgtttgtttttgtttttcatatcatctcgttagagtcaattatctgttcaggcagtgggcagtgagggagtggggagaggtggaaggatttgtttctcttttttttttaattcctaaacatttccaccagagacataaaattatccaaaacaaataaatgcattattttgccctccatgttgctggttgctagggcacccatgcctaatttaaaatatatacatcttttgaatgtagcattttaagttttcaaatttatgcaaggtatggagaggaagggagactgttagcatgttttaaaacaaggttaactccatatggagccctgccttctcaagcaatgaattttccaggattaattataaccgaagcaagatttagtcatggactaaaagtagctgcattatcatagaattcttaagtgttattcatataagttttgtatataggatgaacaaattataggtttctaactagaactgcaatgtcattccagaaactatgcaagggtattaaaatgcttattttacagttgttcctggcatttctataattaactaatgatttagtacatctggtgatttggaccaggaatgtgagcaaatcagaatatattaactagtagaggaggtagaatgtttcctattttgtagtgttaagaaagtagacagttaactgactcttaccctgaagaaaatgacaaagggtcagccaggtgcccttccttatcagagatcgtaagtttctatagtccttttgtatggaagtgatagtatttggaaatggggcctttgtgaggcattcaggcttatatgaattcatgagggtggagccttcctgactctattaatgcccttataagaacagctaccagagaacaaacttgctgtctctctgccacgtgaggacacagatagaaggccaggaagagagccctcgccagcaaccaaatcagccaggacttcctagactccagaattatgagaaatagacttctatcgtttaagccactgagtgtgtggtattttgttatagcagttgaagtagacaaatagactattaccatatagctttagaatcaaacatttaatgttaaatcctacccccatagtactggtctcaggaaaggtatgtggcctgttcagggttgttataaattatcaggaacaatatacaagaagtgcctaaattataaaattttataaacttataaaacttcaaattgtcaagattttggtaagcgaggcactttaatttcactttctagaactcataattttctaggagaaattatctctggttttaatttttattccattttattgtctgaattattcatagatgtacaaataatgagaggactcaaagagttttcatgcaaacatagctcttaaaaagtgttaactctttgctccaaggaaataaatatttagaaaactcttactgtaaatatgattatagcagtttcccaaagctaataaaatatttcatcagctaatgaaaaattcagtcagtgcaattaagcagctaatgtgaagacctgaatcagagtttcaaagctactaagaaccacttaccatcatcatgtaggctcaagtgcttttcactcaaagcttagtagtatactttcttgttcaaggtatacttcaggggttaagaatatttccaaacctatagcttcctattgtgtcccaaaatgtttttttgagacacaggcagcactttcagttttttttctaaatccatcttttgagtctataatgtgtcatgataatctttttattatgtaagaggggagtcaggtaattttatctctatccagagccctttgccagaaaaaaaaaatagagcatctttatataaaggaattctaactatctattttctttgtttttctttggaataaatttgaataccaaatagattccttataggaatcactttacaatatgggcccagtctcaaagttgaataaatctttggtcatttttctctgttacatgagagaagggcttaggccactgggggcactttctaaaattcctttataatcacatcttttcttccttatgaacacattagtatttttactgttttaattatattaaatacattagtattttagtgttttcgttatattgtgacaatatataacatttgaatacaaataataattagaaattttaaaacatgtatgaattattgttaaattagttctgccgagagaagctggagaagatcccataaacaacagattggtgccattcaggtatcattttgcacacagatacggtggcttcttctctcacatcccacagtggctttcccacatcatcagtttcctaaatctcccactccactttcccctctttatactcagcaactaacttttcaacatgctacacagagaaaacgtatgtatgaatacattctctccaaagccacactctaactataaactcgtccatacttgtacacattgctaactccttctgtccattcttattggcagaaaggcctgtcctgcttttgaggccagtcccaccacctgtgttccatggcctacttttgattcaactcagggatattagaccatcaaattggtctccctccctctttcagattgagatcatcttctctgtgttgaaatgtttcctttaccacatgaacatactcaaatttccatcttaaaaccacatagtcgcttcatcaaccctgaatcttcctctgactactgctctttcttccatattcaatgaaaaacctttgaaaaaagtcttatacttgctctctctacttccttatttctgattcatccaccaaacctagtggaatttggcttttacttagaatctgattttgctgattcacaatcgacttgctaattacaaaatttggtgggtaacttgcggtccttttcttattttacccttctatcgaaccattctcttattcttcaaactgtatctttcatttgctttatgacactacttcctttttgtttttgtttttgttttttttttcttcctctgatttcttctgaatccttttggccagttcttcttcctctgctaaagttattgtgtgaagtcattccttgaccttttgttctcattcactatcactaattgagtacctgtgtgtatggtaggctcttttttaggcacttcttgtatatcgttcctgataatttataacaaccctgaacaggccacatacctttcctgagaccagtactatgggggtaggatttaacatcaaatgtttgattctaaagctatatggtaatagtctatttgtctacttcaactgctataaccaaataccacacactcagtggcttaaacaatagaagtctatttctcataattctggaggctgggaagtcctggctgatttgattgctggcgagggctctcttcctggccttctatctgtgtcctcatgtggcagagagacagcaagtttgttctctggtatctgttcttgtaagggcattaatatagtcatgaaggctccaccctcgtgaattcatgtaaacctgaatgcctcacaaagaccccatttccaaatactatcacattgagagtaggggcttcaacagaagaattttaagggtagaggtaacacaattcagtacatagcaaatcgttttcagactttttaaaggaacacagctgtttttttaaaaacaatatcttcctaggaccccaacatataaaatagtcaaaagcagaactactccattacagtgggaatgacaggtccagagccctgataatttggacctccctcccaattctaaccccatagtgctccaaaggtatttgctcagaacccaagggctctgagaaaacagtttaaaaggtacaataatttatgttaaattgtccaggctcacacctgtaatcccagcactttgggaggccgaggcgggtggatcttctgaggtcaggagttcgagacaagcctggccaacatggtgaaaccccttctctactaaaaacacaaaaattagccaggcatggtgatgcgtgcctataatcctggctactctggagactgaggcaggagaatcgcttgaacccgggaggcagaggttgcagtaagtccagattgtgccactgcactccagcctcggcaacaaagcgagactctatctgaaaaataaaaattatgtaaaattgcaagcctagatttattttttagttagtttgaaaatcagatttccaaatggatcctggacacttctgtcattctacctgtgtctgaccagtacttcactcagttctttatgctccaaatggaacttaccttcattgttaacttctaactattgttttagtgaaacttcctacctcagcaaatcttccaggctccagacctgcgatgacaggtggaaagatttcttcttgctgctatgtcatataattggacagttaaggcctgtagagctgtagccccatagaggccctcataatcttttctctttgcttccttttttaccctctctttctccaatctatcttttctacaaaggtaaatttctaaaattcaagcccaatcgcattattcacctgctgacatttttcttgagcccccattgtctgttttaaaagatactgaaggggctgagcatggtgactcacgcctgtaatctcagcgcttaccaaggccaaggcgggagaatttcttgaggccaggagttcgagaacaccccgggcaactaagtgagaccctgtctctacaaaaaatttaaaaattagctgggcatggtggtgcatgcctgtagtcccagctcctcaggagactgagatgggacaatcacttgagcccaaggagttcaaggctatgattgtggcactgcacaccagcctgagtgacagagcaagaccctgtctctaaacaaacaaaaaaagatattcgaggcatacagaaccctcaggatttgacactgagaatacatcatattctctcaggcctcaagtcattgtagagttttttcatttctagaaaaccctctttgcttctttacctacctggcaaattatcattttcctttcatgtatcaacttactcattatgttttctgtactcgcctgacttctccgggtgaccagttctcttatcattaaaaatggtttatttttatgtttttcttcctattagacttatatctcctagaaaacagggactgtttgtcttctcatctagcacttaacatagtagttggtacatagtaagtgttcaagatatgttaattgaatagttgaattcttttcaagaaaattaattttttagcatatctaggtatcagccattttatctgttaaagaaacagcaagataagatgatttcaaaatttccttccagttttaggattatctgttaaagaaacagcaagataagatgatttcaaaatttccttccagttttaggattctgtgttacttctcttactataatctccttacccatgattcttctcacttattttacaaagcatttaaaatttatttttaataatcacatgtagaattaattttaagtatatctttaaagaaggatggacttttatcctcttgatatttattttatatttttttgaaaattatttttgttccataaaaaattagtttttgcaaatgagtccaattaggaacaaaatatatcaagaataaactttggattttttcctcttctttacttcctgttgactaattgtagcgggttctctccaaagcatgttcttggcgtaggaaaactgtgtggcctgttttgaacctaaggatgacaggtggaaataatttttctctcaaaagtagaattcaagaaaacagtagggcttttttctttcttttaaccttttaaagtgatgaaataagaagtctacatttttaacgataaagcatttttgtaatgtactgaagcaggttctgtaaaatttaacttttaaaacttatgattttagaaaaaagtcatatgtaactcattagaatgtatttttatttaaaatattataccagcatgtgcatagttacaaggcattgccaaaaaatgtactctggaagcaaaacagaatactgaaaataatgctacaatttttaaaataagaggaaaatattttctttacacatgaaatttttggtccaaatgatatttaaccaactaactggctaatctattaaagcattctatttcagaaaagcttcatttttggtaccgttgattgcattagcacattacttctgatagtgggcatagattatttttttttctaaagtgatgttttttccaaagtgatattgtggttttactcttggaagaaagtacaagttttctgtgggcctaagtattaaaaatgttttttaaaaacttgaaattgttatacattaaactagaactcttggaactttttcagattttgctgctatagtcactagtcctttgacttagatattttatgaaccaatttttactggctggaaaatagaattttccataattaagagaaaacatcagttattttatccagttgactttgtctttgcttgttattgtttgctttagagatttatctaagttgttgacatgattcagattctagtgtatgaaataaagcttttgaggggaagttgctttgaatggaaaaataaataccttaaaaaatatttagctttgagtgtgtctagtcctgtttgaattttttgtttttccttgcactcatagttgtattctattgtagtatatatatttgagtataaaattggttaacacactaagagttcagtttatgagatgggataaatttaaatctcaaagcaattttcaaatatactcattaagaaaatgcaagtatttatattttaaataaagtcattttccactatataccctatcacccttttattattatagacgttttctaatttccaggaaaacctcgtccaccccagtgactgatatatactctagcttgttcaacccatggcctgcaggccacatgcagcccaggacagctttgaatgcagcccaacacaaattcgtaaactttcttaaaacattatgactttttgttttgttttatttttagcttattagctatcgttagtgttagtgtattttatgtgtggcccgagacaatttttcttccactgtggcccagggaagccaaaagattggacacccctgatgtatagcttacccttcattcaaacccctttcatctttcgacgaagcttcataatttgtggtgataattgttttcatatcctatttttatttgccagctattatcatggctgcactttagagctatatcttaactaatcagaacctaatttagttttaaaaattctgtattttctgattagaagttaggatgattttttaaaatgatggcaaataaatatttatgttgctatcaagaaacttatctagtggggaatgtataacatttttaagtagccatggtacgtagaagagaggtagcgataaagtgctttgcgaattcagaggaggaaagaagtaattctatctggacaatccagaagaggtgtaatctaaaacagttgttaaatatttcaaacatagagaagcacagagagtaatataataacataataattgtgctacccagaattaagaaatattatttgcaaacatcaaaaaattctaaacttaatatctttcctccttctgaacaaaacaaagaccttagaatgcttaaactcaggcttcccctcccttttttttttttttttttttttgctgtttttgttgctactttgtcttattgttattgttgtttttggctcatctttgctccttacatcctgcttttcccattggagtttaatttgcttcttgctgaaacatttcctttagtggttctttttcacattttcctttttttgtcgggggagagctctactgtattttgtgttttcctcacatatgtctttcagtttactattttctgtccttctgtggataatctaatgcttaacctgtccattgaaacttttattccaagattcctgtttgattctttcaaaaaagaaaatgcctattcttttcatattgtcctttccttgccgtatggcagctattcctttcgtggtttcttttgacattaaatatacttcttttagaatttctttcagtttattatctatgattgtggatgtgtcagtcctgccattggtcatgtcttctgactcttttataagtgaggttcatttaaattttttttttccattttactgtgaatttttttttagtgggagttgttttcctgtgggtcttggatcgtgaaggcatactgttatagagattcatatttgcttctgacaaattcctgttggcttcactgagtctgaaccagttgttattcttaattttttgagggtggagcaggcttgggtagtctcattccttatgtgtgattccttttccacccatgccccagatgggttgcaagctttcttgtgactatacccaagctagtaagcaaaattttcctaggagctgtttcatagacagaagagtattttgtagatctaggttacatgcagggctgcaagcccagtttcagcttcctacctctaacaggactgagacctgtctcctttaatagagggtaacagaaaacctcacagttgactttggcttaagttcagggtacatggagatggttaatggaaaatatgtttggaaaggtgggttggaatcaagtacagtaggccttgaatggtaggctaaggaatttggacttcatgctacatatagcaggaatccaatgaatgtctttttgcgtgagagtcatgcagagctttgctctaagaagattaatttggtaaccatgaataggttggaatggagagaacatactgtgaatagggagatcaattaagagactattcacattagtctgtgaaagaggtaataaagacctgaaatacggtaacaatagtggcaatgaagatgatgtgagaggtaaatagatgtttatagagagattatgatacaggtttcacactggtattcaggagaaagagcattccaagatgaccccagtgaggatgctgaaactattaaggaaagtcagacacagacagagcgttaggtttgtaaagaaaggtgagttcgattatgaaaatattatctttgtagtgccagtgggatacccaggtacaaagggccacccatgcagataaacatattggactataattaagatagaaggacagaccaaaagagatgtggggcttagtagaacagaagcattaaatgaagccatacatttcagagacagaatcaagaatcaggaaagagaggaggtaaaccaagaagaaaattagtaattaggaaatagaaaaagagaattgtggggaatgatatgtcagagtagtaggagtgtggcccggggcatagactgatattatggaaatcagaaactggaagcatttcacggccaggggctatcactattagagaggtggaggaaaatgttgaggaggatgaggtccaagaaatggccatttaatggtaaccagagtcaaaatacaaggatatgaggaacaagtggaaggagaggcagtgagagtggaaataatgtagtaaattcacttctgaaataaaacttataagggtatacatagtatttgtgaaatatagatctgtatgtatatgtttgaatctatacaaatgtattatatgtatgtatatatgtaaatttttccccatgtctgttagcgtgtaggtattggcacccttgggttactctattaccctgtgataaaagattagcaagcaagattcttcttatcctttgaaatctccactttgatcttcataatagaggtacagtaaaaggggaaagatagaaagcaacaatattattgttggaatagacgtaggaggtcacagggttgggaaaggagaggtacatactattagcagagggtaaaagtgctttggaaatttgggctatggaagatctatcttttgtgaaagcatgctttgtattgaaattatcaaatagaagatagagggtggacaagaacacttacacataattgaatgtaccagatgctttacataaattttcatgtttcatctttcaaaacactaataaggagtgcatatggtagttctgtttttaattttttgaggaacttctgtactgttttccatgatggctttacaatttacattctcattaacactgtactaggggttctctgttctccacacccttgcgaacccttgttatatattgcctttttcatagtagccatcctaacaggtgtgaggtgatacctcattgtgattttaatttgttttgcctggtgattagtgatgttaaagttttttcacataccttttggccatttgtatgtcttcctttgagaaatgtctattccagtcatttgcccattttttaatcaggttatttgttttcttgctatcgagttgtttgtgttctttatatattttgtatattagcccctttctaggttctctgttctgttccattggtgtatactgtttttatgccagtaccaggctgttttgattactttagctttgtagtatactttgagatcaggtgatatttacatgcctctttgttcatttccttaagctttatttgcctattcaaggtcttttgttattccacatgaattttaggattcttttctctatttctgtgaaaaatgtcataagaattttgatagaaaaatgtgattagaattcagtgatggaatcattgaatctgttgatcactttggattttatggacattttatcaatgttaattcttccattccatgaataaggaatattttttcatttacttttgtctccaatgtctttcatcagtgttttatacttttcagtgtatagatcttcacctccttggttaaatttgtttttaaattgttggggttttttgttttgtttttgtttgttttggtagctattgtaaatgggattgttttcttgatttcttcttcagacagctccttgttagtgtatggaggtgctactaatttctgtatgctgattttgcatgctgaagctttactgaatcaattagtttcaacagttttttggtggagttgttagggttttctataaataagatcatgttatctgcaaacagagacaatgtaacttttcctatttcttcttttgcctaattgctctggctataacttccagtattatgttgaacagaaatggcaagagtgggcattcttggcttattcctaattttaaaggaaaagctttcaacttttaacagtttagtgtgatgttagctatcgtattttatatatatatggcctttattgtgttgaggtacattccttctatatgtaatttgttgatagtttttatcatgaaaggacgttgaattttgttaaatgctttttttatatttattgagatgatcatatggtttttgtacattatgttaatgtggtgtatcattttcatagatttccatatgttgcatccctgtgacaaatcctacttgatcatagtgtattgattcttttaatatgctgttgattttggtttgctaatattttgttgaagatttttacatctgtgttcattatagatattagactgtaatagttcttttctttaatatccttgtttggcttttgtattagggtaatgcaggcctcataaaataagcttggaagtattgtctccttttcagtttttagaaaaatttgaagaaggattggtattaattcttttttgaacatttaggagaattcagcaatgaagccatcaggttctaagcttttctttaatgacattaaaaaaaaaattatagattcaggccaggtgtggtggctcacacctgtaatcccagcactttgggaggccgagacaggtgagtcacctgaggtcaggagttgaagaccagcctggccaacatggtgaaaccccatctctactaaaaatacaaaaatcagctgggcgtggtggcgggtgcctgtaatcccagctactgggagactgaggcaagataattgcttgaacccaggaggcggaggttgcagtgagccaagatcgcaccattgcactcaaacctgggcaacaagaacaaaactctgtctctaaataaataaataaataaaagattcaatctccttactttctattggtttgtttacaatttttattgctttataattcagtcttggtaggttgtctgtgtctaggaatttatccattttttctgagttctccaatttattggtgtataattgtttagtgatttttttcatacctatgtggcctcaattgtaatatctcctccttcatttctaattttatgtatttgagtcttctttcttttttcttagttaatctagctaaaggtttgtgagttttatgtttttaaaaaaaccaacttttagtttcattgattttttttctttctattgtatgtctaatctctattttatttctactctgatctttatttccatccttactgtaactttgggcttccttacactaactagttctttaaagtgtaatatcaggttatttgagattttttttctttttaagtattgtcttttattagtataaatttctcaggactgctttggctacataccataaattttggtgtgttatgtttactttttcattattcttaagatatttttcttgagaatcaaaacttcccttttgatttcttcttgaaccattgattgttcatgagtgtgttgtttaatttccacgtttgtgaattttctagtttttcttctgttactgatttctagtttcatatcattgtggttataaaaattactcaatatgatttcagtcttactaaatgtgttaagatttggtttctgggctaacgtatgatttattttgtaaaatgttctttgcactcaagaagaatgtgtattctgctgctgttggctggaattttctgtatacgtctgttaggtttattttgtctgaagtgtaattccagcttagtgttcctttactgatattctttctggattatctatccattgttcgaagtgaaatgttgaattcccaactattattgtattgctgtctatttctccctttagatctgttaatatttgctttatgtgtttaggtgctctgacttcggttcacatatatttacatttgttatatcctcttgattaattgatccttttatcattatctagtgaccttctttgtttcatgtgatggtttgacttaacatctgttttgtctgatgtaagtttacctgtccctgttctttttggtttccatttacatggagtatcttcactttcattctgtgtgtgtccttaaatgtgaagtgagtctctttcaggcagcatataattgggtcttatttttttttatccattcaaccactctatgtcttttgattggcaaatttagtctatttacatttaaagtaatgattgataggtaaagatttacttttgctattttgttaatggtgttgtagttatttggttgttttggagaccttttgtcccttttttcttgctgtctttctttgtgatttgatgattttctgtagtggcatgtttcttctattcctttctcttcatcttttgtgtatctactgtaggtttttgcatttttgttaccatgagggttacataaaacatcttatagttacgctagtcatacaaaaacatacaaaaacttacttttactctcggtattagtctgtcctcatcctgctaataaagatatacctgagactgggtaatttataaaggaaagaggtttaattgactctcagttccacatggttggggaggcctcacaatcatggctgaaggcgaatgaggagcaaacacatcttacatggcagaaggcaagaaagcatgtggcaggggaactcccctttataaaaccaacagatctcatgagacttactcactatcatgagaacagcatgggaaagatctgctcccgtgattcatttacctcctactaggtccctcccatgacaggtgggaattatgggagctacaattcaagatgaaaatttgggtagggaaacagccgaaccatatcattcttctcttatattttatgttttctgtgtcagtgtatgtatttttacattatatatccattaacaaatttttgtagctctagttcttttctggaaatgcttttgtctttcaacatttatattagagttataagtaatttacacactaccagtacagtgttagggtattctgaatttgactatatatttacctttgtcagtgagttttatactttgatgttttttttttggggatggcgtttcactcttgttgcccagggtagagtgcagtggcacgatctcagctcactgcagcctccgcctcccaggttcaagtgattctcctgccccaacctcccgagtagctgggattacaggcatgcaccaccacacccagctaattttgtatttttactacagacaaggtttctccatgttggtcaggctggtctcgaacttccgacctcaggtgatctgcccacctcaccctcccaaagtgctgggattacaggcttgagccaccatgcccactctatactttcatgtttctaagtagtggccttttgttaaagtctgaagaactcccttttgcatttcttgtaacacaagtctaatagtgatgaactccctcagttttgtttgtctggaaaagtctttgtccctcattggtgaaggatagctttgctgcataaagtatttttggttggcattttttttttctttcacaaactcttcccacttactcctggtctgcaagatttttgctgagaaattcatcagtggtcttatttagcttcccttgtatgtgatatgctgcttctctcttgctgctttaaaaattctctgtctttgatttttgaaaatttgattataatgtgtcttggtgaagtcttctctgggttgaatctgattttacatctttatgtttcatgtaccttgatgtttatatctttccccatatttagaaagttttctgacagtatttctttctctttctctttctttctttttccttctttcttttgagacaaggtctttttttttttttttttttttgagacagagtctcgctctgtcacccaggctggagtgcagtggcgcgatcttggctcactgcaagctccgcctcctgggttcacaccattctcctgcctcagcctcctgagtagctgggactacaggcgcccaccaccacgcctggctaatttctttttgtatttttggtagagacggagtttcactgtgttagccaggatggtctcaatctcctgacctcgtgatctgcctgcctcggcctcccaaagtgctgggattacaggcgtgagccactgcgcctgggagacaaggtcttactctgttactttggctgtactgcagtggcataattatgactcactgaagccttaacctcccaggctcaagtgaccctcctgcctcagtctcccaagtagttaggactacaggcacacgtcaccacttaggcacctggagattgggaaggcagaaaactgtgggatgcccagtggccaaacctgcagggggtctgttgtagctatgctgactgctagattcctcagcagccagcaaaagcctgttagggtcttctgcagagcaagctgccgtggtccacctcagtgaacaccgtggtatcctcaggggtgaaatctcttgtggtagccacaagggctgttgaggtcctcagcagagaaggctgctggaatcctgtgcagagcaggccactaaggataataatgatttctgcttatatggctgatactgatagcccccatccttctttgtttccacccatgccagtctcttcagcaatctgggtggggtataactaatgctggttgctgatttctcaggcagtaccctgaaagtctggggaagctgctctttcatcctgctctccattgccatgccagtgatacttacaaacttgggagttccttttctatgctgatcagtgctagccttgggaatgggatgataaaggcagaatgaactgtttctttcttttgtgtggttatggaatttttgtgtcattacttatgggagttttcttccagtgtattgctgtagtttcttaagtagattcctgagctcttccagttattcccattcatgggtagcgtccaattattgttctttgtgaagaaaacgaaggctgggttttcctacttagccatctttctgacatcattccttgcttttctttatagctttgtcatatttacatattccatgtttagctttgcatgttcagaatttaatatgaatggaaccatgctcttcatattcttatgtaacttggtttttatgttttttttttttttttgctaagcattgtttctgagagtcagtcgtattgatgcatgtacatagctgtaacttatttattttcacttctgatagtattccattgtatcaataacaagtttatccattctcttgtcaatggacatttggttgtttctgttgttcttttgctataagaaacacgtctgctgtaaatactatgcatatgccctttggagtccttaggtgggggaatcaaataggttaccttgtctctgttattattgttttcctcctttccaggtggcttacacctcccttgtgtctacattttttgcaactctagaaaggaggggaagagagtttatgaggtattggggatagcaggggatagctgcatttactaccctttacttcaaaatagcttcttttgtcagaccattacacattgtagttctctaggcctctgccttaggccctcctcttttctcgttctatcccttcttcttaaatattaacatttatttttatggtttcaaataccatctaaattctggtaactccaaattggtatcttcatttcataactctcttcttttcacttggcccatatatccagctaccattcctcatcaccatgcatatgtctctactataatcacttcagactcaagtccaaaaccaaagttgggatctttcccttctttcctctcccacccttaattgcttctccagttttctatttctctgtgagggcatcttccctgatctatgtgattatgtgactaggtacctggaagttgaccttgacactgctttctccttcccaccctcatattcccacccccatatccacccactcactcactgaaatatttctaaaccagtagttttcattattttcactgccaccaccctaattcaaatcaccattgcatcaagcctggactagagaaacatcctcctaaggaatctctctgtatctactcttgcttttctctaatccattgggcagccaaagtggaccatttacattatcaggtttcctttttactttcttttttctttttttttctttttttgagacggagtgttgctcttgttgcccaggctggagtgcaatggtgcgatctcagctcaccgcaacctctacctcccgggttcaagtgattctcctgcctcagcctcccgagtagctgagattacaggcatgcgcctctgtgtccagctgattttgtatttttagtagagatggggtttctccatgttggtcgggcaggtctcgaactcctgacctcagatgatccgcccacctcggcctcccaaagtgctgggattacaggcatgagccaccgcgcccggccatcagctttctaataataacttttcagtggcttcccagtgcccttgaataaaatccacagtttttaaacattttctataaggccatcttttgtgtactttctgcctacatctctagcctcatcctgagctgaaaccacctgtcccctatattctcaatatgtactgtgtctccttactccttcatatatgttcttccctctctctggatcaccgttatactccccttgccttcctagctaattttatctctttggatctaagcttaactgtcatttttttagggaaacctgttctgatcttattcatgttggcttctctttttatccacattcatcaagccctactttctcatttgtaatattcattatttaatatgtttcttttctgctggattatacggtcaatgagatcacgaaggctttgttctctgttttattatcagggctacttcaatacctggcaaatagtaggctctcagtaattttttttttgagaatgaatgagctgcatgtatctaaatttctgcatttttgtcccctcactcttggagataaattactcatcctgcctttataaagatatgatgaaaattctggcacatagctgttactaacatggaatttctagtaaaaaattacattagacaaaccagaatcaggcactaggttttttaaggaatattaccaaagaaattcagaagctagtacatttatttttataatatctactgaatttccaagaagtgacacttgttcctcattgggatacacaaaatctaggctcatattacttgctatttttagattttttaatgaaactttgccttactctgtctcttccagtcattattctgaataaattaatagaaatgagtatcataatgttttaagaatcaaaaaataaaaacaatatttatgccatttttctgtgtaatgtcatctaagcatataatggcaatactgaaattagacaaacattgtattaatctcttgtggaaataaacatctgacttggaagaatatacttaaaatttatcaaatatcatttggcctattagctactgtttattatctgtttttcatggctctatctatctcatagcccatgttcctgagatgttcctgtgtttaaatgtatgtagtatatagacagaatctatccttagaggtctatcctttgagataatcagcactaccaacaacattgttcatagaatatattatacttaagtagctatatcttctgtgtgttctatagttcacacttaaatcaaggaagtaatcctttcattatgtaattatattaactgtcagtaataactgttctatccaaaatacctggtgtgctctttgatagcaataaattacacagttatagtataactggacttatactccagttataaggcagaaagtcttctccgagcaatctatattcagttattaaatatgagtaataataaagcattgtgttcatttggaaaccatgtgtcttttaatttccaaatatgagttttggtgtttgattggtctaaatgtctggcataactattcactctctttccaagtgtattgatgtaaatctgaattcagttttattattagtttattcaaattgtattctcactagctggctagatggtaaagtgtaagagtaacatatgactgcctgtggaagtttgttacatttttgtttggacttcatgaagccatatgttttttgttttttgttttttttaagatggagtctcgctctgtcgcccaggctggagtgcagtggcgtgatcttggctcgctgcgacctccacctcccgggttcaagcgattctcctgcctcagcctcctgagtagctgggattacaggtgcgtgccaccacgcccggctaatttttgtatttttagtagattcgggttttcaccatgttggtcaggctggtctggaactcctgacctcgtgatctgcccacctcgccctcccaaagtgctgggattacaggcatgagccaccacacccagccggccatgtatttttataaccaagctgccctcagaattatgaatagtatttctgacatgtagtgtcttttctcatttatcttagaatatatggttaccactctataaacagtttgtctattattctggtactgtgcttagtttaagacacctaaccattaactagttttcagaatggttttgctttttagtgatagttgtgtgagcgcactgttgctctggttgtttttaaatctcactgaggtaggcttcaggttgttaatgtaaatctttatagctttggctgaacttcctacaagagctgtgggtcttgatagctgagatcagctggctgatctctcttaatggcagttagatttgaattttgtgggctaggacacagatctgtttggaaatggtctgtttaatgcatgatggctttaaatgaagactaaaaaaacgggccaccttgtaaaaagaaagtcttagtctctagagttcactacctttcttagtttgaaccaatccaagtttttaactctccatagggcccggtaatttgaggtggaggaaactaatatgaactttacatttcatttcaatattaattccaagccagtgtgctttaaggattgtcacaaacatattatgactggacaggaagagtgcttgcctcttggtcttgagtgacaagccctgccctctgcccctagctgagaactcaaagcattgttaagtagcactaaaacgagctgagtccaagacttcagccagatggtcaatatagtgcttttaaaggaagggaaataggaaaagagtaatctcagaagcactcctatgttaaagaactaagaaactgaagtctttctgaagctaagtgtaaattattccactttctttgggagcaaaagctgcaaaatataacacaagaaaatgacagtgtaggaaaccaaagttcaggaacaaaccttcaagtgtggttttctaatgcttaatcgtatcttacgcccttctcaggatccattgctccttttccctccctcttctccaaggtctgtttgaaagggattttgatgggataggaaggcagctttagacagagcataaattagggcataagatgtcctttgtacaagaattatcttagacatgctttcaaaaacatactttttttgaccttattaagaaaataatcaaaggtatgattttttaagtctttgagtttagtctgctttcagtaaaaataaggtataggtaccaaaataagcaaacctcgtttttactttcctggtttctgcttataagatttacacatatttaaaataaacccatgaaaaacaggaatagtgtcatgggattggctaaatagtcagagcaattacctccaggctcccaaacccaactgagcttgacttttggaagtaaatttggctaagacttcttcctcattctgttttataaaggtatacatgaaatgatactgacttctgccagaaaccccaggaatcctgttcagtgatgtacttgtaatggtcatgaaagaataaaaacacagatgtggattaaggtagaaaagtacagaaaacactaaattttcattgtgctgtttcaatgtggcagattctttaaaatacttcgacatgctacaataattaaaggttttaagaacattaagatacttaaaaaataaaagcccacaattgaataacaaaaatgaactttgttttattttttattggcattaatgtaggttgccgtggtgaaaatagtttgaaatacttcacagtaacagttttgtgcagccctagagatcaaaaacagcaaagtaaataagcaggactctcaacgactcatactcacagacatgtttaatgtaaatgattgctagaagggaagggcattttcttcagtgctatgcaaagaaattttaattgacttggttttggcagtgagaattgtacaacttagcattaataagtcaaatttaaaaatttgctcattactctggattatgactatgttcaagaaatactattttcaagcactaatcatttagataaaactttttttacacatttatggcatcaaggagtatgactgtttataacattttacctataaagctgaactgttttatatactctttatggaaacatggccataaattaaaagatgcaactgttttgaatattttactggtggtcctctgttttcctgccagcagtgcagctgtttcaggtttctcaggataacatataaaaagctgtatgcacactgcaagtttatgctcaaattgccaagccagatatggtatgactcaactttcccagaagcaagctgtaccaaaatgtgatgaatcaaaacagttagttgcacagtggtttgtattacagctatgaaaaccaattctcatttatgatgtttggcttttcaaggttgacaaacattctactgtggtgcttgaattttaccataagtgaacatctattgaagctaagactatgcttttcttttgaggatctgaggaaaggaaagggtgatacattatcatctggtgtgcggataaaaattagctggaaacttgtatcaggaatggaacatttcatttccaagttacctataaaaatattactcacttattatttgtatgatagttattgaattccctgtgaagccaggttaatttttagacctttctgaggtaacttaacatttacttcatttctcatgcatcagaatcttaacagttgatactttattgtgtcttggaaagtaataagcagataactttatggccatggggtaggtgtggtgaatccctatttcaatcctatgcgacctaaggttctatcaagagtttaacaacgactatttttcttttttttttttaaacagggtctcactctgttgcccaggctggagtgcagtggtgcgatctccgctcactgcaacctctgcctcatggactgaagtgattctcttgcctcccaagtagctggattacaggcacctgccactgtgcctggctactttttctatttttagtagagacggggtttcaccatgttggccaggctggtctgaaactcctgtcctcaggtgatccacctgcctcggcttcccagagtgctgggctcacaggtgtgcgccaccacacccagacaacaatgactaattaataacagtagtctctaaagtgggatgtgtcccatgaggatatgtaagatacagtttatggagaaaatattaaaacattcattcattaatttatttagagatggagtctcgctctgtcacccaggctggagtgcagtggcgaaatctcggctcactgcaacctccacctcctgggttcaagtgattctcctgcctcatcctcctgggtagctgggattacaggcatgtgccaccacgcccagccaagtttttgtatttttagtagagatggggttttgccatattggccaggctggtcttgaacttctgacttcagatgatccgcccaccttggccttccaaagtgctgggttacaggtgtgagccactgtacccagccagaacttttatttaaatatttttatttcatcctttttctatttatatttttatattacactgactatattagtatcttatgtatataattatatatagtaacatatagtacattagtattctacataaaacatatctgagatatgttttatggctataaaatactatcaaaaatgtttttgtttttgttcaataaatattctcttcttccttccgctttcccctttcgcccttggcagagaagcaaataattgagttaaaaccttgatttgtggcaatgtgaataaattatagctaattccaggaacttagctgcatcctaccttgacccattttttctactggactcttatattgctctatatgttttagctacacaggtttattaaacatggatacagatgaaaaacagacttgttatgttagaagttataagttgctcatgcattaagattttgacacacaggaagtttgaatgaatgagtgaaaaaggttccaagttattaaaatgttctggtacctgatttattcatttgccataccagtaattctaaggtgggtgaagctcctttacttcctgaagaaacaagttagtttcttaaactaagcattaaaagaaagctggaattatttgtttccagaagtgttagtagtcatgctaagttgcccttctttggctagattgtccaattttttttaggcctgttttgtctatttttgtcaagatataaatgtttaattgctttaaaaaaactgtgtggttgcagaaaaaaattgtactgttatattgttgagatcaatgagacttttctgtatttactttttcagacattattttgaactcaggctcagtctcagagatttcttcaacatgtaattttctaatgtttcctttcctgcaaggaatgagacaatatattcttggaatattaaagtacttttgaagtaactcatacgttttctcccctcttccatttgtttagctattgagggtttgctttaaaacaaatttatgtagaaatatcagtactataatagtattgtgatactgtgtatttcttaagcatatgccaggaaggagagcattagttaggtgtccaaaaaacagccaacaaaacaaatcagctctgaaaatcgtgaagcagtgaatattttagaattatttttgaaacctctttcagaactgtttttagaccccgtggtaatttgctatgtaatttaatactagtttaggcactccatgtacagttggtatgtttccttttgaaagataataatctatttataataaaagtctgaatatttcaatctcggaattcctctttaaaacttgaatcagttttactattgctttttaaaatgttacctatttatatttgctttgtatatcaatgctacacttcttgttttgttttaggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaagttctgtggtttttctcttattacagtgttttacttgaacacattttaaataccattttgattacaacatttactgttaatatccaagtctattatttcttctcataaaatgttcccctttttcctaatgtcttgttaatactagtccagacaagtggatatatttcctttgaccaagttatggcaagaaaaacctgacccatgataatgtcattccctcaatactaaggactcaatgcctgttttaagcagtggaaaatgaggcaaaccttgatcaaggtgttatagttcccagctgtgagccacactcaggataaaacaaaacccagcattaacctgctttagtgacacattcaaagaagttaataaaatttaatacttaaatgatacctttcacctccaatgtaagctcattttatgatgaatcctttggagactggagaaggtacattttaagtacagttccctatgtataaattgtatactgatacagtttttttgttgaaacttcaaaggcttttattaccagggttttgcttaaagagtttagatatgaataggatgatattgcagcatctcaaccttgtatgagtctgttacatagagcattggatatgggatatagtttcttaaggaaattaagggatttcctatcaaatctctattacaacagatgttagttttatgggtagaaacttaggtgaaacaagacttgtggttacattaggatggactatccatctgtaacaactccatcttattttactaagcagttattaattaattttagcaatacatcttcatctttattgtacttctatctttgttaaatgagaaaaccaaggcatcaaataattgagtagacaaagatcatattcacaagttagtaaaaagccagaattagaatgcaggttttttttttcaaagtccagttccatctacattctaccagactgcatatcctattcctgtatctattaggtatttccgaactgaggattagtgtttttaagtacagtctataaatctgttcaaagaatagttagaacattgaatgtagagttaaggctttgcagcagccaattgcaaaaataaggaatccagtcttttgaaaagaaacactactgcttgttctcataccttttataaatgtattttaaaaagaatgaactaattaataaaacatatcaaaggcttttaaggcttgttttgagcctgccttattgtggaaattgcatgcacctggtttggcaaataaattccaaaacctttatacatttgtaaatattttgtagttgctattgctgtactttgttcaataggccaaatttagaagttaactgaccttatttgatcaaagggaatggtgaaaaataacttagtgacaattcactgaggtttagtgaattcactgaatttaccaaacaacagaaatattctaaattgatgtgcttatcccctaccatccaagtgatttactcttagagacaaaggctgtacatatctttcatctacatgagttaagtcttcaagtattttatgagtacagaagtaataattaacaactactgtattacctgtgtcccaggcactgcttcatgctttgtgtattacgtaatcctcaaaacagttctactagtattttccccattttaacagatgaggaagctgagacagtggttaggtaagttgccaacagtcatataacttaaaaatagcagagctgggatttgaactcaggcagccagactccagaagccatgctctagagatgactgtcaaacaactgctgtgctaaaactagtcctggtagtcgaacttcataagacttccaggaggttctacagatcaagtatctagatcttttatgagatataaatgacatcaactaaatgatcttgttgatgtcctaagagaagttctgagaaattcatgatgtagaaaatgattttactaataactatactccctcttaagcagatatta

SEQ ID NO: 13405 - DNA, 48316 bp, Human; identical to SEQ ID NO: 12853

SEQ ID NO: 13406 - DNA, 43993 bp, Human
ctgatcgcgtgggatagtccctaagaggagggaggcccaggctcttacgtcaccagaacattttacgcaaggcgcagatgacaacttgaaagtgggatttagatgaggaacctggagttttgagtttatcctaatgggacatcggctaaatatagcaacagcaattaaaattataaattgctttctacaagaacaataaaacgaagtctggggagcgcttcggaagtatttgacattcagtaaataacatgtagaatgagtgaacgaaatggacgaaatggatcgtttctggtttaatcctcaggaaattggcacatgctgttttctctgcctagaacaatcttttcgcagctcttttcctggctgatttatacttttcagatcttagatcgtcaccccaggaagccttttcttccccaaccctgacaatatcaagtgcctacaacactgttcttttccttaaagcaattacagctgtgtctatttattagtttgttatttgactaatgaattaatttctgccttttgtcattagttctggcgagggtaggactcattcctcactggaaccccaggacctgttagtaactgatcatatttaccaggtcaataaatgtttgagtgaatgtataaatatttgattgaactgtgtagatcaagcagattaaaagcctcacacaaaacagagaacttcagtgtcagcctgtgagtgtagaaacaggttttctttctttctttcttccttccttccttccttccttccttccttccttcctttctttctttcttttttcttgagacggagtccctagtagctgggaccacaggcgcccgccaccacgtccggctaattttttctattttttagtagagacagggtttcaccgtgttagccaggatggtctcaatctcctgacctcgtgatccgcccacctaggcctcccaaagtgctgggattacaggcgtgagccaccgcccctggccctgaattgcattctagaagcatctttctggctgccatgacaaggaagaattggaggggaggactggtggaaagtatggtcaaggcatgaagacagacctagatgtctagatgtgtcacgtgggcaactgaatggatgaacacaggacagagagagagaggaagagaggtggccgggcacggtggctcatacctgtgagaccagtactttgggaggctggatttggtgggggggttgggggttggatcacctgaggtcaggagttcgagaccagcctggccaacatggcgaaacactgtctctactaaaaatacaaaaattagcctagcatggtggtgcgcgcctgtaatctcagctacttgggaggctgaggcaggagaatcgcttgaacccgggaggcggaggttgcagtgagccgagatcacgccactgcactccagcctgggagacaaagcaagactccgtctcaaaaaataaataaataaataaataaaaatgggagggggctgaacacttagacgaactggatttagctaagatgagtaaacaggaatctgaagaatcgtaagcaggggccccttctacttcccaacctccctggccaggtttaaactaagcgcgttttccaagacgttagggtcacctccacgactccagggggcgctgcaactgctacggcccctctaggctcgccccgctcaactcactgacagaggcggcctctcccgcggtagacaatgtgcacgtgcgctcttcagccggcagagggcgcgcgtgcgcagacggggccgggggcgcgcgcgggggccgggggcgcgcgcgggggccggcaccggaagcgtgcggttgccatgtaatatcctggccgcgcgggcagcggctaggagggcggcgccggcgctggcgcgcagctggcaagcgggtggcggaggcggcgccgacggggactgctgaggcgcgcagagggtcggcggcgcccgggagcctgtcgctggcgcggtccgggcgggaggctcggcggcgggcggcagcatgtcggtggcggggctgaagaagcagttctacaaggcgagccaggtgagcgcaggcccaggcgggagccgagtaccgggccccgggctgcccggatgagggagccaggcccgacctggcccgggagggggccggggggaccgaggtggggacgttggcgcgtgtcccctgccaggtgggaagaccaagggacggacgggggcgacgaggtggcccaggccctgcccgccatgcgggctccagaagcggggacagagcccctgggaggaggggagaggcaccctgggctgcccagggacgcggacctctcccctccttctctccgctgcaaaggcggggtgcggggagagaaggggaagagaggagtcccgaggctgtcgacacaggactcttgccagataacccagagccagggaaaagttgcgtctagagcagttacgttcaaaatcctctggatgggcaaggtacaaagttgaaaaggtagaggaagaagtcagtttcccctctctgctcctcgggcagccagcccttctccccagagacaagcgactgtcatcgactccgtatgtccctttcctaagatacgtgtgtgcctttcctttaaaaacacgtaccctgtgatagcatatgccacagaatcctgtgtgctgtgtttttcattgcttggagatcacactggagcgggatttctccccctccgtcggcactgttgacatctgggctggattgttctccgtggtggggccgtcctgggcactgcggggtgctgagcagcgcccctggcctccacccactccgggccaggagcacccccaagtcgtgacaaccaaaaatatcttgagacatcactgtgtgtccccttagaatcagtcctccttccctcccttcgttccttccttccttctttccttccttcctccctccctccttgcctctctccctccctcccttctcttctttccttcctcccttcctttcctgtcccccaggactactgcactagaccatactccacacttcttggattttttttttttttttttttttttgagagggagtcatgctctgtcgccccagctggagggcagtggtgcaatctcggctcactgcaagctccgcctcctgtgttcaagcaattctcctgcctcagcctccccagtagctgggactacaggcatgcgccaccacgcccggctactttttgtaattttagcagagacagggtttctccatgtgccccagggtggtcttgaactcctggcctcaagtaatccgcctgcttcggcttcccaacatgctgggattatcgacgtaagccacctgcctggcctacttggctctttttaatgggtacattgtatttcattccatgacatataccataatttatttaaccagttgtcagttgatagatatctctattgtttaccggaattttctgttaccattactacaataaatagccagtgaatatctttgctcaccagtgggattagttttataggatgaattcccagaagtagaatgctgcatcccagcctaagtgcatttgatatggacagataaagggttttttttggaaactccagggcccactgctcatgaatctggtgaaagctgtggatccactctccagaaaactgggcacatttaaaattttcactttgcaatttcgaatgcaagaagcctcaaatttggccgggcgcggtggctcatgcctggaatcccagcagtttgggaggccgaggcgggcggatcacttgaagccaggagtttgagagcagcctgggcaacatggcaaaaccccatctctactaacaatacaaaaattttgtatttttgcctgtaaccccagctactaaggagggtgagacaggagaatctcttgaatccggcaggcagaggttgcagtgagccgagattgcaccactgcactccagcctgggtgacagagcgagactccgtcttgaaaaaaaaaaaaagacaagaagcctcagattgttgaatcctattggtccgtgtactgcagggtgaggttgtgtggaatttgtgtagatagagtccaccgaggaatgagcaatgatcttagcaaatgcttgggccaaggtggcaaacagggttctctgcccacagttcggagatgcccagtgggagcaaagagaaacgagtccccagtaacacccagcaggtacctttgcccctggaaagaaaaaagtaaggaccctgccaggtgctgtggctcatgcctgtaatcccagcactttgaaggctgaggcaggggttcccttgagttcaggagttcaagaccagcctgggcgatatagggagatcccatctctacaaaatatgaaaaagttagccaggtgtggtgatgtgcacctgcagtcccagctacttgggaggctgaggcaggaggaccacttgagcccagcagttcaaggctgcagtgaactatgatcgtgccactgcacttcagcctgggcagcaaagtgagaccctgtctcaaaaaataaataaaaaaagtaacaaccctagtggttgtttagggatatagatacttagggtctatctctacaccccagatgatggttaaaccctggagaaagatttaatccagacgaattttagagttgtcactgagaacagtcccacccccttgccccagcactttgaaatcagatggcctggccctgggttagaccttgcccagcaggcgtcagaccttcacctgcttggttagagcaccatagagtactgctccctagcaggaaagatgtcctcagaggtcttggaggaattcctgggccactttgttccctgctatagacaggtctctggaagccaccacccccactcccagcgatcagggcctgtgcccatattgtcctgagctgacaccctctttagaggaatgaaccaggcctcttgtgccggccaccaggactttgtctctctcaagggaagcaggatgacctgcgttcagatctgtgaatggcgccttgaagcctggaaaggacagtgtggtgttagctgggcttaggattgcctatttccacatcccgaggcctagtcccaaagcacaatggccacagcccaccctcggggctgtcgtcttggcctcctggtcaattctgtcctgagtcgtgctcttagaagtcaccctggctgcgttccatgctcttctgtgatcattgccatggttccctctgacatctcagctgttatctggacgtatccgactatttgtgtctctttttttgtttttagtctaataacaactctttcaccctctgctgtgcctgttggaaagtgacatctctcgggatctctcattacgtagtgatacaaacatttattgagttctcaccatgtgagcaggcagtatgctttataccagtaggtctcagctggtcttgcttatccggtctaagggtaaaaaacattcccccttttacacaaaaggattaggggacatttatcttcctgtaaaacagggccagttctgtcctccaggggacattgacaatgtctgggacctttttggttgtcacagcttggtgcggtgctgctggctactagtaggtagaggatattgctggacatcctccggtgcccagggcagcatctccccactgcccccaagaattacctggccccaaatgtcaatagtaccaaaatttgagaaaccctgcttgaagatttggaaaaaaaatgaggataattataccaaaacaaaggaacaaaaaaatccccactgagccattcttacgattttcctagtttggccaggtgtggtggctcacgcctttaatcccagcagtttgggaagcactccagcctggtggatgagagcgagacttcgtctcaaaaaaaaaaaaagtaaaatataaaataaaacaaagattttcctagtttgctaaacacagatagccacatgtgtagtttgtttttgtttgtttgtttgtttttgagacggagcttctctcttgttgcccaggctggagtacaatggcacgatctcggctcactgcaacctccgcctcctctgttcaagcaattctcctgcctcagcctcccgagtagctgcgattacaggcacccaccaccatgccccactaatttttttgtatttttagtagagacggggtttcaccatgttggccaggctggtctcgaactcttgacctcgggtgatctacctgcctcagtctcccaaagtgctgagattacaggcatgagccatggcaccccgccccacaggtagatatttacataaaactcagcatccagaccctaaggtcgagcccaccctcaagtctttaggaaaattcgagtgtctttcagtatctgggcttcttttttaggggggagctagatccaccataaacattttatgtgtatatgtacaccgtttatcatatacatattgtgacaactgtatatatatatatatattttgagacagagtcttgctctgtcacccaggctggagtgcagtggcgcaatcttggcttactgagaccaacctccgcctcccgggttcaagcgattctcttgcctcagcctcctgagtagctgggattacaggtgcgccaccacacccggctaattttttttgtatttttagtagagacagggtttcaccatgttggtcaggctggtgttgaactcctgacctcatgatctgcccgcctcagcctcccaaagtgctgggattacaggtgtgagccaccgtgcctggcctaaacaacttgtatgtatacatacactgtttatcatatatacgtattgtggcaaccatatgtatgaataagccttcaaaaggtgagcacctgtatttcctggtaattgacaatgtcagttttgtgtgatgtagtctctatggaatttcccgtacatatgatgacagaaacaaagactgaaacatggttcacagagaaacacagaacatacatgactctcagaataaccatgtctgctgctgtgtagggaactctttgagaggaaacactttcactgctggcctcaaatgccactatccacttaggttcttcagtgtgaacctttaattcaaaagtaccttccagctgatcacgaggaacctttatcgcttgcacctgaggaggtcagggctgcagggagccctgattgtagcactgcactccagcctgggagacagagccagaccctgtctccaaaaaaaacaccatttacagtgacttagaaaagggacagtttccagtgctacacacaatggttccatacacagcttaaaggtttccagttctttgctggaacttgatttaatagttgagagccacaggcatcggggctcctgaaggaggggcacgcgcccatcagcgctgtcagccggggatggcgcagaccccttccttggcttggcaatgtcggagacagttgttatcgcaactttgggagagaatgctcatggcatcgaggggataggggccagggatggttgccaagcatcctacaatgcataggacagcttccccccgctgcaaaggaagaattctccagccctacgtcagtagagttgagcttaagaaaccctgctttaaaccaggctctagacttccaagggttcttacggtgtcctttctaaattgatcaacagaggccgggaggatgcgggagagagtgctggaaaagataaacttactttctaacaggcgaggctgtgttgttggttctgagtttctgatctctcgttggtgataatggtaagaaccttagtgggttccaggctagttcatctccctgcaaaaccttttgggaacttgttcaaaattggtttgggcttgagtgggcagtttgtgagtttttacttcttgtcatgaactggccatagactggttgagggcctgagctggggaaagttgaatcatctggaagaaagcagtaaaaagccgtccgtcatggtcccatctccctggttccctcctttctgcctgtgtgacacccactccctcaagagcctcctggcatccgtgcgcagctagaactgggggactaaggagggtgaaagaatgcggctagcgagagctgctctcagaagttcccttggtgtgctgggggtttgggtgacattatttccaggcttaagctgctaactggcttcctgataaatcttgtggccgggctgtgtgagattgagagtgtaactaggggtagagctggcagctgcctggaatgctggctttttttttttttttttttgcctgaaaggagggagagggtttgaacatttgaatggaaagattgcttcagactgagctaggagggacattcacaagcgtcacctcccatagctttgaaatctgcctgatgctccttaggccctgggtttgtgcctaggagaaaaggagaggccagtggggttgggggaggactgtctgccgggggatcctgggccccacctatttgggggctgtaggtcagagtaagcagtgtctgggacatggctggtgtttcagaatgtcaacgatactgcttgttctgacctatttttatttttatttatttttaaattttaatattaattttttgtttgtttgagacagagtctagctctgtcgcccaggctggagtgcagtggcgcgatctctgctcactgcaacctctgcctcccgggttcaagcaattcttctgcctcagcctcctgagtagctgggattacaggcacataccaccacgcccagctcatttttgtatttttagtagagacggggtttcacatgttggtcaggctggtttcgaactcctgacctcgtgatccacctgccttggcctcccaaagtgctgggattacaggagtgagccactgtgcctcgcctatttttatttattttttaatttttttgtagagactgagtctcactatgttgcctaggctggaggctccttaaaccccaccactccaggtcttgaactcctggactcaagtgatcttgtctcctcattctctcaaagtgctgggattacaggcgtgagcctctgtgcttggccctgacctttttttagtttatttatgatggtgtttttttttgtttgtttgttttgttatttttgttttttttgtttttgagacggagtctcacaccattgcccaggctggaatgcagtggcgcaatctcacctcactgcaacctccgcctcctgggttcaagcaattctcctgcctcagcctcccaagtagctgggattacaggcatgtgccaccacgcccagctgatttttgtatctttagtagagatgaggttttgctgtgttgaccaggctggtctcgaactcctgacctcaggtggtgatcctcctgcctcagcctctcaaagggctgggattgcaggtgtgagctaccacgcccgggttgttatgattttttaaaattttacgtatttgagatgcagtcttgttctgtccccactcccaaggtggtgtgcagtggcacgatcttgtctcactgcaacctctgctgcccagttcaagcgattctcctgccccagcctcctgagtagctgggattacaggtgcctgccaccatgcccagctaatttttgtatttttagtagaaacggggtttcgccttgttggccaggctggttttgaactcctcaggtgatccgcccgccttggcctcccattgtgctgggattacaggcctgagccacgtgcccggccctgacctcttttttaaaacctcactttgtggggccactcttggttttcctaccaaagtgcttgacttgttaagccataaacatggaatgatcttttgtgtgtgtgtgtgtgtgtgtgtgtgtgtgtgtgtgtgtgtgtgtgtgtgtgacggagtcttgctctgtcccaggctggagtgcagcgggccgatctcaggtcactgcaacctccgcttcctgggtccaagtaattctcctgcctcagcctcctgagtagctgggaatacaggcgtgcgccaccacagctggccaatttttgtatttttagtggacacagggtttcatcatgttggccaggctgttgttgaactcctgacctagtgatctccctgccttgcctcccaaagtgctgggattacaggcgtgagccagtgggaataatcttaagatacaaaaatatggggttcataaccccttcaccttggcacagataaaagtgtatacccttgtgctgggagtgacaggtagttgagaggcacttttgtgtgggctggtaagggccggcgttggtgattcagaggctgtgcccgggacaaggccggtgagtccagcagctgcaggctgacctccggaagccccctctccctcggggaggtgttggcaacagatgtaggaagggactttgctttgtgatgtccacgtatgatgggaatggagttaagtccgttcttgcaggaagctctggtgactgaatccaggaacgtgcggcatgtactggtgtgtgccttgaggcattggagccggcattggagccggcggcgtggaccctgggccaccccaggacaggcagggctcactctgtttctggcttgcagacgggtggaaccagcagctgtgtggaggcctgaactgtgtgccagctgggctgtgcagacacagaagtttgagactgcctttccccaaaggaagctagaggctccttacaccccacggctccccgggcctgtctgtgaaacctggctcacctggcccccttcacagggttggctgttggtggtcactgggcactttgtaaccaagcagcatcctacgttttcccattcttaacaaaccaggaccaaggggtcatcagactccgatttctgccacccgtgactgctgtacagtaggtcccagaacaagtcaagggctgaaagttcggctaaaagtttgtctctgactcagaatcccgtgttcaccaaagaccagttggggctccgtgggtgctgatcgccctgcttatctgggtgtgtgttaaagcccagctctgcagtacttaattatattccaggtgcccctaataacagcctgcgagtgcgagatgaggtgtctcaccttatgccgctcagttgaagaaattgggggctgtcacattttgacaccccagacctatcaagcacacagagaacatgacactgctcaccccgcccctggccacccaggggtggccgctgtcacgtgcgcagtgcacctgaggtctgagctggcagctgggcccctcagatgtctgtgtgtgtgtctgttgcattttttcctcaaaggagaaacctgcaggttgaggcccgtcccgctcagacctgcctgtgtctctgtgtccagtggactttaatccaggggcctagggtacagccaagccttcactgctgccttagcccttttcctcctccgtgattgtttccagtgttttgcaactgatctgatctggggaaacgtcgtgtttaatttggagcatgctgccaacgtccccagtaggatttcggaggcagccgcaggtttcggcgctgcccggggcagagcttagaggagaagctcagagcggcctccatgtttctcttttccaagcccctgaggtctttaagtgccgggagggttggaaggggaagcattgccccggggtgggggtggggtaggtgtcaggagctcaacaggctctggaggcatctcagcaggacctgagctctccaactctaatggctttttaatgtgtgagctgaagtgtcagggggcggtctcttctggttctttttcgaagctgtccctggaaagcggatgaaagaatgtggtggccagggctgcagcgggtttccctctctcccttctctcccctcctctccctatctctcccccctcttcttcctctctttctgttctcactcttcccttgtctttctctctgtctctcccttcttttgccctctcacctcttcttcctctctctctgtctgtcctctccacaccttcttcctgtctgtctgcctgcctgtctctctctttctctatctctcgccttttgcagggctggatttggcaagcacttttcctgagcactgcagcttggtgcgtttctgctcatttcctgttaagcagtacccagggctccctgaactcaggctctgggaggacggccctgtcttccttttcctctccactcctagaaaaacctgctgaccaggccctgagagcagggtcacggggagacctcctcaccacagcaggaagatagacggacagtttcctccattggacctgactcagcagcggcccactgaccgcctgggagggggctcccgcctagcgggccgcagttccacacctgggtaaggggacgaagcacccagcaggggtcatgccgcgtgtgacacagtctgtaggggcggtggtcatggcagatactcagaatccagatggcatcaggcctgcgagggcatggggtgagtgggcccactcccctccctgggccgggaacatgcgtctcctctgccctggcccccaagtggacagctccccacatggtttcatgccaatgggagtgattattccattgccgttgccactggaatatgagcccattgccgccggagccaggcatttgtgctcattgctgcatccccagtgtttggtttactggctggcctgccccagggagccggtaaatatcacatggaaggacggatgggccaccgtggcccccaccctacagcggatggcctcgtgtcgagtttgtgtgagcacgccctagaggaagagaagcaggtctccacctggcccagggtacagttcaagctctcagccgaatttcgggagcttctggagcccctgccttggtcccaggtttaaatgctactcttcccctgcatgggaactcacacagtcagtccctcccgcccaccctgtgtggggccctgtactctcctgcctcctgtccatgtcaccggcctctcctacctcccaacctcattttctctccacttcctgtctgccctataacgaacgcgtttctatctccccttatccttggcatcttccggggatgcatgtgggaactgagttctcagcccttggagcttctggcctcggggtcccccacccagatgccacacgctggtgttcgtgtgaggtgctctcctcccatcggacggcagctcctgaggctgggctgtgctcgggcatgtgtgatgggccatgttctgctgggcactggcctgctgatgaggttgccagagacgccccctacagaggctgagctagagggctccttctcagagtgaggggctgtcctccacagggcccctgtggtgtccctggtggtggctcaacagcagcccctggtccgctggccaggcatctgaccaggccgtgtcacagcaccagggaggcaggtggctgacaaggcctcggagaactcggttgggaacaggtccgactgctctgaaaaaatcaacagctcagagagtgtctcctgtggtttagggtgtgtgtccagctccagggctgcagctgacagtcacctgaacttggccaggtccgagggcctgactgtgtcacaggcagtctctgacccagagcctgcctgagcagggtccctaagaagccaagcccagacgcctgcttccccccttgatcgaggccaggctgaaatgcacctgctgctgcccggctgggccggtctgctcagagttggtggttccctggcttgaatgcttccccaaactaaaccactcccagcctccagaaactggctccccagccctgtttgccaagattcttaggacttttgccatggctgggcctggccacccatcctgcagctctctccctggcctctgtgcccagttgctgcagtgacttctctctgattgccacaataggccctgcggctcctcccacttctccctgtggatggccccttctgtctctgagcctgctgtctcctgtgcttccgctgcccctctctgtacctgtcttctaagcctgcgtcccctgtcccagcgttcaaatgtgacactcccacgactcgcagaccacagcaggcagctggccagcggtgatgccctgaaatgacagccagggttcatcgcctgtccttcagcttgaacccattagctgattcggcctctttcctcttaaattacttttattttatcacttttaaaatgtattttaaaggggatcgtggtatttttccttgctcaataacagtaactggaataggccggacacgatggctcacacctgtaatcccagcactttgggaggccgaggcaggtggatcacaaggtcaggagtttgagactagactggccaacatggtgaaaccccatctctactaaaaatacaaaaattagctgggcgtgggtggcgcatggctgtaatcccagctactcaggaggctgaggcgggagaatcgcttgaactcaggaggcagaggttgcagtgagctgagatcgcgccagtgcactccagcctggcgacagagcgagactctgtctcaaaaaaacaaaaacaaaaacaaacaaaattcgtcgggcgtagtaatgcatatctgtaatccccgctactcgggaggctgaggcaggcgaatcgctggaacctgcgaggtgaaggttgccttgagccaagatagcaccactgcactctgcctcaaaaacaaaacaacacaaaaaaccccgcacagtaagtggaataacaaatacaacagcagcaaaacaatagagtgaaattttgctggataccccacccctgagcctgaggtgtgctctcttgtgaaagagctgttcgggctggacgtggtgattcttgcctgtaatcccagcacttagggaggctgaggcaggattgctttagcccagttgttcaagcccatttgggcaacacaatgaaaccccgtctgtacaaaaaattaaattagccagtcatagcggtgcacacctgtagcccagctacttggtaggctgaggtgggaggatcacttaagtccaggagtttgaggctgcggtgagctatcatcatgccgctgccctccagcctgggcaacagagcaagaccctgcctaaaaaaaacaaaaacaaagcctgtactatagtagtgcccacctggaagttccttcttgccagaataagaaatacagaagaggggccaggcgcggtggctcatgcctgtaatcccagcactttgggagggcgaggcgggcagatcacgaggtcaggagatcgagaccatcctggctaacacggtgaaaccgtgtctctgctaaaaatacaaagaattaactggatgtggtggcgggcacctgtagtcccagctactcgggaggctgagccaggagtatggcgtgaacccgggaggcagagcttgcagtgagccaagattgcaccactgcactccagcctgggcgacagagcaagactccatctcaaaagaaaaagaaaaagaaatacagaaggggaattgcagcggagttgtgttctgaccacgtgattcacgtgccttatgcttgtgttagctgccacgctgtgggaaatgcctcacggaaggcacgttgccttttcccttggggcccaccgccatgccctctgcagtctcgcctcttaggatcgggggatcctgcacactgggatttgggctcaggaaagagggctgatgggttggtaacagccaggtcctgagtgcctggggaaaggcatggaagctggagacccagcagtcagcattcttaaggagttcccaaacattgttgggcacggtggctcgtgcctgtaatcccagctctgagggaggcagaggcaggaggagcgcttgagcccgggaatttgagatctgcctgggcagtatagcaagaccctgttctccaaaaaaaaaaaaaaaaaagtgaaaaagaaataaaaaaaaaaaagagttcccaaacatcacccaagcagtaatgcaaatatcttcctccaggacacccccatccagccctgcgtgctggaagcagaactgctgactgattatttttctgctgtcatttcgggactttgccccagcactaagcagagacccttattctcaggaagccccctgcggaaggaagctctgggaactttctgcccgccctcgccgcaatcccttgccacccgcctctgtgggatgaggccccacagctgactcaggcaggcatccatcagcctaacagcctcactcatcagagtcccgattgtttgaaacagatgggcagccctggcccttcaaggccagcctttgtggctcagaagagggcagcccagggacctggttggaatttccccatctcccaaccttcacccaccctggcataagatcatcttcatcctctcctgaggcctctgatggttttctctaaggttgagaatccctgctattattttaggaaggaaggacaacccccagaactgcagagtatcttgcttcttgctgactctggtcaagtcagcgttccacccacgaggagccttggagctgtcggacccctggctgagcgtagtgtgggtgtctgggaggtatgtgctgcccactgcagaggctggctcggaggccgctggaatgctgcgctgtgccctagcttttacatttttatttcatacttgcagaatcctgtgtatttttccagtgttctcccactcccagccttcccacagcagcctccccggctagccccagagcactctgtgcctgtcagaagaaggcaccagtgggcccctctgttgagtggggtccctgtgccacctctagactggctgagggttccatagtgggcagctgcacagccagggagggtctttggggcccggaaggaaagagtgctgctgggagggagggcaggagaaagacctttggtctgcctgctgcaatcacgtttctggagcccaggagtccactcggctgtcagaggagccggtagggggtcgccctccttccaggagaggttgcctcttactgcattcagaacacattccctgggccacacgctggtcggcaccagtatgtggcacagggcacctcccttgttcaggcacctcatgaaggttgtatcataaagggtttcagatccagaaaggcagctaagaatgaccagcagatgagcaggtgcccccaccccatcccaaggaagccagagcagggccggcgtgccttcactgcgcacgttcactgcgccaaaacacgcagggttgtgtggcggtccacactgcctgtcaacaggatcacgtgctttcttgcttggtttctcgtaccctagtttttttttttttttttgagatggagtctctcgtcacccaggctggagtgcaatggcgcaatctcagctcactgcaacctcccgctcccaggctcaagcaattctcctgcctcagcctcccgagtagctgggattacagacaccaaccaccacacccggataattttcatatttttagtagggacaaggtttcaccatgttggccaggctagtctcgaactcctgagctccagcaatctgcctgctttggcctcccaaagtgctgggattacaggcgtaagccaccgcacctgctcaccctacttttaggctgagcactgcttgtgagtaccgttcacactgacacacgaggctccactcgcatccgcagctgcgtggctttccctcgtggttattccacagtgtgtctatccgttctccagccagtggacatttagagtttccaagtttctgcattttcacacagcctggcagtgagcggtcccctgtggcatgtatctgagagcttctccagtgcggtaccttgcttaatatgatcatctgctgtagtgcttgatgactatgcccatgaatagccactgcactccagcctaggcaatatagcgagaccctgccttcaaaaaaagaaaaatagccacataggttttcagcagtcctagcctggaaaaaaacaacctgttcaatttgcatgaccgaaagtcctggaccggtggctagcaatatcgtgtgttgcgcactcgtaaagtgtgttatttcaaccctcctccaccgtgctgtatgtgcctgggggccttggccaggaagccaagtgggcggggaggaggctcccagctcagggttagctctgtgtggtccggagcgggatgaactggggggctcctgcgccatcagctctgaggactctgcttctgctgggcatcctcctcacggatgtaacatcccctccagcctgtaaattcctctggagcctgcgttttcagttttgttgtgtacagtgaggccgcgctcacagaaagcacctagcacccagccttgtcgcagagggcagcttgggccaggactcacgtgctccctgtgcaaattcacctacttgataagattgatttgtagccccaaatcattccttttgcagtcttttgcagacaagtgcagagcagcaaaaaatctgtcacccatcgcatatgttcctagccgaggtcaaacaaagccacactgccttctcctagctctcaacgctgtgttctggcgtggatcactctgccttctcccggctctcgcattgtgttccggcgtggatcacgctgccttttcccggctctcacgctgtgttccggcatggatttgcaggcttttagcgccatgtttctcacatttttgggattttgttggtgatttcgctgttgagaatggtcccagcatcatgcagcagtgccgtctcgtgttcctcagtgccaggaggctgggatgagcctcacagagaaaccatgtgtgagagcagttctctcaggcaggagtgatagctccgtgtccatgagttcagtgtgggtgaatcacagtaaatatgaactaaggaaatacgcataaaggacaggtgcagcggctcatgcctgtcacccagcactttggaaggctgaggcaggaggatggcttgagcctgggagtttgagaccagcatgggcaacaaagtgaaaccccgtctctacaaaaataccaaaaaataaaaaataaaaaaaaaaataactctgtgtggtgatgcacgcctgtagtcccagctactcgggagactgaggccagaggattgattgagcttgggaagtcaaggctgcagtgagccatgatcacgccactgcactctagcctgggtgacagagcaagacctggtctcaaaaaaaaaaaaaaaatgtccaggcgtggtggctcatgcctgtaatcccagcattttgggaggctgaggcaggtggatcacttgaggtcaggagttcgagaccagcctggccaacatggtgaaaccctgcctctattaaaaatacaaaattagccaggcgtggtggtgtgtacttgtaatcacaattactcagaagcctgaggctggagactcacttgaacccgggaggcagaggttgcagtgagccaagattgtgccactgtactccagcctgggcgacagagtgagactctgtctcaaaaagaaaaaatgaaatacacaaaactgggttacatagtgaccatttgatgaacatgttgtgagcagaggctcacagaaacctagctgtgtgtttcccctctgaacagtggctcagtactggccaactctgtgcttgaggtagctttctagaacagagctgccacgaataacgagaagtgatgagctcctgtggcaagcaggacagcacccgccacggctgcccctcacctccacccctggaactgtgactgttcccttacatggaaaatgggactttgcagatgggacaaagggtacggacctgggggtgggagattatcctggcttatccacaagggcccagtcccatcagaaggccctcagaaagcggagcacctgggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccgggcgtggtagtgggcgcctgtagtcccagctactcgggaggctgaggcaggagaatggcgtgaacccgggaggcggagcttgcagtgagccgagatcgcgccactgcactccagcctgggtgacagagcgagactccgtctcaaaaaaaaaaaaaaaaaaaaaagaaagcggagcaccttcccctgctgtggtcacagggagctgagacaacggaagagagaacaagagatagctgttgaggggccagcgcctgctagctctgacaatggagggaggagggggccgtgagccaatggatgtgggtggcctctggattctggaaaaggcaggaaagccccagaacccccagaatagagtgcagctcatagtatctcaatcttagcccggggtgatccctgtcagggtctgacctagtgaagactttgtgttgctttaatatgtcgttgaagacgtcgtgtgtggctgtaagtcactaggtttgtggcgatttgttgtggtcatcgagaccatcctggctaacatggtgaaaccccgtctctactaaaaaatacaaaaaattagcggggcgtggcggcgggtgcctgtagtcccagctactcgggaggctgaggcaggagaatgttgtgaacccgggaggtggagcttgcagtgagccaagatcgcgccactgcactccagctaggcaacagagcgagactctgtctcaaaaaaaaaaaaaaaaaaaaaggcgtgtggggggtgacagagaggcgggggaaatgaagagaggcagagggggtggagagggacaggggagacagaggcagggtagacagagagaggcagggggaacagagagaggcagggggacagagacgggagacagagaagcagggggacagagaggcgggggagacagaggcaggagaacggagagaggcagaggggacagagagatgggagacagaggtagggggacagagaggcagaggggacagagagaggggagacagaggtagggggacagagagaggcagaggggacagatgggagacaggcagaggggacagagagaggcagaggggacagagagacgggagacatagggggacagagagaggcagaggggacagagggagacgggagacagaggtagggggacagagaggcagaggggacagagagagatgggagacagaggcagaggggacagagagagatgggagagagaggcagggggacagagagagtcaggggagacagaggcaggggaacagagaggcagggggatagagagaggcagggggacagaggcaaaggggacagagagaggggacagagagaggcagggggacagagaggctgggggaacagagagagggagaggaggccggtggggaaacagagttgttttttcctctgttagctctcatccctgaaatcaacaaggaaataggaccggttcactttgccatgttggcttgaggtgccctgctaagagctggggttccatccagccttccttggctgtgacactctgtggaactaatcttcaacttcgcagaagttgttccctggcctctggaatcccaccttggtgacttaaaagctagtggactgatagaaaattcagtccccgttacttaacttggattttgaaaaccgtcccctcattcaggtttacacagaacatgctattgcccgtctaagcctgaggggaccacacaccccagaaacaccagagcagatcatgttcaaaaccgccgactgtcctgaagacagttgacaattcatgagtttgacgcacgttttttccagtccaagagctggagccagatacccacccgtgacgccctcccacatcttccaaacgggcacttccaaaccttgtcctgggcatgtttccaagccagcctcactgctgcaggctcatgtcatgccctctctcctgcgtgctcccagatcccacccatccttaaaagcccacggccacggccacctccttcctgcctcaccctggctccctccccgcaaggaggaagcggcccctccccgctggcgtcctgtctgtcatagggccttaggttcttgtgtgtgtgcgagcctgggttacgtgtctttccttttccactgtacctggcacaggtaaatactcattcagcctgacttggacctcagtgatggctccagaccgtggctttgaagaatgggcagaatttggatgtaggaagaagcaaggaaaggagggagagtttccggtgcagggagagagccctgccctgggcatcccttaggcaggtgttggagggaggcccccagcactggggccccagcagcatgggtctgccctgccgtgtccttcccctccaacctgagcccatgcagcatccgtggggccagtccttccagggaagtggaagccaccctgggaggagcctggctaccagaccatgatggcagggtgggagagatttgaatattcttactgctcgtagctcaggaagtggcagcaccagtcccttgtcctttggggcgatgacaacagagaagcaagccttggggggcagggctgctttccccccaaaatacaagtaagcacaaggcagagcggcgtgctttgtgttgacgtcgcagcagcagccatcctggcagtgaggggtcacagtcacggccacaggctcgcccatgcacagaggcacgttctcgaaggcaggaagagcgtgggtgtgcagaggtgcagggagggcgggacatccccagggaaggagttgcgttcaggatgggcagctgtgccaagttcccagctggtaggaagacaggaatgcaggttgattgggaaacaggagagagggcgcagcggctgtggcagctgcctggggtgtgagacagcagcaggtgtgtgtcagggatgtggggaattttctaccaaccttctttttaagttgagtcattttctctcttggtcctttgctgctttattttttttttttttttgagacagcatcttgcgctgtcacccaggcaggagtgcagtggtgtgatcttggctcacagcaacccccacctgctgggttcaagaaattctcctgcctcagcctcccaagtagctgggattacaggcatgagccaccatgcctggggtttcaccatgttggccaggctggtcttgaactcccaatctcaggtgatctgcttccttgacctcctaaagtgctgggattacaggcatgagccaccaagcctggcagtcctttgcttctttcctcccgccctcgtccgccagtagaacctcagaatttgtgtcacggccattgacaaatatgtcccgtgctgtgagcattttggaaccgggacttgactctgtggctgatctggaggcgctctgggcgcaacatgagatttcgtgcacgatcagccagctgtagccagtttttcctggtgtgcgtggtcctgtgagtgcctcaccagggtcccttggagatgggtgtgactcaggtaaggtgtgttccttttcttcttcttcttaagggcctgcatgaagcctcttgctccagaaaaactgggctcagaggcagtgtcgtggggcggaggtgaaacccctggccggccccacacccatcattcctcgggactcagttgctcagtgcacagtagcctaggatcgtagggtggtgtatggtttctgttttttttatttttattttttgagagagttttactcttgttgcccaggctggagtacaatgggcgcgatctcagctcaccacaacctccgcctcccgggttcaagcgattctgctgcctcagcctcccaagtagctgggattacaggcatgcaccaccatgcccagctaatttttgtatttttagtagagatggggtttctccctgttggtcaggctggtctcaaactcctgacctcaggtgatctgcccgtctcggtttcccaaagtgctgggattacaggtgtgagccaccgcacctggcctggtggtgtgtagtttctaaagcacatccacgcctgagatggttgagaaaaccgaggctcagaggggtttgcgttcctgctcagagtcacagccccgaacggcagagctggaaccacatccagtcccggtgtcgcccatccaggcaccctaatcccacgtcagcctgcttgcctcgtggcgttacggcacacctttgctctgatgtgttactggcacacctgagctcccgagggcagggctgcttcttatttatttgttatctcaacaactagtatttattatctcaccatatactcagtgactgacgccacctgggtgccaggccctgtgctgcctctgccacccctgtccctgtgcctggccctgctggcaggaagcttgtgtttgaggacagagaacttggggtgggttggcgacgagagcctgtcccgagtggtgtccctccaaggacgatgatccacagcggggcagaaggggccctgggaagcaggctgcacccgccagaatctcccaggcccgggacccaaacgcgagtcttcagacaggagaggctgcagtcttctcgctgcaggggagatggtggggggactcgggccatttgcctgcttcctctgtgctgaggccgtggtcagcaattctgagattcccagcccgggtttccaccaccgacatcactgtgtaaggagcaggcagtgcctctgagcggccaggggcacccatgcgccagagccagtgcacgtgacctggcgagggggcaggagtggccactgcaaggtgacagctgctggcacctaatgctcgcagagggccccagtgcacaggcgcggctggctgtgcagagctgctgaccgcctctcaccaccccctgccctgccccgtgccacccgggatgacttctggcctgggtgcttttggtagccacacctcagaaaacctgtcttcgtgactgtgggccaccatgggcatgagtcacctgtcaccagagcctggtgtccctgtgtaagtgtgccagataggcagaggagacaggtgaaggcacattcctcagtgcccgctcacagctctgcccaccacgcattctgtagagaacctcagtgccctcctccctgctggcagccaggcagggatttaggcggtttctgtttggcctccagtgcttgcctctcccgtgtcctatccgcccagacctcagacctgtcactgttcccgggcatcctcctggataagaaactgcccaaatgtggtagctgggtccccaggatgtgagtcaggctaggcctgcctagctcacgttttgttctttgcaaattttcccaaccttgcagctctctggggagggagccagctccaggctgggaatgggcctggcggcctccatcagtgtcagcccaggtgaaccgtccacgagccacaaaagggaaggtgatgggaggagtatcatctggctgccttccgggtcactgcggggagttgctgcccccggagcttagctgctgtcaaggggtgggatgtggcgaggacccccaagaggttgcccggggtcctttattctagggcgctaagcattggagagtgcttcctgtgtctgagacgggacagcaggggacccgaaaacaagcaagcaagaggaatgcgaggccccgtgaggatagcaggagggtggggcagccttgcagccatggggacatttggatggacagagccctggtggctaagacccagcatgggaagatccagggaggctcagtgagggagaaggaacagcgagagcaaaagctctgaggggagatgggggggccgcccaggcagatgggggtgtaagatgaagtgtgaaggggcaggcgcacgagagaggaggcatcagtggtgtgttgggagaaggtgaggagaccagtgatggggatcaatcaggagagcttcctgtgggaggaggcttctctgaggtctgaggtctgggcggataggacacgggagaggcaagcactggaggccaaacagaaaccacctaaatccctgcctggctgccggcagggaggagggcgctgaggttctctacagaatgcacggtgggcagagctgtgagcgggcgctgaggaatgtgccttcacctgtctcctctgcccacctggcacagctgcacagggacaccaggctctggtgacaggtgactcatgcccatggtggcccacagtcacaaagaaatggaagtccttcagaaatggaagggatcttagagatggtgaagatggtttctgtgtctcaggaagggctctgggctttcgggcaagtctcctcagctctcagggagtgagggaactcacggcccctcgttgagatctgtgcacctgcagcctctcaccgctgtcaccatgccccgcagttctctctccaagaccatttccagtctcttcctgcagggctatgcattgcctcagctccttttgaggagctgttgagaaaagatcgttttttaagaaagccttatcgttcctgtgcatgtgggtgatgtcatcacactctgccccctggacgcagatcctccatgctgcccccagtgggaacaccagcctgtgctcagtgctgcagagctggtgtttccctgccaggcggagcctcaggggatttatcgcctcatttgtttgtgggttggctttttccttttataagttttcatcggaaactgattttaccagttgtatgtcacacagccctcctgcctggtccccaagatgagaaattacaatgcatgatgcatgaggctgattttcatgtagatgtgttcgctcgggctggagctctgggtgtggtttgttcctgggagaggagccccaggcactcactggcatctccatgtttggatgaaaccctgtgcaagggcaagggtgggagcgtgtgtcccacatagctgagccccctggttggcaggcctgtcctcccgtctcctgggaaggtagcatgagcttcccacctgctcccagattcctcgcccagccctggggcgttgcccctccccttccacctgccctgactgcattccaggcagagccagggttggtggggcctgcagtggggatcccttgaccttcctagccactcctgctgtctggccttgggccaggcatgtctctcctaggcccttagctgtcctgtttatcaagtggagacatctgcccagaggcggcagctgggccaggtgggggctggagggcccggctggctctgtccactcctctcggggttgtcctggagctctgtggggtcagcctcgcaccacagacagtaggtcccagctttccacagcagagggcaccccttctcccccacgcatggaggggcaggtgggtctcgtaggtgcccgaggggagcaggtcgggctcagtgctctgctgcctcctgggcagactggtagtggtgatgggagccccagggctgccggtcattagagccgagcccaggtcaccgccctgccaccatgtgctgggacagcgtgtggcccatggcttctgccagacgggcggtgagggagcccccaccattgggcagcactggccagcctaggccccatacggccaccaggcgcagcccgcagcctcccccacacccatgtggagctgggccaggcagggtgcgtcctcggcatgcgtttccaaggactgctgagtcacctcaggggtgactcaggggcccaggggccaggccagagccaagggggacagcaggggagaggccgggctgcaaggccacagcacgggaagggcagcatgcggaccagaggccaagcctctcaatgcagacgagggccaggaggccagggaggaggctgtcccgggagaaacgccgattgccccatctagggcggacgggccaggttcgggctggtggaggccttccgggatgcaggccctgcacagggttccttagggtttaaagtcagcagccagagctggaggcctcatcagaaaggcagtgtgggctggactcccgctggtgactttgctgtcagcacaggagaggtccttctggccctggggctgccctcacggagcctccggccaccagaccatcatagaccaggcctgaatgtcccctttctctctcggggatggtcacagagctggcccctggcccctggctgccactctgttgtggccaccgctgagcaatttcctgtcgtggctgtcaccacttcgtctgcgtgacttctttccagtggctgattccctctctgcttccagttcccctgatgtgttggcctcagactcttggatggggcctccagggcccatctggaggatttctcttgcctaagtttttttctccccctcattttcatgtgctgtgacttcaaatgacatcggctcgctgccgcgcacacaacaaagcatttatcgctctctgccaatctgagagtcctttctccagctccaagagccaggagtcaggcagggcagggcccgacagcctgagagacggcatgaatggccagcaccacagttggcagaaacgcacccccaaggcgatttagactgcggtggccgggccgcaccatggcccccaatgtctggctgtctttccctaccatggcacccagccacacctctggccaggaagtctgtggcaggcctgtccccacagcctgggggccgtggggaagccgggctctcagggggccctctgtggcctggtctgaggcagagcccattctggttccagtccagagccggtatctcggttgccagcccaggcccaagggactgcccctttggctgagaggacgcctggggcttccagagccactgtccttttgctgccagagcttggttcccagaggagcgcctgacccgccacagaggtgggtctgtggctgtccccgggtgcccaatctggccatggtggcagcgtctggtttggggtttccgtgagaaaataatttcagaaactttgtcttgattcattgttttcagtgcctccgttcccaaaggctgctttttaaaaaccattcagccttgatggacaggaggggagatctctactgagaggctggaggctcgaaggacagtggcaaatccagggctctcagaactcccagatgctgaggggagccccggctgtcgggacccttccctccgtgcatcacacacagtgggtgatgacccagtcagccccaaggcagaggctccctccatcttcccttgggctggggagtgggtttctgccgtctgattcctcgccgccgggccatgaggatcacctggcacctgtgagggtcacttggcacctgtggtgctcctgtggccccccctcccactgctcctctccctccccctcctggcctcatccctgagcatgtgcaggaatgactactcctgcttttcacctgcggatgccctgcaggctcccagaccaggagcccaggggccacaaccccacccatgccaggcacttactgtcacaggaaagctcagagctgcctgcagccagcgccgcccctgtagataggcgagctttcatagtcagcacgcaagggcctcaggtctggagagtccccatgccactggggccactgaaggtttccaggaaggacagacagacacatcagcaagccaggagcctgggagcccacatggaaaaggggacacgaaggccagtggcttcctgtgtcgctgggcagcaggccgcctccaggctgtgcgcgtcttcgactttttgactcatgggaaagaagctgtgatggactcgaggtggccatgtgtgttgggcagtggctcccaggtgttgggccagcagggaagggcgttgcagatggaaaggggttcagagacacacggatatgatacatccctacatcctttgcccctgccctcttcccacgtcagggctttttctacaccacagggatccttacgtccctccctggggcctccaccccgaccctgtattccagctgttttgcacagaggtctgataaggactctgctgcttctgcaggccttaccctggctttgcccctttccatggctgaccaggccttgaacacagctgcagtgttagaactgcgcccactgtgaggaggggctgagcactcgcctcctccacgtccccttcagcttcctcctctgtgacgttgggggccgggcacagagtgcctagcatgggggctggcacatgggactgtgaatagtggcccttgttccgtgtgtcctgcctgccctgtccctggtcctgcaggtggctgggcctggaccccctcctatggtccccagctccccaacccatgctttgtcctggggctgttgtcccctagtcctgtaaatgtatggccttggccaggcacactgtgtcatgcctgtagttttggcacttggaaggctgaggtaggattgcttgaggccgagtttgagaccagcctgggcaacatagtgagacccctgcctctttaaaaagaaaaaaaaagatgaggccttgtcacaggtattcgctgcggttgaccagccgtgcccacctgccatttctccgctctgtgcctggcactgggcgaggcccctgtggtctgtgcgctcacagattccgctgaggaggactgcagggagggacgcggagatggctctgtagcacagcgtgcagcaccacagcaccaccgatgccgacgggcaggcagacaccagccagagacccgctccccagccgagggaggacccgtgaactctgctgtgaacctggaaattaccaagcaccacagcatgactgccagtgagacctgaggaccctggggccgacccctctgcgggcaaatgtggcgcatccctgcaggctgggccacagcagccctcccttgccctcccccacgctggctttcttctttaaaagagaaaaaaaaacaaaaccctgtgaattcatcagagcagatagtctgctggggcaccaagcccgagacgggcatttgtgttccgtgctgtgtggatcaggtttccccgctgagatgtttaaatcccaaggctgcccatcggcagcagccagctccactcggcaggattcggaattttcctcctgctcctgccaagtggccaccacagctgtgcctgccgggcacagggcagctgcccacacccctctgggtaaaacctgggattctcctgcctacggtagccctgtcctgactctcagtccacagtgtcttcacagttcatttctgtatttttccaccttgtattctctgttctgtgtgtcacatcccttgctcccctccaaagagagccaaaggtctaaactctaatgaatgccaggcttcaaaggaatagcccccttctcccagggggacaagagtcccatgctctggggcaaaaccccatcttcgtgtccagcttgctcgtttcccaggtgcctggctcacaggtgacagagtacagggtcaggcagaaaatccatgcggcatgcaggtggcgggtgcaggtgggatgcgtgagcatagagtgggcaggtctccgctgggcatctctgggcaaagatctgaaagaccacaagccagtcttgccaaaccctggggaagtgtccggcaggcaacagtgggatccttcccagaggccactgccaggcctgactgagccggggcctctcccatagtgacttctcagccctggtcctcgcctggcagggttggccaaacctcacttctccctgctccaggcggggacatgtcacagcctctgtgggaggccagccggcatctgaagcaggggcagagtcttggagactgttccctcttgggctcggcctgtttgttccaggcatggggagagaaggcgctggtgttgctctcaggatggcagcccttgtggggcctgcggttggtcactcggggtttgcagctggtactctgaccccgtccaggtggggccctgtgggagagtggggagggggcccccacccaccctgccaccctgatgtaggttcagtcagcggagggtggtctcacccctgagccctgttgggtccctggctactgagtggccccattattttcctccgtttcctgccatgcggggtgggaacaggaggcgagccttgtgggtatgggatggactcgagtgcggagctgtcattgccactgctgagtccgctgcactagtcagggctacagccagcctgcagagtctccctcggcaggaatggactgctgggaccatggcctcagtcctccctccccaccggtagggtctctgatgcgggggcattggggctggctgccccacaacaggcagctcttgcctggcagatggcaccagggttaggaacactcgctcctgacagcgagcccagaggcgccctctggtgagcctccccgtggcgcccagctctgccgcagactctcggtcccctccgtgctcagcagtgctggtgtggagaccgcagtgagtagggccccggcgggcaggagcccacgcttggtttccgcgcttgcggccggcgctgcacgtggcccggccgccttgcttttcccgtgtttcccttgtggctgctcatccctgtgtccatctgtgctggtttctagcccataagccttggagagaaggggccttacagggttgtgtcccctgcccagtgcctggcccgtgggggaccatcagtcaccacaagggacttggctggagctgagcagagggacccgggtagttagggcacagcctcccgggtgtcaggggtgcgaggagtcaggcggttgtgggggttcaggaagtcgtcctggggctcaggaaggcagggtcctggattcccaggtgagatgggcaggtggggccagggccagagccagaggccaccaggtgggtctttggtaccgtggcgggtccccagcccctcccctcagaggcaggatgtggtcctcgccggtagggcctctcctcctgccctgtgtgaggcagggggctggggaagggccctgacggagccactcctgccagcctgcacactgggtcctgcctgggcaggtcgtggggccggggtggcctccgcccagaaggtgtggtttcgcagcccgctggcttcagttctcctcccggcttcccagaagagtccagtctcacatcagccactcatttccctctccggcagccgctggctctgagcacgccctctctcgccacaatcaaaagaagtgaaactgtcccaggaaatagagtggaacgccccaaaaacacctagggagggggggctccttcctcctaatgccttcagcagaaatggagggcagccccactctcctgccccgcaagggacagttcctgcttctcacctgtgccagagtcagccctcccgcggtgggtgtgacgaggtgattttttttttctttcttctttcttttgagatggagtcttgctctgtcgcctaggctggagtgcagtggctggatctctgctgactgcaagctccacctcccgggttcacaccattctcctacctcagcctcccgagtagctgggactacaggcacccgccatcaggcccggctaatttttttgtatttttagtagagacggggtttcactgtgttagccaggatggtctcgatctcctgacctcatgatccgcctgcctcagcctcccaaagtgctgggattacaggcatgagtcaccgcgcccggccaacgaggggatttttaagaagcttccaaggtgctgtgtggctgagttgagagccaccaacccacaggcaggaaagggacaggggtcagaggcatggggcctgtgctcactgaatgcccggcacaccccgcacatgaaggcaggtggacagaaagggtcccgatgcgtgggtgaggacagtcccgtggtgtgggggcttccagagccaagccttggaggagggccaggaattccttggcaaaggggctggtgtctttttgggcaggttgccaggacacaagaccagccgtgtactccgggcaggctaccttttgcagaacttggggttgggggcatttgcactcatggtgccttgggctgtgacctccaggcatgggctagagggtacaccaggtgcctggcgtgggcagagccccaggctcaagcttctcctgcccccgcacttcctgctcttgggtcacttcctcccaggctgggtcctaaactcctgactgccctgctggacaccccccagccccacacagccaacgcagtgtggcaccacacggaccctcatggcatcccttggccacgtcttgtgacagctcggggcaggcaagcaccaatcagacctggggagcaccaggggcacaggccatggcccacggcacgcaacacctcactctcctgcccaggccgtgtgtgcacgtcttcacacaagtgatcagacccgggatgttaaatttgccgatgacttcagagatggcacaccctgtgacacttggcccccagagggcagggccaagcttgtgacctcaggcggcctccctctgggagcctccatttgtggcagggcctggcagccactcggctcttcatgaagcgctgtgtgctgggaagggcctcacactgtccatcctcactctgtgcggcatcccttggcgccaggcacacatgggatacgtggggtgaagaaagcaacgcctgtgctcagacagcggtgctggggttcagtggttcccgccatgttccatgggacatttcagggctgtttttcgcatcccaggcgctgtcagagggagtggtttgggaattcagtgcttgcttctgccttcccaccacacgaggaaagacgctgtaagtgcctgtcattgtcatcgctttcaccgtagctgagagccgtgaggaccaaggtgtgccaggcctgtgttgactgccttgtgaaactcagtgtccacatggggcaagggctgggctgtcccatcctgcagacacgggcaccagagcacaggagaatggcggcctccctgcccggctgcctgcacctcttctcgtaactgtcagctcctgctgcctctcccagccaagctggcaggatttttttttttaagtagaccccacatactcaaggatgggggcagatccccacattgctatctgtggggatgtttgtgtaggcgcttctggaagcagtgtcttctgagccatgtgttctcaggctgaggctctggactccaccgtggcccagatggggcctactgtggcagggtccccagtgggtatgtgagtggcagtcgggacacacacaggtgggcaggccacccccaccctccccctccccctgcaggcccaccctgctctgcaggcagcgtgtggccctggggtgcccacggcagtgcctgaggtgtgtgtcctgatcacttggcctcctgcctccagctgtggatgcgatgtggctggaaggcggctcagggcctcctgtcctcttcttcctcctacccctgggctcacagcgtttcccctcttctgtcctctagctggtcagtgagaaggtcggaggggccgaggggaccaagctggatgatgacttcaaagagatggagaaggtgaggaagaaactgcgtgctctgtgtggtggtggcactgctggggcctgacctctgccgggcatagtggaggcggccaaccttgatgggcctgggtctggagtgatggggcccggcaggtgtggagagatggggtggtgtgggggcctcgtcagctggacttgacgggcaccagctctctcccctgccgtgggcaggcagctgtggggacatggctgagctgaagacatggagagggggttggggggtcctggtatgggctcttagggcaggaggcggtgcagcagcgggggtcttgtgtgccttgggcccccactggctgtggagtcttatatgctgcttctcttcacagaaggtggatgtcaccagcaaggcggtgacagaagtgctggccaggaccatcgagtacctgcagcccaacccaggtgggtgctccagccactgccagggcctgccccaggccctctggcctctgtgtcagagggaaggcaggggatgacagaaccgccaggctcatgggttgtgggcttcaggcacagctggatcccggagtgcagaggccatccttggtgctgcatgctgcctttccacctcaaccagcagctcagcccctctgttggcttcactctcatgccgactggttcctcagggccgtcccagccttcaacccctcttccagccagcagtcctggcagggagcctctcccccagcttacttgtgggatccatttgtattggccgcccctccccagtgcccctggcctggacttcacctcttgggcttgggactgggtctccctggctgagagacgggcttttccccaaggaaaacccaaatgctggctccataggaggccacggacagggggcagacgcacacccagcagtgtccactcaggccctgccaggagcagacccaagcgggcagcggaagggacacagctcatcacccaccccgggagccttggcctcaaccaccccccgctgcacatcactgctgcgcctcctccctggcaccccccagatgaggggtcatagccacgttccaagaggagcagcccttggaaggaggaggttttgccccctgaggagcttggtcacctctccacccgctgccagctcctttgaggctagcaggagcagggaagggaccctctggggattccactgtgctttgtgtggcctaggctgtccacaggcacaggaagcaagggtggggaggagatgtgggggctgcagtctgccagggcagaggagtgcaggcctcacagcccacacccacctggccatcctatcccagcctcgcgggctaagctgaccatgctcaacacggtgtccaagatccggggccaggtgaagaaccccggctacccgcagtcggaggggcttctgggcgagtgcatgatccgccacgggaaggagctgggcggcgagtccaactttggtgagtggtgctctctggaagccacgcccaccgtccctggaggccacacctcaacacaggcagggcaggtccaggccctgcgtgtgctgagtgccggggacgtacagtggcccccacagctttccagctgcagaggtgcaggagactgcacagaccaacccatccagcactggccagcagctgatagggccccttcctgtagctccagaccttccccaactcaagccagctgcttccccagggcctggaccccccagcatctgtccttccacctgttaagggcaaacctaggcccttttaggagcattggagggtctggtttaacgtccagcatcgattcggattttaggatcctttgttttgccctgagttccaatttccgggccctgggcttagagtgttggggggctgttagaagttgggatggggccaagtgtggtggctcatgcctgtaatcccaacactttgggaggccaaggcaggtggatcacctgagatcgggaattcgagaccagcaagaccaatatggagaaaccccaccccgcttctactaaaaaaaaaaaaatatatatatatacacacacacacacacacacacacacacacacacacacacaattagccgggtgtggtagtgcatgcctgtaaccccagctactcgggaggctgaggcaggagaatcacttgaacccaggaggtggaggttgcagtgagccgagactatgaaaaaacaaaacaaaacaaaacaaaacaaaaaccgggtgcggtggctcacgcctgtaatcccaacactttgggaggccgaggcgggcggatcacaaggtcaggagttcgagaccggtgtggtctatatggtgaaaccccgtctctattaaaaatacaaaaattagctggatgtggtggcaggcccctgtaatcccccttactcaggaggctgagacaggagaattgcttgaacctgggaggcagaggttgcagtgagctgagatcatgccactgcactgcagcctgggcaacagcgagacttcatctcaaagaagttggaaaggatccaggtgtgggggtgaacgcctgtggtcccggctacttgggaggctgaggtgccagcatggcttgagcccagtttgaggcctgcagtgagctggtacagcgccactgcgttccagcctgtgaaacgctatttcaaaaacaaaggctgaggagtgtctcagtctagtggtcccaggcccggtatgatggcttcccccaccacttctccacaggtgacgcattgctggatgccggcgagtccatgaagcgcctggcagaggtgaaggactccctggacatcgaggtcaagcagaacttcattgaccccctccagaacctgtgcgagaaagacctgaaggagatccaggtgctgctcctgcgccagcctggggcctgtcccttccccctgccggatggggcagccccattcctgccaccctcacctccagcctcggcactgccctctgggtctcaggcaggcaggatccccagtggtgcagggacagtgggtcaaagccatgcgtggggcggccctctggccgctactggtgtgacccatgtcccccacgtctccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacgtgagtagctcggggtgtcacatcctgagaagacctatgcccttgggaggccggggtggtgcctcaagggagctggaggacagatcggcacctacctggccgctgcagcaggggaggtggagggtatgggccccagtcccctgtcccctcagcccccttgcctcctgtggcttcacctcgggagtcagggaaggcacaggacagtggcactggcaggagcccctgagccctactgtccccacagatcgagcaggtgagtcagctctcggccctggtggatgcacagctggactaccaccggcaggccgtgcagatcctggacgagctggcggagaagctcaagcgcaggtgagcccagggccttggtctctccagagtctgggctgccatgcgccctctgccagcgcaagtgggcagcacacctcgctgtggggtgagcacatggcagagcagcatcctggattcttcctggggactgagtggaaaggcctggggggccgcgaggtcagaggagctggggctctgagaactctgagtcaacaccaagccctgccccgatgcaggccccggggactccctccctggctgcacgttgctgctgccacaggaacacccaggctcccctccctgaatgcagaggccagacctgcttcaggggccttggcgtatgtggggcgccgtccgtggtggggaattgggggaggaggcaggggatgcgactgggggtgttgtaggtagatgctgtggcaggccccagctgcttggcaatctctgggatgcctccaaggtgggggtccaggctggaggccctctgggtagacatcccagtctagctgtgtcccagggtccatgtgtcacaaccccactgacggcctcttcctgcagtcccaggccaggtcattaggcagcagcataaatacaagagtggggctgcctcggccgtgacacgggctcggtccactcacgcctctcccttcacaggatgcgggaagcttcctcacgccctaagcgggagtataagccgaagccccgggagccctttgaccttggagagcctgagcagtccaacgggggcttcccctgcaccacagcccccaagatcgcaggtaatggggcatggagccctcttgcggaggcaaatgccagcgggtgggagtggccaagggctggccctgtcctgggtctctgagcgccagactcctgggtgcagctctcagccgtgctccatctggaccgccaaggcagacgggaagggctggccccagccttctgcagaaggggccctgcccgaccgttttgagcccacagcctcctcgttttgcttgtgtttagcttcatcgtctttccgatcttccgacaagcccatccggacccctagccggagcatgcgtgagtgttcccaggcccgcctcgacctcagtgctgccttctcggccattcggggagggtgtttctcctcccgccctgttctctgcccatctcaagcagggaggggccaggctcgtgcagcagtagggggcacaggccccacagcctgcaagatgccacccctctgggtctcagcctcacagtgtgaatgagggattgccaagggcactagcccagctagctctaggctgtgtggtggctacaagggcttgagggcatctggtcactccctgtcaccgcagcagcaccgggtgtccccagcacttcccaggagtagctttggtgaccacttaccaagcttctcccatcctccctcctgggtggcagtagaggccggaccccagaagtggcaggggcagggggtggcccaggcagggcagaggggaggcccatgcccacccacacgctccaggtcacagcaggtctgagaccccagactgggcggggtgaggcgtagcagccccagccccacagcccgctcccgcccccagcgcccctggaccagccgagctgcaaggcgctgtacgacttcgagcccgagaacgacggggagctgggcttccatgagggcgacgtcatcacgctgaccaaccagatcgatgagaactggtacgagggcatgctggacggccagtcgggcttcttcccgctcagctacgtggaggtgcttgtgcccctgccgcagtgactcacccgtgtccccgccccgcccctccgtccacactggccggcaccccctgctgggtctcctgcattccacggagcccctgctgccagggcggtgtctgagcctgccggcgccacctgggccccggcccttgaggtactccctgagcaggaccccacacttgggtgggggggcttatctgggtgggtggggatgcctgtttacactagcgctgactcccaacggtgacggctcccttccccactccatggcgccagcctcctcccccgctccccaacttctcgcccagctggccgaggcggggcaacactaaggtgctcttagaaacactaatgttcctctggggcagcccccacctccgtcctgacccgacgggggcccggcccactgcctaccctcgagtcccgcagccttaacaggatgggatcgagggtccccatggggtggctcagagataggaccctggttttaaatccctcccagcctggtgctggtgatgggccctggccctactccagggccaatgcacccccgcctcacacacgcactccttctcctcaaggccagggcagagggcctcaccgcctcccgggcctgctgtcagcttgcagcccggggacagaggccagctgggatctgcctgaggacagagaacatggtctcctgcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctacagccccttgcctcgtcttggtgcaggggtgggcctgccacccaccgccttcctgaggggccggctccaaagccacacacaccccaggaggtccctccagcaccccaggtgctcctgagcccaaggtgggtgggactggccctgaggcttttgtgccagttcccaggtgcaggggctgaggggtatcctggaagttaatgccctgccctggaagtgaggaagctggggtgatggtaccagcctgggcacccagccaccctcaccccagccttggggagaccagcgtggctggctgctgcttccgtttctttattacctgagcccatccggaccctcaagacaactggagcccaccctgccctggaaggctcagctcccctgcttgaggacgccgcacacctgttccaggacgtgacacaggctctggtccttgggcgtcctgctggccaaggagatctgaaacgagggggctgggcctcaggctgtgcccgggggtcctagccagccctgcgcctcacagtccaccgtgcaagtccagcatcctgactgagcccccctgagaccgaggcacagggctggggtcccgcagcacagcctgctgcttacccagtggggcagtatgtaaccgagggcctggctcccaggggcagcggtgctgtgtggaggggtggggcttatgtgcacactcccgatcctgcccccacttcagcccctccctgcctggttccagacacccatggggacaccacagcctccacagctagccgagagctgagcagaatgagtccctttctatgccaggtggagggaaaccaggaaccactaccctaagacactcaggggtggccaggaccctgggccctctgcaggggagccactcccaaaacccgctgccaggacctcatccggcactgccggagcttaaagctccacagtccaatcaaatctggcctgcaccctgctggggtggccacggggtgaccagggtcaccagtctgccagctgggctgtctcaggcccctgaggcccacggggctcattgctgccaccttttaggctgcccagggggcctctcctggggccccgttaggaggtctgcggggacttggggctcaccttaagcttgtcgaggtaggtgtgctcctggctccagggttcctggagcctcacgaggtcaggggaacccttgtagaactccaccagcagcatctacaggacagaggagcatggactcccaggctccctccaagcctgaggtacctcagcgcctctcctggggttccagtctcaggcagccctgagacatgaccccatcactaacaaaccaaccacaaagagatcacgagtgaccttagccagagggctcacctagcttaggtccaggagggctctctcgagggggaggcagcagcgttgcccaagtggctgccacgagaggtccacctggacctgcactcaccgagcccagttctccagaaccacgcgggcctgacgtggccccctggttcggcctcatccccagcagtgacacctgtgaggtcacaggtttgacgaactagtttaggttttgttgggttttttccttgaggtagggtctcactctgtggcccagactggagcgcagtggcgtgatctcggctcactgtaacctccacctcccgggttcaagagcttgtcctgcctcagcctcccaagtagctaggactataggcacccgccaccactcctggctagcttttctatcttggtagtgacagggtttcgccatgttggccagactagtctcgaactcctgacctcaggtgatccacccacctcagcctcccaaagtgctgggattacaggcgtgagccactatgtctgccttagtttagtgttttaaatgcatgttgaacacacaatttttaagtgttcatccagttaccacccaaagtccctggggtttctctactggacagcctggcagaagaggccagtgccttagagaacagcaggtggggag

SEQ ID NO: 13407 - DNA, 32616 bp, Human
atttcttggctgggtctggggaaaagccaagggatgtgtgctaaaggtagatggacagagggtgggaagtcccttattatttccacttttttctccatctctgactctgccatctctttctgcctctgtactttctgggagctggttctgctgatacttctgctgaatctaaatgctgacctaacttggcaattcttttatgttaggagtcttagctgtgacagttcatccgcttcttcgcccttccatttcacttcttttctccttctctgactgggagaggaggagcctccactcagtatttagaacagagtaaataccttctcctgatcactcctccttccaacctccagaattttttgaaattaaaattcacattctgggatcctggattagtggcctgttttggattcagtagttagtgaatatatctccactttctgttgacataggagtttccccaatgccaaagcaggtggtcattaagggagagaacaatatggagcaagagaggtggttcctgcaagagtcctaggtaggactcggttggatggaggaggctttgcccttttacaaggtcttgagttcaaattccagttcactccttccacaaatgtttattaaccagctaggctgttttgtgctgggcctttagctcctagatttctttctctgaagacagaacagaaaaaatgagctggaagtgcttcaggaggggttttgatatcaggaatgctttcctggctgtgtagagttattacctagtcaaagaagaagatgttaagctgggtgcggtggctcacacctgtaatcccaccactttgggaggccgacgtgggcggatcacgaggtcaggagttggagaccagcctggccaatatagtgaaaccccatctctactaaaaaatacaaaaattagccggcgtggtggcccgcgcctgtagtcccagctactccaggaggctgaggcaggagaatcgctggaactggggaggcagaggttgcagtgagccgagatcgcgccactgcactgcagcctgggcgacacagactccttctcaaaaaaaaaaaaaaaaaaaaaaaaaaaaaaaaagatgcctgctctggagagctttgaacttggaagaaattcctatctgctaggcgggcaggcagaagtaccatggagaaggccacagtcttggagacaggtggggaagatcaagctgagggacccgaggccaagtgtgggatgccatcacagctcagggcacaccctgaacttttccaagacaggagcacaggtggggtctggtccgactgggttccgagtccagatctagcagggaaagatgtgtgctcatcccctaccccgcactcagacatgggacacgcaggcagctaggcacacgtggatacatggaaccacaaccacatacacagaaactcaaaacacacggagagaacccacacaaccacccacaccgaagtccagcccgccgcctccgctgcactctgtaaacacgcactcacatccgccagtacagggcacacgcagccactcgtccccggcgcctgtgtgcgtgcgctcgcccttgggcgcttctgtctgtgtgtgcccccggcttccaatcgttcctttgggagggggaggagtggctgtgaggagtgagagactggcgggcaggctgaggagaagggagggagagcagagggaggggggaacccggccgggggaggaggagagaggcgaggaggcggctctggcagcgcgcggcggcggcggcggtagcggcagcagcagcggcggtgcggagagcttggactgggagcccaaagctcggctgggcagcgggagaggaggagccgcaggagctgcagctctgccagcttgggccgagcctagagacaccggcctggctggtccacgccagccgcaggtgggaagggcctgggatggggggtgagggtctctcggctggggctgaagctgagccgaggtgctgtctcctccttctgttccgtagaccgtggctgagcatggagctgtccccccgcagtcctccggagatgctggaggagtcggattgcccgtcacccctggagctgaagtcagcccccagcaagaagatgtggattaagcttcggtctctgtaagtccccggcccgggaatggggggaagggaccttagggagcctgagcgggaggaggaggggggataactggagcagggctgtgggctggtagattctctttggcacagatgttggcaggtgcgaggaagcacggccctgacacgcgtggccaggccacatgtgcaaggcatgtgcggagcaagctggccagttggagcgggcttaggagttgcaaaggtaacgatgtgcctgtgcctgtggaccccaggctgacacacgcagcgcctagaggcagcacagtatatgcagtgtggcagggctgcaggagggcagtagaggtgccaggctgactcacacatatccatgtgcagagttgtgcagatgtgagccacatgacatgtgtgtgcatgagtgagcgtgggtcacagaggtatgtggagtgattgcacacagctgtagatctactgcatgggaatacttgtgccaacctgtgggtcatatgtatctcagttgggattggtagtttctgcctcatgcacagggagtggggtgggggttaccccatgcctgagctgctcatctcttggggcctggaaactcactctatgtattaatgatgaggggacccacgtggaatctggagggggggttggagcccccacctggaagctgaaggaggtgatgatggtgaagaaatattgattgacaaaggcaaggtaactggcttaatcagaggctttttgtttatatagggtcttccaggatctccaagcacatttgggcatcttttcctattgttgcagtaccagggcatgtggggaggaataaatgggggaaggaagaactcaggtatctgatactccagtcccaggggaggaaaggaacttttcccctgctccttagaaaaaaaagaggattgggtcaaagacaagccatgcaccatgtttatctcccagtcagctgctgccattgggaaatctccgcagtctgttgattcttaatcagggaacaagagaagatgtccctctctccgagatgaatccatggccccaggaaagaggaaacagataggagactatggatgtttagagaggaaacacagtaaacatagccctgaacccagttcctcctcaatgttctccatagtgagcaccgaagctttctatttctgggttctgggagagggagagatgggggtaggggatggatagatgcttatgttgtattgttctttaaatacttcacctatggtgataagatgacacctttttatggcagatgggtctgatttatacactagctacttggagaggcgttagggagaactgaggcatagtgggcaacaaggcttggaatccaaatgtacttctcagtcctcctccttggctgcctctggccaatccaatttgctgggctctatgaagcacagccttggaatgagttctgggatgaagaaatggaaaaccagattgaactgatttttgttgggaggagcactgtgtgattcttgatagaaaatgacgctgcgttaatggtaaatgagctggggaaaggggcagataaggaagtagttgaaaggtaaagaagggccccaggtccataaatgggagaattcaggatggctcccctaacactagtggctcatcatacttaccttgcctgtattccaggtaacagggccctgcgaaagagtgggtattactagtttcactatctcccacacatttctaaccaaaagcctttcctgaaaatgaattgttgtttcttcctttagtgtgagaagtgctcagtggtgagagaagaggattcccagaaggaggcatgaaacctgggaagagaagggagtagaggcatctgtctctccagagtgccttagctgagatgtccttacatgagattagggtggacaaggatccctattcttattgattagatcattctggtcttcactcacttcagcagtctggtccttaagaatgctagctttgtacaataaatttacaagtaaaaaataaagctagctacatgtaatataacttacccaaaaaagtacaatctccggattattaattggcaggaatagattcccagtcttacgtccttaaagcagagaaagaccttgaaatcaaggtagatcccaacttgatctatgttgatggcctactggattttgcctttttgaatattggggaggctttgactatcagatgaagggaaataaaaggatttagggctttgctgggtaagaggtgggagtttcccaaccctctcaatgggatggtttctgaataggtgagaaaggagatgttcccccttttaagtggaaataaagatccccctgcccctttggtcaaggtgggaaggggttgctaagtctggaaataggaaatagacatgattatcttaggactgggtactgcttggaaatggaaacatggcatatatacttgtatgtatttatctaactatctatctagattcttctactcaacacatcctattcccccccttctacccttttaatttctaatcaggacatccagactttcttcagggagactaggcctggtgtttttgactctggataaaaagcccacactaatataatagtgcagggcaattttttgttgggaagagcatccaagaattctgtttcccacactaagaccctgtcaaaaataaattcagaatctaatctgtatcatatgagctgaagagaatctcttaactgtgtgattttacccctattttcagaacaatttctctaattaagcaaactcataaactgaggcatgagagagggtgaaagaggccatctggagatgatgagttggccaggatgattttcagcatctgtaaccctaagaggaagtatttgacttggctgtccacccttctctgagatcagagggctttagggaatgggaagaagaccagaagagatagaaatgattttctgtgtcttttgtgattcaagaaaaacgatgagcagacattggtttgccatcctcagctcatttatttatccaacaactatttcttgagtgccttctatggaccaggtggcatgctggatgctgagaatacagtcggtggtggacaaaacagacatagtccctgttcctacagagcttgtaacctgcttcaactccatcaagtggtgtagagaggcagggggctctgtattccctgttttgctacacccaccaagtgatgaaattctaccactctgggtttctgcctcattttttctttaggggggttatatacataggaaaagcataaatatgagttctctttttcccaggatggtacaaacaccactctcttttctctgctccagtttctcttggaattttacattttacagatggaacttcccccttcctttgggacagtatagacatagtccctttctctttttctttccccacatggtacgcactcgggaccctcaaagtctaggctcaatgttctatgctgtggttcaaggtcattatagatgagctggagcagggaccccactggggattatttttgcttatctttgtttcatcagagtctagtgtgataccttgaacataacaggcactcaataaatgctgttaaataaaggaatgaacaaatgaaatagtgaatatatgtacatatgttacgaggtccagttctgtctctggttctgtggtgcgtgtatacctccgtgtttgttgagtggcggggggaggagtaggaaatggaggtggaggaaagggagatgatgatgatgctgtttttttgagagggtgatgcttaaaagatatggggtttagggacctcaggacagagcctggaactgaaggagttacagagaggatccagaaactgtggcgtttggattgtgtgaatgagatatgttaggatgaaattgtgaatgcctgcctgacacgtatacatgtgtttgggtaaaggttgatatgtatgctggggacagagctccatgaagatgtgtctgtttttataagtggcatgtgtaataataaatatattgggaaggtgtgcacttacctgaatacctgaaattgtcctagttatgagatgatgtatgtgtgtatgtaggtaatgggataatacctatgtgtgatcttgtgtatgtatttgtgacactgagattttttgacattcctggggagatccagtggatgggaggaagaagctgagactgggtgcctcattggtttaaccctggcttttgccctctttttgtataggccccatggagtgatcttctatggttcttaccagttttgaaaatcatgctgccattctcctttttctgtctatggatgtggagctgctgtgaagattgcagcataaactatggttccctggacctctggagaaaaaggagtgtcatttttctcatgccttggtggggacagttttttagtgctatcctcagcagattagtccttcttcctctgcttccagccatagcaaagggaatctcttctccctcggtttcataccccacttttccatcaaatgtctcctgtctctatttcctccatcagctttgtcttgaatgaggactgtgtggtatctctgggaaggtagagggtagaaaattcctgccttaagttgaagggaaggtgcagaggtaggggatcaaattcagccccaaggaagaacttcacaaacctctggtcaggataggtggctggagggagggaagcagggaggcagagtggtggtagtggaagggcatggggaattttgggagacttgagttcgagttcacattctgccctaacaattacaacggtgtaatctttaagtcacatagtctctctgagtctcagttcttcatttaatatcatcatgtaaaagtaactttgaaatgataaagcctgaaggtctttttcatcatgggagagcttgctttgtgaagaggcaggggaatgggaatggatgggcaactattggctgggatgagggagacaaagattcaagaggtaggaatatgaattacctaataggtttgagccgtgattgaaggagtcttgttgatggttatctggaaggagtgaaggcatgtgtctgaacttagagaccagaaggataggtgggactagaggagggcaatattatgaaggatgtgggccactgaggtcaaaagaaaggagaggaacttcctccttatcattttttcccaatggtcaaactggaagtggatggagcaattgcagttctgagacatggtgagtgtgggaagcccaggggctgccataggtgggttctatgaacattggggaattcccttcggacatttatcccaagtccctaggcctgagggtatcatcagttataccacatcctattttagaaaatcactgaagtctcttagaatccaaatatcactctgcttgtccaggagcctcaggaggtggtttgaaaaaagacagaggattccacatttgaggttgcatttgccacctttgcccagaggaaggcgaaagaggttggggatgcatgggactagaaggccaggtgagatgctcagtaggaaagaagcctgcacatctatataactacaccctgccagggagttcctgaaatcaaaggaatggtagcttccctatctcccagattcccccaacctttaaatctttctgccaccttcagactgggatggaggagcagaaaaccttgaaaacaggtcttccctctctttttgagtctttaaaggaatccttgagaatttgtgtccaactcctctgctctctctcattttctcttctttgattcttccatcttctcctttgcctcatctttctctgggttctctttcgctatgaggctcccttttgctcttctcccttgtcccacttcctctctctgtcccattccttttgacttaccctttcgctcttgccatcagtacttctcctccctcatcttggctaggagtcagaaaatccccgtggctccctcccctcactgaggggttgctgtggtgatggtacaggataagcttgctataggtgccctctggggccttaggagtccagccccgactcctgtcttctgcaaggcgtgtcttttgccttctcagtgacctcatcctcctagtccctctggggaggaagccaagtaattgcctttgaatctcaaggggctgatttttctcaggtacggaagttgagtagctattttccaactctcttcaggatagcagcagagaaagagggacaaaaccaggacagcaggtggggtggaagtgagacaactggggagactggaagttgttagataatgaaattgtcccctaaggcagcaagactacatggtctgagagaactgtgggaccattcctccgttcctttgggaaggggcatagatgggaattgagcagggaaaaaagagtgactgagaagggaaaaggataaaatcaacttattatccatacaatgcagggaggtccttagtgcccctgcccttgcccctgtgccctagtatcccccagtcctgcaactgctccttttccctcagctggggttgcatctatggagcttatcgctgtctgagaagaaaacaccaggtccagattccacttcagcactcagacctggcaaaggtgcactgagggagatgtgttggggttttggtagagaggaaggcttggtgggaaaagggtcaggttgtttttggggtaaggcctgggggcatagggcatggagaagagctagaaagggggtgcttcaggtggtgctgttggaaagagccagacttccaggtcagttgattccacagctgcagtgagaagtcagatttgcaaataattatggtggctacagtggggtgattaggctgccagctggtgttggcaccatttaggttgggaagggaacttggctggtggggggttgagggctgggggctgggggctgggggctggttgtagggagaggctgagtgattctctggcaggcaggacctggggaaagtttttccttttattcctatttgttggcttccctgctcccctgtttatcaactcctgcatatctgcttggcaccatgtccctagttctcttctctgtgcccaccttgtttggaaacttcttgtggcctggactgagtgaacacacaggccaacggaattgccaaacttcctaaaccatgagcatctctcttccaagcaattgctttagaaattccaatctggaagatgtataataaatcaaattgcactagacacctcaaagacttcttggtccctcctattctctccccttctgctcttctttgaaatgccaagaaaatttgctgttgttttttaaattgcagtgaaataaattgaagacagatatgcaggagaacttcctggaaagttcctggaggttagactgtggcctttctctgataaagaaaaaatctacccttctcctctaagcactgggttagagctgatttggggaagcagtgagccagtcagaaaggatgaactctggaactgggaaattgaggcccaagcatcctacttccccagtgtctccaacccagtccctgaatctgagaaccataaaggctacagaggaggaacagatccccagagatagttagtaaaatcggggcagtgctgggaccagacccaaatcctgctgatccataatctgatgctgccctcatcacacttgcagtcagactcttgctaagcttttaatttactttcccatcccagactaccttcaacatctgttaggccccatggaagcagggcatctgctgggaacagctgttaggatgtagtttggagggctggtggggtggtccatgtggaggtggttaatgagcaaaatcaaatggtgtagggagggaggagaggggtggagaaatgaaccagagaaagagttcttctggactgggtactgggagcctcctctttagtttgccttcctctgaccttctcacccacccctcccaattcctctctctctcaagggctgaagtctgatggaaaggtgactcatttgtgttcttggctgggagctgggacacctgggttcttattggtctgggctgaggctcaagctgcttagattattccctttctcgtgtgatctgagttgtgctgggctgttgctaggaacacctgttagaaacggcttctggtcagaaggcacaggcacaggaggagtctgaaagcagtctctcccacttcttcagtgtgttcccagcttctcgaatgcagcacctttcaaatctcctttcctttcctccctgcccccttaatacctcctaccccttttcctcatctcccttcaccctcctggtttctgtccttcccccactatcttccaatcttccctagggcctgccccattccctttcctcatcccacccccacccgtagctcctctgtccagtgctgagggctctctcaccactgctgccatgtcaacagtgcctcccaggatggcaacccagctttgccactggggggctatttttatctgtggagccacccccgccacaatgcccagccagctgccagaactggggctttctgtatagcaatggaagccagaagccaggggagtgggggagtgggaatgctcgggtgaggtggagagctggttgttcttggtttctggagctacatgctctacatactctgcagcctctgcctccactgcctccccagggcctctggaataagaagccagagagaagccctaaacgtccagagtggtggcgtcagggagactagagctttcccaccaatatccaggtgccatctgaggcctggatggaaagtcaggggtcctggctgtaagagtgggcatatgggactttgtttatgaatgactcaatgaatatttgctgaactaactaaagatttggactaaataattatccttcatattcatgtatcactttagggttcccaaggtgttctcataccatatctcattaggtccttgtgaaaattctgtgaagcatgtattatttacccattttacagaccaggaaactgaagctcagagtgactttcccaaggtcacacatagtaataaaatctaggcaaaagtttgtgatttctttttaaatttagttttttcttttcaactgagctagccagaaaagtctcctgattttataaacttacgccctctttctattggaattagatgatttccttggttctttcaatttctgagattttggagatttgaagtcagccagtgaatcccttcccgagcacccacccctttacccccacccacccccacccctttacccccacccacccccaccccttttctcttaccagaggcagagtctcccatcctttgtttcctacctcgaccttattcttcactgcaggctgggcaggcattagagttgggttcctttctatttttaaactacatttaagggctaaaggaaaatccatactggaccctttgttgaggtcatcacatttatgtcctgcctgccagccaggtgacagtctccttagaggtagagtgtggggtgtgtgtatatgtgtgtgtaagtgtctatgtgtgaaatttttcctcaggaagggatgatggttgatcattatccctccttattaggaagagtaaataataataacaggctagggcaaagtatgcagcatgcatacctgggctgaagtggtgagcagccattcgtccaaccagctttggttctaatgggtaagagaggagaggaatggacaagatatcctcttcgaggcttttctagtctaagaaatctttacttttcattaggagagttgaggttagcacttacttggctagagtggcagggtctggagtgagggtacaagacgaggcagggaagttggcctgggttggaggttattagtgtttcaggctgtgtgctgccatctgcccccactctcagccccatcctgcaacgcaagcatgtccacagaacatgccaaatgacctgtcctcatctcctgggtggcattcagggtctctgacactgggtctagtcctttctctctaaaaacactcatcagcttgtggtcattgtggggagggtggtggtgggacacagaaagagatggatacagagagagtgggtttcttccctcccaagatctgcagcagccctgcttcacggctaccaggtgttcactagagaacagccttaagatatttgacttccactcctcttgttgagatcgaagcccacttccacttgtcccagtactcagtggaactgagaaacagcaggttcccaaacttcatttatttctgattcttcaaggctttggcataatgacaaggtattttcatttcttcctgcttttgacgggttggggtaaagggaaaacttcctgttataaaatcctagctcttggcctgtgtcttctcttttccctttctgctgacatactcaaccccattagttccttttcctctttaccacatcacccgcagccatagacctacatctaagagattgcagatccctgaactcttttccccaatgcgttgggcttcacccgccagctcttctccttagccccgcccaactcctcagctggccaatcacggccccagcgtacatgtattggtggcgtcatctcccagccaatcaggaggcgggctgggactgtgtgcgcacgtccacttggagctgcagaggctgggttcttccctccccaaccttggcgaaagcaaagtctgaaggcgggagaggggttcctggtcctcagaccccttctgggtgcctcttttggcccctcctgggccatctcatcgcttctccttacctctgagctgattgacctctctctggttaattcatggttattccccaatttccattttacaaatgagaaaactggggctgggggtgttaatttgcccaaccccttggtttctatgagcgagttctcttgactttcattctctgcttgcgggtggagggcccttccctccctgttgagcccggtctctggataaggatcccctgacacctagcttcaggaagcccctccctacagttttttatcctctgtgggaagttcatccccctgtcttgcttccattctgtgaggtgggttaaagctcgttttgaagaatggccccagaaaaagaccctgaaagggagctgaatctgcttagctccttttgggggttcttgcagggccccttcccctcccgctacagacctcctctctgtgacagattcaggatggttccctgtccctgcactcttaagcctcttgctaaccccctttttcccaaaagaggagccccacctcctcagagcaaggggctggcctgtgctatttctgtcctttctgggcttcttctgagaacagattcttgttttccgtctgattcagatgtgaaacttttcccgcagcctcccctctcacccagttcctgtaggctgggtctctgcctccccactctcttcttcctgcagccaggcccctccccaaagttctctctggtcagttgctcagttctactgggacctggaggaggaaggcaggggccaaagaggaagttgtcccctcttgggggccctggggctcccggggtcaggattttgatactctgaagcaggaaactttgattcccatggcaaaccctgttcctgttcagaggagccacctccagggccccattctcaggtaggtgccagggatgagaagaggaagggggaggagggagaggacaggttgctcatggatccaccagttgtagtttagtgaagtggagagatcaagacctggcagtcccccatatgttttgtgcgtgtgtgtgtgtgtgtgtgtcgcgtgccaacttcaccttttactctgtccatcttgccctttaccttattctcctcccatttccatccccccccacctttttaaaaattgcttcttcttgactatggtaggtgacttatcattgtttcttccttttctctccttcctgactgccaacatccttaggacctcacattccttcgaaatttcatcttgtcttaagaacccaaactggaaatagaattcttctcttgactcccatcccctatcttattctaaagtccttcagagttagaatctccccagacgcactcaaaatcttcacatcactgttcttctgcaggaagtccttctctggcttccctgtcctaagccccctacttatggtgatctttttgggaatgtgggtgctggaagcggaggcaggggactttggaaatccccagaacaccagccatggtgagccaaagaaatgaactgtagaagctggagaagctgagctcttctgaggtgttggggttataactgccagagtcttttcctcccaatggctgcctagagctaggagagactgtggacttccagaagttgggatctgaggcttttccaatcgtgcagggactgaaggtaaagcagaaagaagtggtggtggtgaaacgggcagggatggagttcgaaggaaagttgggggaagctgccagttttccttggggccagatgtggactggacggggttgagcatcctgttctacagggaaaggtacctttactgtgccagattccttgatggctgaaacagagggtttggattaaaactgatgttggtgggatagaaggacttcctgcagaagaacagtgaggtgaggactttgagtggtctggggagatcctaactctaaaggactttagaataagagagggccctggcaggccagaaagtatggggtgtgtgtgtggagtgggttatttgacttcaggaggttgcagttcagcaccttcaagagggtgctttcagctgcttgagtccaggtcctcttcttagacttcccatttgtcaaatttattctttaatcttttttcccctccctccctgcctccttctggtgtctggattgtgtttggttcagatttcaacagaagctatacaagagctcctggacaagatctgtaagtgacagaaggagaaactcggagggaaacctgtgcttgaagtcaacctacaaccttactcttctcaggctcactgttatttttagaaaccctggctcagaaatctccattgtgagctctgggagatagcctcacacctgattaattttcccctttccgttttatttatttaatgaacttttactgagcatgttctgtgtgctctgaggatggaggccaagataaacaagccactgtcagcgtcatcaagacactcacagtctcctatgggccaaccgacagaattaattaaggttggaccggctgagactgcagaagctatggtggaatgggttccagcctctctctaagctaactgcatgattaggtttgttctgccttaacagcttcattgtttggggacacggttaggttccattagcttgagttgtaggccttgacaacctgactgagatggatgagttgtgtgaccttagacaagtcacttaacctccctgataaggagtttgtgaagattaaatgaagtttgtaattgtaaaggaaagatcatggctattatctttctcccatttcctctgttagggagcttcctaattaccagcctcaatccaaaccaactcagtcttctccatctggacttgggagagagaaggtacttgtatttgaagggagtgtggtgtgagctgggttaggaccaccatgatttgatgttgatcagtcaattcctattcaaattacatttttggagaccttttgtatgtgccaggccttttaatgtattatatcacttaatcctcttattaatagccctgtgaaatgtttattatcatccttaccactttatagatgaacaagttgaggctctaagataaacattctcaaagtttagtgtatattagaataatctggggtgttttttaaaaatgcagattgggttgcgaactgtggctcacacctgtaatgctaacactttgggaggcctcaagctgaggattgcttaagcccaggagcttgaggttacagtgagctatgatcatgccacttctagatcttgtccaggagctcttgtatagcttctgttgaaatctgttgaaccaaacatgatccagacaccagaaggaggtggggagggagggaaaggaagattaaagaataaatatgacaaatgagaagtctaagaagaggatctggactaaagtggctgaaaggatccaggtgctgaactgtaccctcctgaagtcaaataacaccccccacacccatactttctggcctggcaggaccttctcttattgtaaagtcttttggagttaagacctccccagacccactcaaagtcctcacctcactgttcttctgcaggaagtccagagctatgatctgggtgaccttgtctcttaaaaaaaaaaaaaaaagcaggccgggtgcagtggctcgtgtctgtaatcccagcactttgggaggatgaggtgggaggatcacttgaggccagaagtttgagaacaacctgggcaacatagcaggacctcatctctacaaaaaataaaaaaaaattagccgggcatggtagcacatgcctgtagtcctagctactcaggaggctgaggcaggaggactgattaagcccagcaggtggaggcagttgtgccaatgcactccagcctgggtgacaaagtgagatcctgtctcaaagtaaaaacaaaacaaacaaacaaaaaaaaacaaaaaagcagatccctgtccagcagatccctggacagaaatactgattcagcagctgtggaatgagacctagaatctatattttttacatggatccaaggtgattctgatgctggtgggctacagaccacattttaaaaagcaccgattaagagttagtgacttgctcaaaggctcacagcaggaagtactagctttgaatccaggattcctgcctcccagactggtgctgctgctggatacatctcaccaaagctgcctcctgagccttggtttctgcattgtaaatggaaatggcaattccttccccgcctcccttcttcataggcccattgtgaggataaaatgagataatgtaggagaaagcacttttaaaaatgtagaactggcagcattgttagcgattatgcaaatacatgcaaatgagtgccgtgggtgtggctgctcactttgggagccagtgctgggatgtgggtttcaaaaggtgggtcgagaagggaactggaagaactttgatgatgggcattgatccctggggaaagttttgtaaaaagggccgaatgaagcagaaggctggggtgggaatctgggggagagagagaactataggcagaagaagaggccttctttcctttttgggttttatgtcaccagatttgagggtccctggctatggggactgatcggcagagggaagccccagcttgtgcctgggcaccaaaggcaaagcgtacctctttgttctgtgatctctgggcggggtactctgggagacactggctcatagcccctttccagctcatttagctgggaaagccttttatgatatatctcgcctctattcctcctccctaatgaagctggagctggggctgagctttactaaaatcatcctcttacttgttaaacaacctgctgtttccacatggagatggtgcagcaggaaggctgaaagtgagatttgaggatagccaaccaaggaggctgcagtgccgtcctccaacttctttgccactttcccttctgtcccatttgctctcagacgtgtcatccaggattgctaggccctgaggtgagaactggcctgtgatgcttcctggggctggctattttgggcaccccattccaaagctgccgagaccccgggattctagagctacttctgttcaggaacgccattgttctccctcccccggcatccctgggaattgatgctaatttcagcctctgatccctgactcattctcttctcctccctgactcatagggtgaccttgggtttttgaagcccctctcagtggggaattatgatggccaccatttcagccccagattggttttaggtgggtggggcagggtgagggaaaggagagaaaggaatatttaactgctttcattaaaatcaccatctgaagagctttgtttgctttgtgactgcctgggctgaactcaccaggcttctaagaagtctcccagttaatcaacaaaccccagaattcataagtgtaaaacatgaggtgattgttccttcaggcaaaacatccagtgaatgagatccctgggcccaccccaccacttttatcctggaagaagcttcagtggggacagaggcaggggatgggtacagtaactctgtcagaggttctctctggtgtaagactggaaaggcaggggttaacccggctttgtcctggttgatggattctggaatcataatccattagctttgcctgcatggagagaggccaggcgaaagcattcagatttgtctttgttctgtgcttttgccatgcctgccaggcacagaggggctgtggacacgtaacccccaccccccacaccatgaccaagagacaatgaaatactcttgggggctatcttgattgctattgatcccaaagccctctcccatgggggaaataagcagtttcagctcttggttattcaggctatgaaacagatcatcctaaaaacatcactccaggggcttgtacctgcctaattctgctgggccctggcattttaaacaagactaagcactgactaaagagcgggtttcgagaagtcagatggtggtggggatggtggagtcaggaaaacctggcattaaactttgggtgtagataaacttaatacaggcagtggcaatagcctgagattaaaaaagaaacattagctgctattattattaatgttagaatgattaactatttacaaaagactgaggatgtttctgtaaaatgtaccttattagggagtatgctgttctcatgataaggtagctgtgcctaagcagcctctctgtatctgctccctgcaggctgcgctacatggtgaagcagttggagaatggggagataaacattgaggagctgaagaaaaatctggagtacacagcttctctgctggaagccgtctacatagatgagacacggtgagagagaccgacagacagagaaggagaaagatgtcagacatagtgttccagagagaggggttaagacaaagatagacacatgtggcatggacagagaccggaagaaagagagagggtggaccagatataaagagctctaggtagtggctcacacctgtaatcctagcactttggaggccaagatgggtggattctttgaacccaggagtttgagaccagcctgggcaacatggcaagaccctgtctctacaaaaaaaaaaaaattagccaggcatggtggcatgctcctgtagttctagctactcgggaggctgaggtggaaggatggcttgagcccaggaggcagaggttgcagtgagctgagattgcgctgctgcactccagcctggtgtgacagagcaagaccctgtctcaaaaaaaataaataaataaataaaaaaaataaaaaaagagctccaggtatccagggagaaatagtggtaagagataaagaagcagaggcagacatagagatgcagagatagagacaaacacagatatcaagaaggacagaagactgcttcagagttggaagggaccttaaagctcatctattccactgtggaatacctctagatgtgtgctgcccaacatgggagccaccattctgggtggctattgagcacctcaaatgtggcaagtatgaactgagatgtgtacataaaatacatgatggatttcaaagacttagaaaaaagaatgtaagatattcatatatatatatatatatttttttgttttgagacagagtttactcttgttgcccaggctgaagggcaatggtgtgatcttggctcaatgcaacctctgcctctggggttcaagcaattcttctgcctcagcctcctgagtagctggattacaggcatgtgccactacgcccagctaatttttgtatttttagtagagatggggtttctccatgttggtcaggctggtctcgaactcctgacctcaggtgatctgcctgccttggcctcccaaagtcctggggattacaggcgtgagctaccgcgcccagccgatatctcattaatatattttataaggctgggcgtgatggttcatgcctgtaatcccagcactttgggaagttgaggcagcctgattgcttgagcccaggaattcgagaccagcctgggcaacatgatgaaaccctgtctctacaaaaaataagaattagctgggcatggtgatgtgcatctgtagtcccagctacttgggaggctgaggggggaggatcacctgaatctggggaggttgaggttgcagtgagctgtgatcacaccactgcactccagtctgggcgataaagtgagaccctgtctaaaaatacacacacacacacacacacacacacacacacacacacacacacacacacacacggtttcatgttgaaatgatattttggaggtattaggtaaaataaaatttattgccgggcacggtggctcacgcctataatcccagcactttgggaggctgaggcggatggatcaactgaggtcaggaattcaagaccagcctggcgtggtggtaggcacctgtaatcccagctactcaggaggctgaggcaggagaatcgctcgaacccgggaggcggaggttgcagtgagccaagatcgcgccattgcactccagcctgggcaacggagtgagactccatctcaaaaaaaaaattatcattaaagtcaatttcacctatttctcttttcctttttaacgtggcctactagacaatttaaaatttcatatatgcggcttgcattttatttctattggatggtgctgctctatagcatccctgaaagatgcgttccatttcctgcttaaacacttccatagttgggatgctcactacctcacatggagacctgtttcattattggagatgttagataaagaaataaaaagatatagagaaagaaaggaaacagggttgaagacagagagctggcatgagagttactaaatgtggggtatggctgggtacagggtctctaggctgtggaagcacctgctgtctttcctctgtgactccccttctggggtctcaggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggtgaggctcgcccacactcagcctccctctgcctttagctgtgcccctctttcccagccaccctggtcttccatgaccaccagccatatgatcccatggctcatccccacatccccagctggccacacctccactcccagaccttcatatgtgggcttcttctcattgttctctctcaggatgttccggagaacatacacctctgtgggccccacttactctactgcggttctcaactgtctcaaggtaatctctgggtttttgggaaagaggagaaagttaggggatggaatagccactgggacttctagaccctgtttatggcattatttttgccttccttttttttttttgaaatggagtctcgctcttgtcactcaggctggagtgcagtggcgtgatctcgtctcactgcaacctctgcctccctgcaagcgattctcctgcctcagcctcctgagtagctgggattacaggtgcccaccaccatgcccagctaatttttgtagttttagtagagatggggtttcaccatgttggccaggctggtctcgaactcttgacctcaagtgttctgcccacctcggtctcccaaagtattgggattacagacgtgagccactgcgcccggcctgccttcccttttaactgttgttcccacatttatcaaaactgcttttgcccagtataggagcaaactcctgccttcctgtctctcccatactgagagatatatgggaagaaagaggcacactttaccatttctttgctttcctatttaccaagactttgtactcatgggaagtccttcttgaagtctaacttcaacccttgctgctgctggaaagccacataatctattgtttctccatagaacctggatctctggtgctttgatgtcttttccttgaaccaggcagcagatgaccatgccctgaggaccattgtttttgagttgctgactcggcataacctcatcagccgcttcaaggttgggcagcatcctacctctacctccaggcaggattctccactcctctcatgcctgttctaaaagcctcccaacaaacagattccatagatcccctcactcagtctcaacatcagggaagtctccccatgcccacgcccagcctagcctttctttcacttgctgcagtcttagttccagacttcattaattgatttctagggggagattctcggtctgcaaccatctagcctgggattctgctctctcccgctttgcttttttcccccaacttgtcctctctaggctgacttgcagtgtggacactggaggcctggagttcagatgctgtcagccagtgccctttgggactagaaaccatgtttcctggataaaattggccactccctcccccgtcccccagttctggtctctgtgcaaggaattatatagagaaggtcagctcttgacagggctcggggcgggggcttgtatgacagggggacggtgtgtgaacttcatttgctcttcagcttgtctggatgggaagaattatatgagattaagtccttcctagatcctgtaccaggagggagcatcttttgggagggaaaaagtgccaggaaaaaaacaaaacactttcacatggacaaatcacatttggaagtagagggtgagggaggttgaagagccgtaatggggatattgggtcagcactttggggagcagtagatgttaaaggtgaagggaaacgtggatgatctgaagggccatagagaggggcggtcaaaggagtccaggtggagggtcccctcccaggccggcttcgggaggtcattccatccatcctctgcctccacttcactagaacaaattatctgtgcatgtaagcccttccttcacccttgactcctccttttacaacaactccctagggagtttccaaaactttcctgagatgctcagctgaaattttcttaagtgccttccggaagcctgttctgcaattttactttcttctttccaatcctgccctctccaggacagagaatagtagggctctctttttcctaagacttttcccagctcatgtttccccaaactggctctcagacttcagtcactagattctcctaaactctgcctccttacctggaaggactgggtctgggggacctcaagagtagctgttttgggttaggtttggcccagtcccagtctgctttgctccaaggcagttagaggaaggagggggtgcttcttgttttagttttctctgatgatagggccagcagcagctgcccttctcaaactccacattcttttcctgggcacctagcccctcccctactcctccctttttcttcccttccctccagggacgccatggcaacgcaaaagcaagggcagttgtcatggaaacagtcctttaaaatttcctgaatttggggcacagccctccaggggtgcgggtgggggatgttagggtctgactgactagtggtgcttcttctgtgtctctgtcactatattgctcatctctacagaaacctcccgagtcctgaaccttcgtcccctcctagcctcaagagattcagggacagatcaccagtcctgtcctctgggagccttgagccttttgaaggaggcagacataccctaagggcgtacacagagacagggcccggattcagagtagctggacagagctctggctgctggtgcttttgtgtgtgttctgtgggactgagggcgcgggtactggtgcatgtagagggtaagtggtcagggagggcaacccacatctggctggaagagtcctctctaggtcatcttcttcattcccttacttccgagcccttcttcatggttttggatgtggggatggagtgggatgtttggaaggtaggagggaagctttctttcattttctttgaaatctccagggaaataataataattatagctattctttagagagcatttactaaatgccttgtacttatctcattaatttccaggtaggtggtattatctttcattctgcaattaagtatctgaggcacagagaggcatgtgacttacccaaggttgcacagccagcaggtggtagaggcaggatatgagccaggttcacctaactaggttctgtgctctctccctatgccacactgccttctaaagaaagttgttgatctcggtccgtaatcaccaccattcctgtggatccttgatatatctccatttcccctaactccccgcagattcccactgtgtttttgatgagtttcctggatgccttggagacaggctatgggaagtacaagaatccttaccacaaccagatccacgcagccgatgttacccagacagtccattgcttcttgctccgcacagggatggtggtaggtgccctggagatgattcttctgtgattcagggcctatggctacagaactgggaggtctagactgtactcccatttccatttctcctcgttggttcttcttgggcactccaaagccttgacagagccaaactggattaactcactctagagaattcccaggtagactaaaactcgttggacagtgctagggacatgtgctgggatgcagtgggagtgttgcaggttcggatggaggaaggtccttggccatttcaggagctgagaaacctggctgcattaaccaagagctggcctggaagcatggaagggatgggatgagtgatctagcctgtgtgtggaggttcctgggaagtgaccagcaggcgtcacccctctctcattctttctctttcctcctgtagcactgcctgtcggagattgagctcctggccatcatctttgctgcagctatccatgattatgagcacacgggcactaccaacagcttccacatccagaccaagtgaggggtggggatgtggcaggggcaggaggggccaagaggaggtggggaggttgccggagtccctccttacagggggtggtcatgatgacctttggctttgtaggtcagaatgtgccatcgtgtacaatgatcgttcagtgctggagaatcaccacatcagctctgttttccgattgatgcaggatgatgagatgaacattttcatcaacctcaccaaggatgagtttgtgtgagcagaagccagtacttggcaaccctaagagactcccttaccacaaactccattttccacttcctggacctcctgcccagcagcgctgaggggactgattgcttctctttttatgtccgctcagagaactccgagccctggtcattgagatggtgttggccacagacatgtcctgccatttccagcaagtgaagaccatgaagacagccttgcaacagctggagaggtggcatctggtggggtgtggctggggccaggccagagggaggggtgtgtgaactgggggggtatacacaagggtagttggtgtgccaggtctttacctcgctgtagagactccactggcttcaggtatcagactgcatctctatgtgagagagagagagagagagtgtgtgtgtgtgtgtgtgtgtgtgtgtgtgtgtgtgtgtccttacgtttactcacagccttggcagctgatccactggagagtgctttgggctgggaatctaagatgggggttctcatcgtagctctgggacaggcttactctggaatgttggaaaattcattcaacccttctgccccagttttattacctctgaaatggtgaaaatgatacgcctccccccacaacagcttgcccctagttcctagtctcatagggctattgggagagtcatacgaggtttaaaaaaatgcatagaacaaatgccataattacatctaatgttgcttagaagtgagtgggaatgtataaatgtgtgtgagagtggactgtgtgtgtgtgtgtcctgaaggtgtgtgttaatctctgtgtaaggtgtttatgtgtgggatgcagtgtcacagcgggtcattgttgagggtataataataattattactattctagataatatctactgagcacttattatgtgctagacactctcctgaatacttatttgttgtttgtcacttaattctcagaaccactcgatatgtggtagggttgttatttccattttagagttgaagaaaatgaaatatggaaattttaagtaacttgctcagtgtcacgcggctaacatgtggtaggtatagacgtgaacccaggccctttgattctaagagcctgggctctcagctactaacccgtgctgctacctaaacatatataagtgtgtgtgtgtctgtgtgtggggtgtgtgtgtagctttggagggtgtttgaagttatgtgaggccgggcgtggtggctcatgcctataattccagcactttgggaggccgaggcaggtggatagcttgaggtcaggaatttgagaccagcctggccaacacggtgaaacactgtctctaccaaaaaaatacaaaaattagctgggtgtggtggcatgcacgcctgtagtcccagctattcgggaggctgaggtgggagaatcacttgaacccaggtgacagaggttgcagtgagctgagattgtgccactgcactccagcccgggcaacagagtgagaccctgtctcaaaaaaaaaaaaaaaaaaaggaagaagttatgtgatagggtgtgcgtgggaagttagggaatggtcctaacttccttttcctaaaagatcagtctcccttcccttgccatctgccccaaccaggattgacaagcccaaggccctgtctctactgctccatgctgctgacatcagccacccaaccaagcagtggttggtccacagccgttggaccaaggccctcatggaggaattcttccgtcaggtagcgtggcatctttgccttccctgtgcctatgggggccttctctccccttttgccctccaagttccccaatcctgttccacatcctccttttgctacctgtagtctctgacctgatcccaaatccttggggtaaaaccccattatcctaaaagcctaacaatagttgcatttcatttgcatatatttcatttgcatattactaatttccaggtcaacagtgcagaaatttcacacaacaaccccccacccccaccacttgccacctgtaccccagatctggtaggtctgaggtatcctctccagctttcctaccctgttccctcctctagggtgacaaggaggcagagttgggcctgcccttttctccactctgtgaccgcacttccactctagtggcacagtctcagataggtgagtgtcctctcctgcaggaaggggaggactgggagggggaaaagatgctgcctgggtcaggattgctccaagtcctcaatccccccaaaccattcttcctgtagaggaaagcctactgtgctagagcatggggtcctgggttaggaggccagggggctgcaatggcaggaaggagctctctggggcaccaagacatcatcccaaagcctgccctgcattgggaagttttcagccccaggttacctctccatcctctttcataagcagccaggggtcctggccatgccagctgcatgctctgcctagccctccagataatagtaagacatctctacggcattgctcctccactgcagggttcatcgacttcattgtggagcccacattctctgtgctgactgacgtggcagagaagagtgttcagcccctggcggatgaggactccaagtctaaaaaccagcccaggtgagggtggctggggtagccagatatcttggttcaggaaggcagtggtagggagggatttggactcacagagaggaccgactcacagccatggtggggtggtggggaggcaggctgcttcaagcttgggagtccctctgccgtcagggacagaaggatgggatcagaagggtgtgacctgtacctatgctccccttcaccatatttttgtttcttccattagctgtctttctgccttctggctaatcttgttttaattttccttctaccaggagggaagatgtggagagggaggggtgaaatgagggggagagggacagggacttggggaatatctagtagaggaaaagaggaagatgaagttccctgaaccttctcctggtcttccatgtcctgcactcccagggctaaggtggttctggagtgggctggggcttacctcttgcggcttttgggggttctgcttctagctttcagtggcgccagccctctctggatgtggaagtgggagaccccaaccctgatgtggtcagctttcgttccacctgggtcaagcgcattcaggagaacaagcagaaatggaaggaacgggcagcaagtggtgggtaccatggcagagggcaggggtgagaacttgtgtgggtggatcatggagcactaggaggtccatttttcttaagcccctggggaaaccctttgccggactccttgatttgggagtggagctgatcagaccagttagatcacaggaaagactggctgagtggcctggaatgttctaagaatgggggccgtagagatgatagagacagtcagatattccacaacccaagggtccctgtgcacactgtggtccctgtaaatggtgcccctgtagatttggctaatttggtggccctggctgggaaatctcttcctgtgtgagggggtggtagggtggtgttgagggttctgagttttagcaaggctggagaggctcttcccaagtggggatgggttgaatgtagttcagcttgaaggcaggttgatggatgagaatcccttacatgtctccacatactccttgggttctggggaagaatacttcttggcctaagctcagcctcctttatgctcctctacaggcatcaccaaccagatgtccattgacgagctgtccccctgtgaagaagaggcccccccatcccctgccgaagatgaacacaaccagaatgggaatctggattagccctggggctggcccaggtgagcctgttgtggtggagggtgtaggagagctggtgtctatcatggcatctttgttgggtcgtctctgggctccagtggatgcgacattctctctccccttttgagcagtaaaatggagcgagtgaagacatagaatggagccaaagtgtgggtggagcagggaaatcctcccacgctcttctgtcccccagtccctgcaggaacaaaggaggtagcttctcagaacagcagcagaacagggtgggcccatgccaggtgacagctaacctgcaccgcaccttagggagggttagggaaaaggagcccagccagggcacacagctcagtgagggcagctgaacgtgacttcgacttcagcccctattcacccccttggctgggcacccttctgaagggcattttttgcacagctctactcgggactgagtggggatcaggacttggagaaggaaggtcaggttggaggtgaaggcaaagctcagggcactgaagtttctccctctttccccaggtcttcattgagtccaaagtgtttgatgtcatcagcaccatccatcaggactggctcccccatctgctccaagggagcgtggtcgtggaagaaacaacccacctgaaggccaaatgccagagatttggggttggggaaagggcccctccccacctgacacccactggggtgcactttaatgttccggcagcaagactggggaacttcaggctcccagtggtcactgtgcccatccctcagcctctggattctcttcatggccaggtggctgccagggagcggggagcttcctggaggcttcccagggccttggggaagggtcagagatgccagccccctgggacctcccccatcctttttgcctccaagtttctaagcaatacattttgggggttccctcagccccccaccccagatcttagctggcaggtctgggtgccccttttcctcccctgggaagggctggaataggatagaaagctgggggttttcagagccctatgtgtggggaggggagtggattccttcagggcatggtacctttctaggacctgggaatggggtggagaggacatcctcttcaccccagaattgcgctgcttcagccccatctccagcctgatcctctgaatcttccttccctccctttctgatatagtgactggggcaaaaggagccattgtgaccaggggctgcgggaggcctttcctgggaccttccttgggactggtctgggcccctggggcttgtcgcctgccctgagtccggagccctttgcctccttcctctcccctggggctgggaggctccatccgaccaatgtctgtaaagtgctttgaggatctccccagcaaagcaccttcagaatgtatcgacaccagctgggttagggtcaagggtgcctggggagggtgagtaatcctgcattgctaaaagagagggtctgtcccctcctctccacgtcccagaactggcccagctgcaggcactaagaagctcctcccctgagacaagtgaggggtagtcggtgaaaggcagatggacaaggggctcagggctgctgccttcctgtcctctggagagaacccagccaggcgcggtgccccttcctctcctcaggctcctccttgcccccaccttgccccaggaaaggccaaagtccaggtgactgccctccttctttcttgtaaataccaaccatgcatttgtacagtgggccctgttcatgcgaaatccacatccatggtctcctagacctgctaccctggtacttccaccctaccccaccccgagaagggcagagacgcatgtgactcacccctgcccttggtttcccagacccctgctatagccagagaacaataaagaagggagaccaggcctgactgtgtgtgttcactgggtacaagttgaccaagcatcttcacatacatacactctttccagcatgataaaatctgggtgaggcgttctccctcatatatatatatatatatttaggtatgtatctgggcaagctgaggcccaggaggaggccccgagggctcatagtagctgcatggcagaagtgggacctgacgcttctcaggctctgctcttgcctctgtaccacatgcttcagcagggagggggaaagaatcttgccttccctcctttcctctctcccactacctgggaaaatcaaaaacagcagcaggagagaggcctggccgtgagatctgagacagtttcttctcttatgcttggttttggtcttatctgggcccctcaatgtctaggacaagggaacccttccagtctccagcatgggcctcttcattaatagccactgtgttctctatccattgttgctaacgggttgaaataagggacagcggtcccacagctggaagagggaacacatcctgaagcttgggaatccaaaaggaaggcagctggggcttggagggcaggcgaggaggtatcggcacaccaccacaccctctttcccatgggccaagtgccatggtgcagttccccttttgtccagcagatggagcccaccgcacagtcacagctggacacggcacaggccttagagcgccgagtcttccagctgcagggcaggcctgtgaggtggtcggatcgttcctcaataagaaaagagaacctggggcttttcttccttcttggcaccctggaagttagtcctcccacctatctgaccctcatctctcttcccacagcaagtaaagtcagggctaagggaagaactcttccctgctcaaggcttctgcctagctcctgtttcttccttcccagaggcagcttggcaggagggtgggggctacagagagggcagggcaagaaggcagggagaaaggattctcccagttggaaaagaaggaaagtgccaaggacctaacaccaaatttatcactttttaaaaacaagagattttccccaaaagtgaaggaataagaaacaaatccggtgtccatgcattcccaaactgcagtcttgatcccaagatacctcctcctctctcagacctgttatgggggaaaggggacagaaagagaaggtgagaggccagagggtcattttgtcccttccccttctggc

SEQ ID NO: 13408 - DNA, 49378 bp, Human
agcaatccttctacctttgcctcccaaagtgctgggattataagcatgagccacttcacctggccccaacttcttaagtaataatgctgatcagccttgtctctcttctcccactccctagaatttattgggacaatgggaactctggatacggaaaatgggaatgattaaaaacctgagaaaaggaattggcaaggtggtggaaatgaagagaactctttttgatttataatttttcctaggaccttttgctttgtgtcttgaaagaaagttgaaatagagttgaaaattttcttgagttacggagttaaggcctcattggaatggcaagaatattttaatgctaaaattcattcaagtctctaagatttaagggtgattactaatttcctctttttaatcttgattaatttggttcttcttcatggggcctatttcctaatttagtcttaataattcaacaaataaaccagcatatttattgagtgactactgtgtccaagaggtattgttctagatcagtgtttttcagaatggaatatttgtaccaaaacctcctacaacagtgcttatataagtacagacttctaggccccacaacagactcgcctacctaccaatgctaatctcagaggacagggattgatctgtttctcaagcatccataaataccatggtactagagcactggttctcaaacttgagtgtgcattggaatcacctggagggtttgttaaaacacagagtgcctggacccaccccagaattttggattcagtggtctggggcgggtcctaagaatttgcatctctaacaagtttccaggtgatgctgatgctgctggatcacattttgagaattactatgtacttcttgagaactactttgagaattattatgtactgtagaagtacaatgcactgtagtagagcattgtgagaaatataaaaaagtattagaggccgggcgtggtggctcatgcctgtaattccagtactttgggaggctgtggcgggtaaatcacctgaggtcaggagttcgagagcagcctggccaacacggtgaaaccccatgtctactaaaaatacaaaaattagcaaggcgtggtggtgggcacctgtaaccacagctactccagaggctgaggctggagaattgcttgagcccaggaggtggaggttgtagtgagcagagatcatgccattgcactccagcctgggcaacaagagtggaactctgtttcaaaaaaaaaaaaaaaaagaaaaaaaagtattaggtacaattcctgtcattaaggagcttatgctgtagttgggggagatacaacgtacactataaacatataacaaggaatatatgtatttgacaatataaaatataatacaatataatatttgacattgatggggtctttaggagaagatgggatttgatctgggtactaaaacatgatgaggccaaaggttcataggcattcttggatataaaagaaggaaaatatagaggtgtacaggggtggggtggtagatacttgtttatctagcttacagcttttaatttttattttttatagagatggggtcttgctatgttgcccaggctggtctggaactcctgagctcaatggatcttcccaccttttcctcccaaagtgctgggattacaggtgtgagccaccacgcccagctttgtctaggacacttatgggggcataagaccaaaaaggttggtgcagtctgtgaagagccttgaaagcctgtccttctcctcagctccacccacttcatagccttaccaaaagtgctgcacagccagaaagaggaagtctcccctgctgagtgtgcaagaggaagcacaagaaggctctgagggcctgtgagccataatgactgatttcacccatgagccaattgcagaggcaacagaagaccagtgcaccaaccaggctgggtccctccgccagagggtgtcaccatctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaaggtaagcatgaacaatgggactagtactgattattccaacaataatagggcagggaaccctgaggcggcaggtgcagcagttagactcccacctttttttccactgcttttccactgactataatctacataatcactcagattatacaggccagccagttcaggaaggcagaagtggaggcttcttttcaaggcttcccctttctagatatgtttcttgccccaacgatggcatctgctttcctctggggatgggggtgagggtggggatggggaaacaacagtggtattccaagtgacttggataaaggtctggggtccaaccttctgggttttattatttattgttgatcctctacactctgaagagatctgaagctgggtctctggcaaaaacttttctgtggaagtgcttccctaaaaggaaaaaaaatagataattagctatttagattaaaaagggtaggtgtcttctgagctgctcctggggtagttcatgctgtggtggttgtgtgtgtgtgtgtgtgtgtgtgtgtgtgtgtgtgtgtgtgtgtgtgtttagaataggaactgaggaattgaaagaagctagtgacaagaggtgggctaggggctgggcaaaccataggaagtaaagagataaagacaggggtgtttatggggagttcctggcatagaaaataggggactttgggggagggagcttttgtgttttttgtaataaaacaaatcaccaggaacacggtttctctgtcaccatgaatcctgtaaatgccctttgggataagatacttacatagtgaacaaaattgtgacactgaatcttgtacaaagtctaactcctgagcagctgcttttcttgttccttccggcttcagttgaggggcggggaaacagcttcctctttgtgctggggccaagcaggcattaaactctacccatcaagacaaaatgcctaggttgttatttcgctcttagatacttggcttaatgtcttggaattttttcttgacctactcttatgctttttatttttatatttatttatttatttatttatttatttatttatttattttcggagtctcgctctgtcgcccaggctggagtgcagtggcacgatcttggctcactgcaacctccgcctcccgggttcaagcgattctcctgcctcagcctcccaagtacctgggactacagttgtgcaccaccatgcccagctaatttttgtatttttagtagagacggggtttcaccatgttggccaggctggtctcgaacttctgaccttgtgatctgcctgcctcggcctcccgaagtgctgggattacaggtgtgagccgctgcgcccagcctctcatgctttttaaattagttcccaggttgccttttcctaagacagattatgagaatgaatgttgcaagaagaggtatgtttctgaggaggaggagaaagggttgaaatatatatggtttctctctgcagacttgttcagaccccaaatctaagccacctttcttactggaaaagtccatggaaccatctctcaagtatatcaacaagaaatttcccaacatagatgtccgaaacagcacggtgagaacttggtccttctctcctttctctgaataattctctgcttgaatggctgaaattctcctcttttgatgcctctcttcaaacttggcaggggatggagtagtctttttttattaatagttttccaaggctcaaccacagggcttcaggttgttgtagagctttaagtcttgagcattttgagataagatgggattcttccagcataagctggagcgaatcatcaccccttttccattgcaagattcatgggaaaacattgtttttgtacaagacagctctatcaacccagcagggtacatgtattttattgtttctgtttcccactcactgtttccttgctgtttgtcttagatttctgcatctaatgggatatctctacttttcccttattaaatgttaaccctagatttttcacccatctttgtagcatctttgaattctgtttcttttgactttgatataaatagtatatctgttcatctgaaagggtgcttaaaatttcctctcatttagccctctgtatctagtcaggatcacatgcaaccattctacctagatagacaatctcctttgtttaaagaccttcagagcactgaagcgtttctaacttcctctgtcagtatatttcaactctctttctttttcttttcttttctttttttttttgagatggagtcttgctctgtcacccaggctggagtgcagtagcacaatcttggctcactgcaacctctgcttcccaggttcaagtgattcttctgactcagcctctcgagtagctggcattacaggcgcccgccaccacgcccagctaatttttgtatttttaatagagacggggtttcaccaggttggccaggctggtcttgaacccctgacctcaggtgatccgcctgcctcggcctcccaaagtgctgggattacaggtgtgagccactgcgcccggcctcaaccctctttaagaatgttttaggtataaccactgttcttcttgagttatttggatcaattgtcttattttgcacttttttattgttttgttttgtgtttctctcagcaacatttaggaccagtacatcgtgaaaaagccgagataattagattcctcaccaactactaccagtcatttgtggatgtcatggaatttcgggtgagctctcttgagccgtttccaatgtaggcaaggtctttcagaggctattctttctttagatgttcatgtatttgcttaaaacaagttcttgaaaaaatgagagagatgtactaatatggaaggatatctaagttgtattgttaaatgaaagcaaatttcaaaatagtatatgatacatcacatttctattttaaaagagtatgtatgtatatgtatttagtaaatatctaggaaagatctggactattttacattaaactgttaaaaataactacctttggggactgattatgactggcttcaatttagtaggctatgcatgttttttctattttaaaaattatggtaaaatacacataacataaaatttactgtcttaaccatttttaagtatacagttcagtggtactaagtatattaataatgcaaccatcttttcaccttgtaaacctgaaactctctaccctttatgcaataattccccatttccctttctttccagccccttgccatcacaattctactttgtttttgtgattttgactattctaagtaccttatataagtagaatcataaagcatttgtctttttgtggctggcttatttcatcagcctaatgtccttaaggttcatccctgttgtagcatattgtagaatttcctttttaagctaaataatattccattgtatgattatactacattttgcttatccgatcgtatgttgatggacacttaggttgcttccaagttttagctattgtaaatgatgctgctatgaacgtgggtgtacaaatatatcttcaaaaccctactttcaattcttttgattataaacatgaaagtggaaatgctggatcatatgataattctattattaactttttttttttttgagttagggtctcactctgttgcccaggctggagtgtagtggtgcaatcacagctcactgctgcctcgacctcctaggctcaggtgatcctcccacctcagcctcttgaatagctggggctaaaggcacattccaccacacctggctaagtttttatattttttgtagagatggggtatccccatgttggccagggtggtctcaaactcctgggctcaagctatccacccacctcggcctcccaaaggctggactgtgccggcctatttttaactttttgaggaactgctatactgttttccacagtggctgtactcttttacattctcaccaacggtgcataagggctataattcctccacatcctcgccaacaattgttatttcgtttttttgacagtagccatcccagtgggtgtgaggtattatctcatctaagtttttatttgaatttttgctaatgattagtgataatgagcatttttcataggcttattggccatttatatatcttctttgaagaaatgtctgtttcattctttgaccatttttgaattggattttttgtgtgtgttgagacttaggagttctctatacaggttgagtattccttatggaaaattcttgagaccagagtgttttgaatttcatatgtttgcagatttcagaatatttgcattaggcagttgagcatccctaatatgaaagtctgaaatttgaaatgtttcaatgagcatttcctttgagtgtcatgttggtgctcaacaggtttcagattttggagcattttggattttcgggttagggaagctcaacctgtataaactatatatctttgcattatttgagctttaaaaatttcaagtatttttccacaatattttatacaaacctactgtaaaatttctagtatagtacaatgaatattgttatactcttctcctggatctcctaattgttagtattttgccacattttcttatccttctctattttttaatgaactatttgagttagcctcatacatcatgacatttcctttcccaaatacttaagcatacatttgctaagagcaagaatattttcttacccaaccctaatataattatcatactcaggaaatcatacacaggaaatataacatacacaggaaatatatcatacacaggaaatataacattatggctgggtgctgtggctcacgcctgtaatcccaacactttgggaggctgacggggatgaattgcttgagcccaggagtttgagaccagcctgggcaacatggtgaaaccccatctacacaaaaaaaaaaaaaaaaaaaaaaaaaattagctgggcatggtagtgagtgcctgtagtcccagctgcttaggaggctgaggcaggaggatcacttgaacctgggaagtcaaggctgtagttagccatgattatgccactggccactgtactccagcctgggtgacacagtgagactttgtctcaaaaaaaaaaaaaaagaaacaaaaccccacccaaactaatatacagcccatattcacatttctccagttgtctcaaggataatacattggatttagttatgtctccttcatctttaatctagaatgatttccagcctttgtcttgtatgacactgacatttttgaagagtctgggctagttatttttgagaaatccttcaatttgaaattgtcttattgttgatagtttttgggagcaatactacatggatgatattttatttgaattttaaataatgagcatgtattatttttataaacataaaaaataaaaattaatatgatgtttttgaaagaaaaattgataaggtattattaaaattttaaaaattaatgtcgtaattttacatttagaaatttgtcataaggaaacagaattgtttcatggggaaataaaaaaaggaaacaaatgcaaagacatatgtataagaatatactccattgcattatttatgatagttacaatgtgataattgatatatccaataaataaaggtttggttaaaagttcagagtatgtgcccacaaatgaatattctgtagctgttaaagtatacacacatatatatatatacacacacatatatattttttcttttcttttttttttttttgaggcggagtcttactgtgttgcccaggctggaatacagtggcgtgatctcggctcactgctgcctccgcctttgggttaaagcgagtctcctgcctcagcctcctgagtagctgggattacaggcacatgccaccacgcctcgttaatttttgtatttttagtagagatgggggatctcaccatgttggccaagctggcctcgaactcctgacctcaaatgatccacctgcctcggcctcccaaagtgctgggattacaggcatgagtcactgcacccagccaataatatattttttatattaattggtatagaaaatgttcatcatatgttgtttaatgtaaaagcaaattgcagtaagacagtttaagacagatgtaagatgtaagatgtccctaaaatgtatatttacataggtaaatatgcatataaagaagattggaatttctgatcggtgggattatagtttaaaaaagctagttaaaattaaacttgtcggtattttctagttttttctacaataaacatgtattatttatgtattcaagaaataatgcaaattttagccctctgagcaacccaagcttgtggtggtgttatagtattttttcagatgatacaagaataatgtgttctgtgcctaccctaggaagcaaatccaggatattcagtagatcacatagtgaagagagaagtgaggacaagaaggactgtaatgtatgaacgagggtcaggtcagagagtattcattgtggaattgagagtagtggttagcaagagggtaggtgctggtggaggcagtgggaagaatgctggaagcacataaaaaaagtctcttactgagaaaagttgaagggcaaaggagattttagaacaccttctggttgctgcagtggtaaataaagttctgagcccaaggtgtttggtacggcttgtttaggaaaggaggggaaatagggacattgaagtatgatgcactgttaagtaggccctgaattagacagacttggtttcaaatctcagctttaccacttacaaactgtatgactttagataagaaactctttaaattccagtttccttatctataaaatggggaaataagatttactgtgtgaggcgtctgtgagaattaaatgagataatgcatggacaacatctagcttggtgtttagcatatagtaaggcaatagaccaacacatgttatttccgttcccttctgattcttgtctgtagagaataagacctgcgtagtgacattggttgtgtgagtggctgaaagtgaatttcagctatattccactggaatttgggtgtaggctggagttgtagaaaggcattcctagcaaatgaggaagtatagacctagacagaggtcatgtagcatacagggaaaatcaaaagctctgggttcaagttctagtaccattccttactagctctatgatcttaggccagtttctttatttttctgcattcattcagcaagtatttatgatgtcacctggctccccgccacattgcggaaacaagcatggagacggggcactgcctgcacagggcacattttgggggacagctaccctgtctggtgtgttaggcaagtttcttaatggctcttggccttggtttccttatctgttaatttagacacagcctttttttggaagataagtaagaagcacttttcctacacattttaataaattttgacaagtgtatatgcctgtgtaaccaccactacaaagtattgaatatttccatcaccccaagggttccttgtgcctttttttttttttttagcttcagccaatccctacccttcacttctggccccaggcaaccactgatctactttctagaatagatttttcttttctagcagttcaaataaagggaaactatacagcatgtattcttttgtgtctggctcctctcactcagcatcatgtttctgagattgatctatgttgttgcatgtatcagtgattcagtaccccgtcctccctttttttttttttgagatggagtttcactcttgttgcccaggctggagtgcaatggtgtgatcttggctcactgcaacctctgcctcctgggttgaagggagtcccctgcctcagcctcccaagtagctgggattacaggaatgcgccaccacacctggctaattttgtatttttagtagagacggggtttctccatgttggtcaggctggtctcgaactcccgacctcaggtgatctgcccaccttggcctcccaaagtgctgggattacaggcgggagccacggcacccggcctcagtccccctttttgctgagaactattccattgcatgggtacaatttatttatccatttacctgttgatagacatttgagttgtttctagttttaggccattatgcgtaagttgctacaaactttcaagtacaaatctttgtggggacatatttttcatttcacttgggtaaatctagaagttgaattgctgaatcatatggtaagagtatatttaattttataagaaaccgccaaaccttttttcagagttgttccattttatcctcccaccagtaatgtatgagagcttcagtttctctatattctcatcagcacttgctattattagacttacattttagttattccagtgggtgtgtcatggtatcttattgtggtttaaatttgcatttccctgatggctaatatcattgaacatcttttcatgtgcttattataaatatatatatatattttgagacagagtcttgctctgtcacccaggctggagtgcagtggcatgatctcagctcactgcaacctccgcctctcagcttactgcaacctctgcctcccaggctcaaacaattctcgtgcctcagcctcttgagtggctgtgattacaggcatgtgccaccacacccagctaattttttttttttttatttttagtagagatggggttttgtcatgttggccaggctctcttgaactcctggcctcaagtgaacctcccacctcagccttccaaaatgctgggattacaggtgtgaaccgccatgcttggcatcatattttttttatggtattaagtgcctgttcaaatcttttggcaacatattaaaaaaaaaaaaaatatatatatatatatatatatatatatatatattccttaatctatcaattttacttttttagaaatgaaagtaccaatattcagtggagaaggctaggaactaggaacaaaacgaatcagtggaagaaaggctgaatgaattgtggtataccatgggctattatgcagctatgaaaaaggatgcattcatgctctaggagataactctgagaacttttggcaagtaggagtgaatgagcaaagcaaaattacaagcagggaatattacctcaattttgtaacacaaataatgaccaaaaaacctgtttctctctctctcttttccttttataatctaatagtattatataaatagggagaaaaataagaaaatattataagaaaaataatatcaggttgctaaagtggtttacctgggcgttctgcaggatggagtgtgggtgctgatgttgggggaaagaagtgtctgcaataaaagtgcatattaatttaggtaaaattatgtgtgaaaaggagaagaatccctatcatactagaatgagagttaaatgaagtatatgcaaattacttggtaagtacctcacacatagtgaattgtcagtaaatagaaactcatggaaaattagacagtattcccgtttgttaataattaactcctgagaacaggagatagaatccaggaacagacttacttcgtggtttgtcaatacgaatcgtttgatttttggcatttttgaagctacctattagataatctacattttacaaccttttttaatttggaggaatggggcatagggatgataagctcaggaaaagtgtgtgtaatgtaatagagacttgtgcctgtggaaatgtaggcatttggcagtgtaggtcataggggcccactggtggcttactgaggaggaacttcctccctctttttcacagtgacttttctctgttacttggtggctttctaggacctctaagggagaggtccctttccctcaagttctggtagtacgtcaccttctctttgattttttattaattcttgtcttcacttccacccccaggatcatgtatatgaacttctcaacaccattgatgcctgccagtgccattttgatatcgtaagaacctttgcaattctcttctatcgtagagtcaaagaaaaggccaggtctaggttgggaggtctaggtctactcacaggatggggtgggaagggactggaaggatggctattttgtttattccttctcaggactactataattgttttgtaaaaagtgctgaagtgaaaatatatttacatgttaagcagatcagcaatgtgatttaattaattaaaaaattacataaaaatcttcttcaccttttccatctcctaaaagctaccttatttcctggcctccttgtatattgagctcacttttagcccctgacttttgttccaattttcttattcttcttttcaatcctgtcagttcctacttctaaatagattcactcggaatatattgagcactgtccagagtggttggggaaagaaggagatccaggttaattggccatgctgtccttgggttcctatgtattttccttgtagaatctcaactttgatttcactcggagttacctggacttgattgtaacttacacctcagtcattttacttctgtcacggattgaagatcggcggatactcattggcatgtacaattgtgcccatgagatgctgcatgggcatgggtgagttaaggcgagagtattatatgaagagtctcatacatggtgctatgatgtagagagtccctcatgcaaaggaaattgatgccatgatttcttatatgagaacctataatctacattgacccaggcaaaataaggtacacttttacatattcagttgactctgaaacaacacgggtttgaactacgcaggtccactttatacatggatttttttcaaccaaacatggattgaaaatgtagtgttcatgggatgtgaaatccacccttaacagagggctgactttttaaatggtgtgggttccgcagcactgactgtgggacttcagtatgcacgggatattggcatacgtgggagtcttggaaccaatctccctgctataatgagagacaactgtggctaactcttgaatatctgctagtggattattcaatttgcatcatctctgaacaatttttaatcctggactggcttctactctgattttcaggttattacaaaaggcaaagaaaattctttttagtgttggtaggaataatattagtaaggtaaatccattagaggtaactaatgcgtgataatacatttgaagccaaatataaatggattttgaattgtctgcagttctgtccccctccattagtgcaaatgtaagtatttaagggctgaaaaaatgaagactagagggatcagagtgggttgtggcacatcattctatgatgatgtgtattcccacatgcctacgtggatacctagacacatgccttacctgttagctttgaatatttatatatccttttgggttgtataacgatttgaatctaggcatattactggattttgaactaattaacagatttatagagtacctatcatgtgtccaaccctatttttgtgcttataaggaagaaaatttcatggacctgcccaaaatgaaatggttctatttagccatagcttagtaacctgatcctggagtggggtatctttatatgtaatttacagtgtagtatgtatatctttggaggtggtggggagtgccagcctatgcacatatctttatcctatatgcaaacataagagttcaagtcatgggtaagggagggctgtaacccctctcctctgctttcttctagtgaccccagttttgcccgtctgggtcagatggtcttggagtatgaccaccctctgaagaagctgacagaagagtttgggcctcacacaaaggcaagttccctgacaatggagaattcctcaggcaaaagtatattgtcctcatgattgccgctaaggtttcatttgcttttccccacaggctgtgagtggagccctcctctctttgcatttcctctttgtccgaagaaaccagggggctgagcagtggcgcagtgcccaacttctaagcctcatcagcaaccccccagccatgattaaccctgctaattcagatacagtgagtgcccttttccttttgttagtggaagcattctctttgccaaggccatcatctctgtagagggtgcttctttcaggaaatatcagtactaaagaatgctttagtcttcttctagggtatgtctctaagttgagcacttcttgtagctaaaaaatcatggttggtttggggcttttgtttggatcagggttagtggtttaacaaaagtgatctataagcagttagcctgtccatagaaggaatttagtaaatattcatagaatgaatgaatggatgaaacagagtcattaggcacctattaagcctagcagcaacttgattttaggaatcaattaacttatttttatttttttgagacagtgtcttactctgtcacccaggctggagtacactggcatgatcactgcttactgcagcctccacctcctgggctcaagtgatcctcccacttcagcctcccgagtagctgggactacaggtgtgtgtgccaccatggttgactaattttgtttattttatttaattttaatttttatttttgagacagagtctcactctgtcgcccaggctggagggcagtggcgtgatcttggctcactgcaacctccccatcttggttcaagcaattcttctgcctcagcctcccaggtagctgcgactacaggcatgtgccgccacacctgggtaatttttttttttttttttgtatctttagtagagacagggtttcaccatgttggccaggctggtcttgaactcctgacctcaagtgatctgtgtgccttggcctcccaaagtgctgggattacaggcgtgagccaccgcgcccagcctgtttatttttttgtagagacgaggtatcactatgttgcccaggctggtcttgaactcctgggctcaagtgatcctcctgtcttggcctcccaaagtgctgggattacatgtgtgagccactgtgcctggccaggaatcaattaattaataaatgtttttgtttgatgactgtgggctcaaagtccttccctcaaagaacttatagtctggtagggaacatatgccatgtagtcacaaaaatacaactgatggtacatgattagtgataagtgccaaatgagtgatttacattttaagcagtaaaataatccaaaggattaaccatcacagggagaaatcatgagaagatttctgagtcttgctctcttcattttattgttattaaaaatatctgaactgttgaagagaagttatgtgaaaccttttgcttgttctgacttctagtccaagttcctctttattttctcaactgtattgtttttcccttactccacttccagtgcctcatcacctccattattggcaggcttccctgctgttggtttatcaatgtgccctaaactagtctggtaaaataaaagttagttttttaaaaaaatttagagacagggttttgctctgttgcctaggctggagtgcagtggtacaatcacagctcactgcagccttgacctcttgggttcaaaagatcctcctatctcctcctcctgagtacctaggactacaggtgcacaccgccatgtctggctaatttttaaattttttgtagagacaaggtcacactgtgttgcccaggctggtcttgaactcctggcctcaagctatcctcctgcccctgcctcctaaagtgttgggattaaaggcgttagccaccaccccttgccaaaagttagttttgatactcagatcctagtttgtcctttctcctttagaggaaggccaagttaaataactgatcatctttgcttctcttctcacagatggcctgtgagtatctgtctgtggaagtaatggagcgctggattatcagtaagtttagtgggattagatgggagtggatgaagcagtatgttatatgaagaacaagttctaaaagtcttcctctgcactgttttcccacctacagttgggtttcttctttgtcatgggtgcctcaactccaatagccagtgccagaagctgtggaagctgtgtctgcagggctccctgtacatcacccttatccgtgaggatgtgctgcaggtgcacaaagtcaccgaggacctgtttagcagtttgaaagggtgagagacacgagagccaaactgatcttccttgaatagtttttagcccctccaatatcctttttcagtctccacaagtgttcccagatataggtggtaacgattaattctaactattgaagaaatatacattaaatacctactattagctaagtgcttcactgggttttagggacacaataatgaataagacaacatggaggttaagagcacagactctgaaactagattgcttgggtttgaattcaggctctaccactagttgtgtggccttgggcaagttgctcaaatttcccatgccattacctcaatttcctcatctataaaatgtggataatagtagtacctccctatggcctacctcatagggttgttgtgaagaataaaagtgttattatttgtaaagcaggtagaaaagttcctggtacattgtaagtgctatgtgcttgttaaagaaaaaaaaaagacagttactgctctcgaggaatctatgaactggtagaaaataaacaaattgtttgatagagtaagagattataatgtgtaaacacaaagtactgtggaagcatttagaaggacacttaaactggcctctcaggatctagaaaaacctggagacaggtagatctgaaaggctaaacagttgaagagtgtgtgtatgtgtgtgtgtgtgtgtgtgtgtgtatgtgtgagtaattgtgtgtgtgtgtgtgtgcctgtgcattgggtagaaaggtaggggagttgcttgaggcaaagaaagatattctaggcagagaaactatcaagatttttgaggcaacaaagagcatggcaagttctgagaagttcatgtagttcagtgcatgggcatctgggttataaaaatgaagatgttgaggatgaatttggagaggtaaattaggatgttgtatgctttgctatggagtttgaatccatcccaaagaggatggggaactattgagtgatttcagacaggggagtgacatgatcatatttgcattttagaaaagatcattctggctgcatggaagaaaagaaattagatgggcaaaactagaggcagagattaattaagtaaattagaaggaattgaggatgatgtcgaggtttctggcgtggatatctggtattccttaagataagagagcatgtgataaaagtaagtttgtgggagaaagattgcgtggttagttttaaacaggttgactttgaaatgtctgtgggacactgaagacagatgtgttaggccttctattttatggttctggaacttgggagtgaggtctggattcagataaagattgctgagttggtagttaaagccagaagagtagttgagattactcaggagcacatgtggagtgagaacagaatgggaaaatcctctgtgtatgttgatatttaagggccagagaaatcagtgggagatactgaaaagaagagggaaaagagaagccaacaaagaaagcattcctagaaggaaggaccagtgatctgttagacgatgttgggagatcaaataaaataagaattgaaaaaatgttcattggatttggctctaaagatggttttagtgcccttcttgtgaacaatttgagtggtgaagttgaaacctgggctgcagtgagtttaggagcaagtgagagatatggaatttaataaacagctctttcaaagtttgactgtaaagggaagaatagagagaggtaaaatgagaaggaggagtgggtttaaggaaagggtcaaaataccaattttttttctggttgcaaataaaacatccagaaatgtaaaaagtgcaaagtggaagttgactacactatcacctcccagaatagtttgatgtgcatccttcagatgtgtgtgtgtgtgtgtgtgtgtgtgtgtgtgtgtgtataaacacataaagatggcatgtattttcaaccttatgaaagtaatttttaaaaagcaatggagccacactctatattatgttctatggtttgcttaaaaaaacttactatgttttggatatctttgaatatcagtctatagagacttattatttttaacagttgaataatattacattatgtggttgtaacataatttatttacaaaatcctctattgatggatatttaagctgtttccattttaaaaaatcattgtaaacaatgctgtaatgaacattcttaggcatatatctttgtgaatctgtgaatatttttttattttctttttttttttgagacttgagttttgcccttgttgcccaggctggagtgcaatggtgccatcttggttcactgtaacctccacctgccgggttcaagcgcttctcctgtttcagcctcccaagtagctgggattacaggcatgtacaaccacccccagctaattttttgtatttttagtagagacggggttttaccatgttggccaggctggtcgcaaactcctgatctcaggtgatccacccacctcggcctcccaaagtgctgggattacaggcgtgagccaccgcgcctggccttgaatctgtgaatatttctataggctaaattcttagaagtggaattgctgaagtaaagggtatgtacatttcaaattttaatagctcttaccaaattgtgctctaaccagttattatcaagagcctataagaatactgatttctcacactctcaacaactaagtattgtcattaaaaaccattgccagagttagaaagagtaaatctgagattaataattagaagttacaggaggtggatttgggcatatgcatgaaaaaactttctaatgattactgcttctaaggaatggaagagatgttcgaagggtgttcagttctccatcactaagagcagcaactaacttgtgtgatttatagtttagggagttctttgacataaatgatctaatttatcttcatgaaaattcaagaataagtattaatatctttttttataaatgagaaaatggaggctcagtctcagtgtcactcaataagaggtgaaattaggacacaattccaggtttctggactctgaatcttttctctttccattgtgctatgcagagattaaaataattatccaatagattgctgtgaagttgaatgttgatttaattaagatactttccaacaccaaacttctttgattttgtgctagttcaataaagtagtggtttggagaagggaaaggagaggtgatgaagtcccaataatgtggtggcaatagtgatacaggacaagagaaaacaaatataaggaacatagagagcaaagagtctaagataatgctgggattctgagcatgggtcactagtagaaaaaaagagatgtggttaggagaatcaaatattgcagaaaattaaaaacaatgaaaaggccttctaatttggtgattcaaaagttcacattgactttagagagagcagttgcttagtgctgaaggctttgtgggattcaagggtcagtgagaggtgaggaagtagagagagtataggtgtctctttagagaagtttggtggtgtgggaaaataaacagaattcggtggattgtcagggtcaagcaaggatcttcttagaatacgggaggctttgaacttatttgttgggagaagagaataagccagtggagaaggagagattaaagtattaaatagataactgatacagtgaaattctaaaaggaagttggtgggaatgggacccaaggtagagattgagtaactacttttacttgagagcagggcctgtgttgtatttatacactgctccctttaaccccctcaaacctggaagagtaccttgatttgaaggagtcaaggcaggagcacaggaagagaagtctagccccacctttgccattaaagccctatgtgaccttgacaagtcatttcccttccctaggtattattttctgtatctgtaaaattatgaggtagagttgaatgatctctaagctgtgagtcttttattaataggctagggtgagaagtagggtttggaaagatcctgcctgtgagggctgcccatgctcccaccagggtataggctggactctctgaggactgggaaggtgaggcaagggccctaatgggtagcatggtcaaccccattgtgcttgtgtcaatcctcaggtatggcaagagagtggcagacataaaggagagcaaggaacatgtaattgcaaacaggtaaagggtggtgaatgcactctctgagaggggatggaataggaatctcttctcacttttgttctcacctaagccatccttagtttctgtacagctttattgcctcaacccaagaacttgctgctaccccataaattcttttttcttttcttttcttttttttttttttgagacagagtctcgctctgttgcccacgctgggtgcaatggcatgatctcggctcactgcaacctccatctcctgggttcaagtgattctcctgcctcagccttctgagtagctgggattacaggcacccaccaccacgcccagctaatttttgtatttttagtagagacagggttttgccatgttggccatgctggtcttgaactcctgacctcaggtgatctgcccacctcggcctcccaacgtgctggaattacaggcaagagccaccactcctggcccttttttcttttttaaaccaagtctaacttgagcattgaaccttccttctgcctgatatcccttcctaaatatagctttcttctgtgctgcctgtggagggtttttaagggtgggagaggtgatagtcatgttccccttttcttccttagtggccagtttcattgtcaacggcggcaatttctgcggatggcagtgaaggagctggagactgtgttggctgatgaaccgggactactgggtcctaaggcaagaggaagaaatgttgggaggggaatgatggccagtgataagagactgtgtagctacatggcactcacgagattttgcctttctgagtcttttgtcattcatttgtatgtatatatgcgattcccttgaacattcttggagtatcccaaaaccttttgtatctctttttttggcactatacgtagtatgtggtgtattaagattacttttatacatgtcttatcctctatttgagtgtgaatgaattggagacagagcttgtttttttgtttcaaaccacataaatgcccagtaaatatttctaaaactttatttgatagggagagaagggtactaattgtgagccagtgtcaacatgtgtacctgcctgattgtgtgttctgtagttgaggttttttggtgagtctgaatgtttattattcacactgttgtggctacacaattacatccatacctatattatcatggtagtttactctgtgctttgaaatccatttttaaagttgaaaattctaatagtctctaccccctccataggctctttttgctttcatggccctgtccttcattcgtgatgaggtcacctggctggttcgccacacagagaatgtcaccaagacaaagacacctgaggactatgctgactcgttagtacttgacatggctaagaaccttgtccttagatggactggggacagggaggcatcagatgaccttaggaggtctcaatttctgccctgatatcactgtgtttgtctcagttcatatttctagtcttattcatctctgttctcatcctaaactttataggagcattgcagagctacttttcttgttggaggggattaggtctctggtccgaagacacatcaaagtgatacagcaataccaccttcagtacttggcaagatttgatgctcttgtgctcagtgacatcattcaggtatgatatttaattgattatactttggaaatttcaggatgatccctagtgattttcctattgaaaccactctggctgaatctcatgctctgtaagttgggtgtcaaaaggtccaatctaggctgggcgcggtggctcacgtctgtaatccaagcactttgggaggcctaggcgggcagatcacgaggtcaggagatcgagaccatcctggctaacatggtgaaaccccgtctctactaaaaatgcaaaaaaaattagccgggcatggtggtgggcacctgtagtcccagctactcaggaggctgaggcaggagaacggcgtgaacccgagaggcagagcttgcagtgagccgagatcgcgccactgcactccagcttgggcgacagagcgagactctgtctcaaaaaaaaaaaggtccaatctgccccttcatatttgttaaaagaaaaagaaaggactaataatctcagccgtctttttttccccactaagtgaaattacatagaaataggagagaaaaataaagagaaactggatgttagaatggcagggaacccggaaagtttccttcatctcttgcttggctttttctctctgtttttaacacttagcaattctttctaccttcatacgctgactgagcctcatggtcctagtttctgtcctagggaacctgtgcccacttgacagtaactgcagctccttttttagaacttgtctgtgtgtccagaggaggagtccatcatcatgtcctcattcgtcagtatcctctcctctctgaatctcaaacaaggtaactggagggaggtgggggaggcaggacatatgtgaggatgaacatcttttatccggaaatattgatctttgagccaggaagtaggacaagatgtttttgaagaggatctaccattctatgtagttggatattggtgtgctgtttattgtttccttttatacttccgtttttcttgcagttgataatggagaaaaatttgaattctcaggattgaggctggactggttccgcctacaggtaatgatctgttcctgttaaagattctcatcctcagattcttcctcccccacaatcccttctctttttatctcctaaatttgctttatggagtgagtcaactttgaaaactgctaattggacaagacatactcaggccaaactgtaattccaaggctgggggcctttttcattcatcttatttttctccacactttcccaactccaaccgcaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctggtatgtcttggttcagagctctctttaaaaagttttattgtttccttttttcatttttttctccattatgccacttacttcaaagaattttgtttaattttttttttttttttttttttaaagagacagatctcactatgttgcccaggctggtcttgaactcctggcctcaagcaatccccctacctcagcctcctaagtagctgggattacaggcgagagccaccaagctctgaaccagagctcttcatcaattcatttgctctcttgcctggcctctgcggaggactgtcattcccctagacaattggaaagtgttgctgtttttgagatctccttaaggtgctcaaactccgcagctcacttgtgtcagctttttaccaataatcttaagtgataggaatttgaagttgattccttttgttctgtattcccttttgttcttttgtggaaagccatttggattttacatagtcttcgcttctctggggtagttagcccatatgtctagtttcaatctcctctctttggaaacgtcttcagattttttttttttttttttactctaggaacattgtgatttaaaagaaacaggaaaaactttgagttttagtggacaggagtgaaaataagtgagaggcctagagaatagggactttggagaatgagctgaatgagtttgtctttcttagatagcacttgacgtttttaggtgaccactgttgtacataattccaccctttgaaggatcaaacaaggagtatgtagcttactcattcattcaacaaaacacaatgtgttgtctctgccttctgtaagcaatgtagttggggagatataatacctatatgtgaaaaggacatcaacatagtacttgcaaatgtaagaaagtgtaaaagagtacatgaagttgagaggacatgggttgaggaaagatcagtctcatgggattaatttgagaagattttctggagcctgagtgttaaattttgagaagaatgtgaattaacactactgaaggacttctaaattagggggaatggcccaaatcatgccaaggttctaagggaagaatagcaaattttgtgcaaggaaagggaagaagattatcattaaacttgcctggggtcctttataaaagtctggaaggattaagtttcttgggttccgttctatcttaagggttacagaaattaaggagagagtggtaaatatcggtaaatgttttttgaaagaatgaatatcctctccgcctcaaagggactagctcttaaactctatttttcttttcctttatttttcactcaccactttactaataaggactaaatcttgatttaaagtcttcccgtttctctgcagctttcatcttcgtatctttgagaagatgtttgccatgaccttggaggaatctgccatgttgcgttatgccattgctttccccctgatttgtgctcactttgtccactgcactcatgagatgtgcccagaggaggtaggtatcctgatctccagaccctgtcatctttctagtcatcatccttatcacccaaaacacaattccaagggttgattttggtcccagaaagggtataaacatagatgtatgatatgagtccctaaatatctcagcttgatgtatcctgtctctgggcctcagtttcttcttctgtaggaatgggtaggaatcttctgtaagattcaggcaagggatgagagcagtattgtgaggaagaagtggccgtgctggtgatgacagtctcttctttggtccctctttcccatagtacccccacctcaagaaccatggtcttcaccactgcaactccttcctggaagagttggccaagcagaccagcaattgcgtcctggagatctgtgctgagcagcgaaacctgagcgagcaggtagactcagccctctctgtttcactctcccctctgccagcgctcagtgccttcccctctatctaactttgtttccctctcagatgccaagctcagtaactctttctctgaagtagggctagggcctttctgtacttgagtttatggcagaattcttttcttagtgtagtcccttcagtctttcctcccttaggactggatagaagtgtctaaaaatactcttatttgaacagctgcactccaacaaaatctgtgctctcacttgaagagttctgagagatgagttaactttctaatttacccctcctctctttgccctgcgtacacatactaaggacagtggcccccaggtcacctgtcttatctcatctttctgtctatctgcatcttaatctgtggctctctggacattttgaagcacctcttctgtgtttatcctcaaggctgctttcttgcctttttcttcttatttttcccctctcctcccttgactgactcttagcacctcgtcataattagttcaacctaaatttcagaaaatttgaaaatgagaaacttgttttgctgttgccctggagtcttctgggttttccagactacccacctttcctgggtttgagtcaggcttggtaaaggggagtgtgtgtatgtgtgtgtgtgtgtgtgtgtgtgtgtgtatacagatgcacagttacattattacttaacctttttatttttcatatgcaaattacatacaatggggataaaaatagtttctttacagaagtgtcttaaggattaaatagggtatatttaatatttgacataaagcactcaataaatgttacctgctatattagttggtacttaccgggcacaaagccctgtgctgggtttttggggacccagaaggaaggtacacaattcctgcccttggggaatgtcccagtttaagagaaaagggagtataaatacatgtttgaaagaaatttaaataattaatgcaagaagatatgcaaatgagtacaattgcaggtatattcattactcaatatgcttaatctcagccaaaaggctgagaaagccaagaagagatcatcagtcaatatgaataactactacttgcaagaacactggtaaagagatttgctctgtgctgtcgtctcagggatgactaaaacatgatgcgaataattttcacacatacagaactttcgcaaccaaatgagtataggctttctaaagttaacattctgagtaaataattactggcattgccattactagtggaattacatattttggaactgctttcagaatctgctacagacacataatcttttgcacaatctcagggttgacacatctttttccatcaaggtggacttgatttttttgaaacagccaagagtttggatttaaaaaaagaaggcacgactaaaagtaacaaaactggtttccttgtgtgggtcttatgctgctctcagagtgatttcaactgaggagcttccagacatgccctgctcatgctcagcagctctggagtaaatggagagaattccagtcaccctgaaggagatgtctgactaggatgtctgagtgaagacaagagatgccaggttgatgtttaagctaattagcaagaaatatgctacttaaaaaaaaagtggaaagacaatgctggccacattgtgaactccaaatctttggagggctgtggtgatgtgggtaactgtctcatgagatagaataggaagggatgtagtatgtgagatgattgtcccatctagcaaaaaataactgttttcctacattggaagaccctgcaaagcacaactgagtgggacttttagatcttgttctttatacttgagtttttccattaagaaaggttctctcaggatgtgggtgtgggagtgaggctctgatcccagaaagacactgccatcttgagacttagagcctgtacacacagagatatttatgaaaactgaaagaggtgagcacattctgaataggcccccattaaagaaagaggtgtgtggaaggaaagagagaggaaggcagaaagataaaataacagacaacaatggacaacaacctttttataactgtcaggtgccgttttagcaacaaatcccctttctccatttacctgtgtttgtttctgaagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaagtgaggacctgggccctagatggccagctgggtactgcatcaaagaaggcaggaaaggaaagagggaaggtgacacagaaagaaaagagcgcaagtcatggtggggaatgaggggcatggaaaagcacttaaatgcgaatttcctactttgcctttgaagtctacatcaatgtgtactcttctaggctgagtatccctagaaactgggtcatgggcccaacacgtccttcctagacattagcaggcagtgccagacctgtaatccaggctcattttcctttctagcatggacaagctacacctaaacttgacagaactggcactgacaatgaatcatgtatacagtttctccgtgtttgaacatactatcttcccttctgagtacctcagcagccacctggaggccagactcaacaggtatcactctttccttgtcctctgtttggacagtagtcttcataccctaccatatacctctatgtgtagtatggtggtcctcaaagttgggtcccattacattcatcctggtggtcatgccacacggtggagattctgttgcagtcagtctagcataggtcccaagcatctctattaaaagcaaacaaaaggaaccccaaacctctataggtggttttgatgaacaccctaaattgaaaccactggtttagtagaatgagcaaggcctttgcagtgagcagacctgtgttgacaacctggtcattagctaagacattggagcagatcgtccaacttatttgaaccagtttctttccttgtaaagtaaggataatggtatttaccttatttatggataattgagaattacccataattgagagttggtagagaattaaagttagtaatgagtgcaaagctcctgacatatgttaggctttaataaaatacatccctagcttccactttgcgcttcactccattgccccataaagtaagatgcacattggaattgggcactacagtctgcaagtgggtgaatgggaggaagaattattatgaataagtctcagcacttctgtgttttcttttggagtatgtagcttattcattcattcaacaaatgtttattgaacacctgctgtgtgtcaggagtattctaaaagctgtttatacagcaatatacgaaacaaataaaaacctctgcctccatgcttacttctagtggggaagatagataaacaaaataagaaagcagaatacgtagtagattagatagtgataaggaccaagcagaaaaataaagtgggaaagggagataggaggatgtgcggtgctggtggtgctggtggtggcagaagtaggtgttgcagttttagatggagtgtccaggaaaggcctctttgagaaagtaacaattgagtaaacctgtgaggacactgagaaagccacgcatgtaactactggggaaagagcattctaggtagaggaaacagcaagtgcaaaggctctgaggttcgaacatgccttctaggttcaagggacatggagaaagacagtgtgtctgcagcactatgagcctgggagagactggtaggatgtaaggtgagggaggtcagaaaagtggcagattgtgtatgcgcttatatgtcattgtaaggacttcggcttttattctgagtgagatgggagatggggagccttggcaggttttgtgcaaagctgcaatgattagacttgactcaatattttactctggctacattagcgggggcaaggacagaagcagggaaaccagttatgaatctatgttttgattgtcagagaagcaaatttatttttcaattgaggtttttgcttgggtgaagttaaattagtttgttttcattacatacacgttaactataaggaagaaagtgtctcagttgcatacacaatgtcaggaagatgacagtttgataatggcccatgtgcaagccttcagatgctggtggtggtttccaggccctggagcagcatgagtgtgacattcaagttttacccgaataatctctgatacttgcttcactgacatcattgttcccaaagccctaaggttggcctagaggtttggcctcagtgttaactctaaattagatcagtcttgcccttagtctgtcccttctgtattatcttcccttaagtggtacttgagaaccttttccctttcatttgtggagcagaccagccccacctttcccatcccctcccctgccataagcattttgccaaaaaacacaaaacaaacaaaaaactacctctttcctctgtggtttacattttaacaaggaaaaaagtccttagtcagaggactgactctaattgtgaaatctcagatacttgggggaggtattttgaaaggagttgggggtccagtggtgaggggtcttgctggtgtgcccctacaataatatagtgtggatagttattctcccctctctaatgttgcctatagctgcatgccagccacgcatgatctctattcagccctggcgtgccatggctactcaggattataatatacttccaaggatttctaagcatggttttccatttctggcagtgatcggaactaattcttttcaaggggaaaagataaatactttcactgggaatgcagagggtgtgaactgtcaggtagagttagatggaattagagagcccaggtcttctactacctgagctatttctccagaggaggaagaaaagcacagtaattagggatcaaatgttactggaatcaagtcccagctctgccactgccagctgtgtggtcgtcagcaatgatttattatctctgtgtctcagtttcctcatctataaaaatgaggataataactgtctctagcttattaggttactatgaggtttacatgagataatatgtgtagtaaaatcctagcacagcacctggaacacaatatacactcaacaattgttactgtatttgccattatgattgtaattctaattttttttttttaaatcacctagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtcagtgttgcttaggcttttccactgccttactttgtgttggcactttttcctttacacggtaggacctcagggcccgagcattttagctcccagggtcatagactccaaaatggagggttgcttctccttgaggaatggagcaataacctgagacaagcccagatccccttctgtccaccacgaagtttccttctcaccctcactggaacatccttcagcctaccctgcagttatttgaccttttctctctaatatctagttcttaacctttcttttttggattcttactgtttcaatttcaaatgatctctcttcctctttccaaagttctcttatttctctttttgcccttacttctccttctgaaaaccatctgcctactaccatctctctggaacgtctccttgtccccagatgtgactattgttcttaatagagaagggagcctcctccctgcaactggagaaggtgggaatcagcactgtttcctttgacatgttaaggaatggaaaggagctggatttctacctccccaagccactgggtggcgctcttaacccaaaatcagctcagtaggcgacaggctgcaaagaagaaccccccagaacaaggggaaacaaagtttgcaaatgcaaatgccagttggggccaggcaggaaaggtaaatggatgtgccacatgggccaggcagagactttgaggaggtggtgagagaatacccctctaaagggaacagccaccgcttagctccacctgattgctgccctactaaatccttatattttatgtaaaaatctgtttcaaaattttgacaaagaattttccataggtgccagagaaggtgattcagcccctcttcccctgtcagccgtttcagcgtaaattcaaaggaaaaaaaaagtttgactgggtttggcccactgacagttagcttgtgatgtctattagatacagacccagagcaagtgcctgggagaggcgggttggtcaagccctcctctacccacattggctgtagcccagctcctttaagtttgcccagaggtcaggaggaaatatttggagactgatgacctgtgctcacaggtacctctttgcccaggaggtttgagagtatatttcaaaggagtctaattaagtagtgacttttttcttgccaggttgagcctgtcttacctgacagagggtaagggtgaggggaatacagctgttggaaaagagcagtggttgagggaggggagtgcatgctattgcatttgacggtatagcaaaataccctccaggttagaggcaaagtggaattccagtactgccagttgtttttgatccatcagcttggggtgttaattagaacattgtgccatcttctttgagtttcttctccctaccccagtcttttgcagagtttttctttctgagctcagtggtagtagtagggaatgctggtagggagaagggattggatcctaatctatgttttcttggccaaccctgtaggtacctggaaagtctgcttagacaggcaagcagtgggaccatcatcctctccccagccatgcaggccttcgtcagcctgcccagagaaggggagcagaacttcagtgcagaggagttctctgacatctctggtgagctcagggcctggtcttcttgtcaaggagctgagcccttccttcaatgcacagagaataaaagactaggacatgtatttaggttggtgcaaaagtaatttttgcaattacttttcattgcaaaaaccacagttacttttgcaccaacctaatagtgaagggtaagggataaagtataaggaggacattctcctgtttggaattattaaatagtggtctgctgtcatggcatcttcttcttcttcttcttcttttttttttttgagatggagtctcgctctgttgcccagggtggagtgcagcggcactatcttggctcaccgcaacctgcgcctcccgggttcaagcaattctcctgcctcagcctcccgaatagctgggactacaggcaaatgccaccatgctggactaattttttatatatatatatatttttagtagagatggggtttcaccatgttagccaggatggtctcgatctcctgaccttgtgatctgcccgcctcagccttccaaagcgctgggattacaggcatgagccaccacccccagccagcgtcttatgctttagggatacattttagagtcttagccagtgtttggattgctgatgtttaataataacgatgatgagatgatacatgacatttattgtgggctaagttctaagtgtttatacatattaactcacttaatcctcataacagccttggggtataatagatacacttattcccgtttttcagatgaggacactgggacacagagagtttaaggaacttgcctaagtccacacattcataaatagtaggacttggagttcgactccaggcagtcaaactccaggaactgggggcttaagcactgtacagcgctgccttccagtgtctagaagtgcttttgtgtctcagggggagacaggtaaggagtgtgtagtgaatgagatgggaagcctttccctttctcaagagggtttgaaactacaagatcctttttaataggtttgtttttaccaactaattcatgaactatcctacttctttctccttcctctcacctccatataaatcagggacgctgcatagtatctgggacagggtgaagatgttccagtgacgctgtcctctccagtcttcttctttggggggtgctaagaaagccaaagtacacagttctgttttccagttctgcctccttcccatcatcccgcctccatcagtaagctgaccctacgctttacctgctgcaggtttcagatgtccccttctcatcaactctacccacaaactgtaggcagcctctaaaatcagctttaggtcttgctgacaaatgacaagcagcaggaggtaatgctgattcccccttctaccacccccaccccaatttcccttggttgccatagtgatggggcaatgctactgcaaaaatagatagatggaaagagaaggatgccctagggttgctagctgggggtagagaagactggagtaaggagctttggcagatccaaactggtagatcagtgtgtctcctttctgtcagctacagagggcgattcagctcttcttcctctctgtcagccattgcggcattatccaagttgatcggtcaggaaatcctttcatagttctgagctcagttcttcctattaaaacaggttgactctaaaaatgtctaacatctactgtggacaagactctgtgtcagtggctgtgaccagttccatttcctctgtcactgatgaaggtggagatcactggtcctgctttgaaagacttgagtgtggagccttgacttccatttctctctgaactcttattagcgatattaaacttgcctttcttctactggtctcttgttgttgttacttctggtctttcatggttttccctgctgggatggcccacagccagagatcatagctagagctccttcctatctggatttgtcactagtgtttctgacatgggatttccccaggcaggctttatttaattcacaaagggccagagcaggctgggtggcaagggataaagcactgggactactagagaaaagaaggatttagaggaataaagaactgagactctgcgggatgtgtgttgattatgaaaaaagaaaaggtagctcaaggagaggaaaatttggacagtgggacactaagtaagggaagtaaagggaaaaacatacaataaacatcagatcttagatgaggaaatagttgtatctgctgggatgcagtaaggggcagtaagacattgcactaggcttccagtaccagcccctgctgtggttaagtggctccggacaagcacttaacccccttgcctgtaaaaccacgatgatccttcctatgccacataattcagaggactcataacatcatcataatactcctttatccatatattttccaaagtttttataatgtatcttatttactctcacatcaattctgtgggttgttcatggcagatattcatatcctcattttacagagaagtaaaccaggctcagagaggttcaatgacttaaggtcttacgtctaataaaactagtatagctagtacagcaagagtcaaacccaagtgtcatataaaggaacacgggaaagtatagattcttataggaaagtaaagtaattagttatcatttgtggtaagtcttggtgtgagtaccagtggagagagggtaaatgtcccatggacttgccagacttgtcacttgaatgtaggattttaggctatttttgctccttgacttctcattttcttttcttgctggaaaacattttaaatattcaaattaccctatagctgttgtacaaatactccagtgccttctgagtcccatctggggcctctgtaactctgttccagagatgcgggccttggcagaactcctgggcccctatggcatgaagttcctgagtgaaaacctgatgtggcatgtgacctctcagattgtggagctgaaggtactatggaaacaatcccttggggaaaagatcctaccttgaggaaagagggtgggtataggagactgggggggaagatgtaacattggtctcttcttttcctgcttaatgtctctgtgttcctggactacagaagctggtggtggaaaacatggacatacttgttcagatcagatccaactttagcaagccggacttgatggcttccctgctgccccagctgacaggtaagcatcctcttcccctatagtgagaaggagctgtggaatcacattgcagatgacagggttttcaggaatctggaggctaggcggggtctgtagaatcaaaatcatcaccaatccctctctaaattatcttttctaacacgcttctttctcctcaggggctgaaaatgtgctaaagcgcatgaccatcattggggttatcctcagtttcagggccatggcccaagagggacttcgggaggtgagttggtggggaggggtctgtcacagagtcacagatacctctgtgggtagggtttgtatgataatttgtggaagtattgcgggaatcagttttaacttctgcttcagaaggggttggtgagcattgagaagagggagcgtaatttggcagagatcctagaagatccctaggaataaatgagcttaggaaacctagaggcataaggagagggatggcttggaaagctggctaggttcttatctaaattgagtgcccctcctttttttttttttttatttctacctatttttgaaggcattggtcatggtcttgtggactcatttatcttctctttcctccaggttttctcctcccactgcccatttcttatgggtcccattgagtgcttgaaggagtttgtcactccagacacagacatcaaggtatggaggagtgcaaagtagaatctaattaggagacttttgttgttgaaaaggaggtagctaggatcttgtaagggagagcgggttctgaagaacaccatagggataagggcgagggtttgaataggaaaactggtcagatgaatattcttggagagaaagagcagagctggcaagatgtagggggatggagagaagtgggaggctgggagacactatgagggttggggagacattactggagggggaggggtaagacctaggatagtatctgtaggttttcacctgatatgagcactgtgcaaattagataaactatgtgcaaacaagtccgctctttagtcttgaggttaggtactgtttataggaagatttgttcctttcattcccacccaccctgcctgccctcagtcttttcttttcctggccttttcttcctcccatccttaagctttctggttcctctatgtctgtttcacctgcctcagacccccatttactacaggagatggtgagaggaagaagggcttccacagacaatataagttaagcatccatttcccacccatctcccacctttgagtcatcttgtcttttgaatcatctggaactaagaagtatgctatggcaggaaatacagctagagcctaggaatagaatccttcaaatgcatagggcaggctccttctcttataattgattcctttaatggagagtggtctgtgttaagaggaaactagttagcaggaagaattaaagttatgtgttaagaaaatcttcattactttgagatcaaaagagttgtgaaatttccacctctatctgcctaaaatcatgaggggcaagtgactgtgggggcagtgagggggcagtgtttcactaggatagctgcccctcttgaaagatctttgattttaagctgagcctgggtttctggcacctgctgatgttggtccaaatgctctaggctgtcaggagcttgtctagctgatatctcctgggtagctccaatctttaggctctgcctgcctgtgaaaataagcaggtaggggcagagagggaggatggcctgtccatcagagatgctgttactgcctcagaggagcaagaagattagaagaagaaaagataaaatcccttcaaccatccctttcttcctccagaaaacctcatgaaccaggttccttatctctgaggccgtggttccacaaacggtcatttaggtagtaggggatttaaataagggcagaacagaaggtggcaaagatttggcttctgtatcagtaccacagcaaagtgtgtgtatgttggtatgtctgtgggattctttttttttttcttgagacagagtctcgctgtgttgcccagtgctggagtgcgatctcagctcactgcaacctctacctcctggattcaggcaattctcatgcatcagccccccgagttcctcctggaacttcaggttcatgccaccacacctggctaatttttgtatttttagtaaagacagggtttcaccaggttggccaggcttgtctccaactcctggactcaagtgatccgcccaccttggcctcccaaagtgctgggattacaggcatgagccattgctctggccagtctgtgggattacttgcataagatacttagttgtccagtattaaaacaattatccttgttctttcaaaaaacatttttttaaatctaaaaaggggtctaggtacttagtatgggagtaggggcttggggctgtgtcctgggaacctgattgtaagtacaatgagacattcaggtatcaatcaatcaatatttattgaatgccttctatgtgctcagcattatgttaaacactagagaaggtaaagagaaatgcaaaactcctgactttaagataaaggaagaggatgtaaaggcatcacattttctctgttagtcactagggtcgatgtgtggtctaatttaatcttcacaacaactatgtgaggtaaatgttattatgccagttttataggtgggaaaatgagggatcaaagaggttaagtaacttttagtcaaggtcacacacttaataagtggtgttgctaggacttgaacccagatctgtctcactccaaagctttttgctcccttcactatgccatgaggttttaaaaagctatctatttggcaagataaggagatgagtcttgcattccatctaaaaagataactaacaccagatgctgtgtgtgatcaatgctaagtcagtggtaccaacgtaaggagggaagagctggctttgggctgaagtaatcaggtagcgctttacagagaagatgagatctaagggatggacgtaacagatataaatagaggagagaaaaggaccctcaaaagagggaagcacctgaaccagagtatgagagaggaagttgtagtttggggacagtgaataaattatcctggcagcaccgaataaaggaagtatttaggaaaatgaagttgaaaaagtaaatttgtacgatggagtgtcccaaagggttattttccctgtaggatagggagagctatgaagggaatatatagagaagatgacaataaaccagaagtttaaaatctacgattagctggacactgtggctcatgcctgtaatcccagcactttgggaggctgaggtaggaggatttcttgagcccaggagtttgaaaccagcctggacaaaatagcgagactctctctttctctacatatatataaaagcatctttaaaaaaaaaattaaacctgtgatccaaaagtcctggctatgcattccttctgtcaagccattgtgtcctgcgaatcctctctagaatgttattttcttctctccaggtgaccttgagtatctttgagctggcatctgctgcaggtgtgggctgtgacattgacccagccttggtggctgccattgctaatctgaaagctggtaagattggggaaagggggcgagatttgggaaaggagggcttgggccttattttgggtgaaaaaatgtcaatgtcaaagaagcctttatttgagattatatattcagaggatataagctgggagtgaaggaaggaccctaaccttcagaaaatacttacataggcgatttagatttatcctcaggtttcaactagttgatctacatcctcaggttccaactagttgatctaccggtcagctaaaaagtactaagtgagagtctgtttggtgctctgcaagtgctcaaagccatttacaatctggttgggaaaataaattaatgcaaatgaaacaatgagagaacaatacaaaatagtgggttgtgtggtatagcacccaaactccccatagtgattttgtgctttctccctccacataatcaccttgacactgtttatttcttcccatctcacacttaacacttttattttccattacacatttcctctgatttcagtcatacctatacacactcagaacaggatgaaccaaggggctaggattaaggcctttcaaaatggccagacttacccttcttcttctctcatggtgggtgagaaccttttgtcttctttctgcctctccatcctatcaggcagtggacaggcatcctagggttgcattgtacatcagcagagcccttggctgaaagttctgccctgttgccagggaggcctccaggactcaggcccttcactataggtggatgctagtcctgtttcttcaggaaaattaagtaataacttgcccataggctttataaagtgttttcatggatattttctcctgcgatcctcacagcaattctgtgaagtaggacccctgtaacagataacttctgtttgctgactttattcacttttcctcttttcctttttccctctcaccagatacttcatctcctgaggaggaatataaggtggcctgcctgctcttgatctttctggcagtttccctcccactccttgccactgacccttcttccttttatagcattgagaaggatggtaagtaaggggtaggtttgagacaccagtgctattcaagttagtgtcctggggtagagagaggagacagagatactggaaaatatagacttctgacttgggtgtaaagttctgtttcaaaaagcacttgaaggctggacaccgtggctcatgcctgtaatcctagcactttgggaggccaaggtgaggtgggtagatcacttgagcccatgagttccagaccagcctaggcaacgtggtgaaaccctgtttctacaaaaataaataaactagctgggcagggtggcctgtagtcccagctacctgggaggctgaggtaggaggatggcttgagcccaaggggtcaaggttgtagtgagccatgattgcgccactgcactccagcatagtgacagagcaagaccctgtctttaaaaaaagaaaaaaaaaagaaaagaaaaggaacaaaacaccaaaacaccccctaccctgaaaaaaaaaaaaccagaatgagagaatgaactatgcataattcgatttcaataagatttcataggaatatcctgcctctaatctcaaaatgccttctcatccttttggtgtcaaatactggtggctcagcctgaaaacatgagaaattactagtttgggtcatcctggagtggcttactttgtcatttcctcttttttctctccatctatatcaataataacctaggttacaacaacaatattcattgcttgaccaaagccatcatccaggtgtctgctgccctcttcacgctctacaacaagaacattgaaactcacctcaaggaatttctggtggtgagtgggtctaggttataaagaatggaagattgcaaagggctggaattggtttgacttaaatctgtagacaattatcgttgaacaggcttttgagtctaacttcccacctaattcattcagtaaagagtgagaagctactatgtgaaaggcaagagtttcttctaaatttcctaacagctggtgtttcagcctctgcttgaatatttggaaagatcattggacaaagagtcagaaaatctgagttctgatttttgatctgccattaagtagttgtgtgacctctgaagtgccaagattttggggccacggtattttcatatataaaacagtgagattaaactgaacccatgaattcagattaaaccgaatccatgaaccttggtatgcatcagaatatcttggggagcttgttaaaatacagattcctgatctttacaccagacctactgagttagaatattgtagggtaaatctaggcctctgtgtttttaataaggcctctgggagatcagatgcacattcaagttgtagagacactgagttttatcatctctaaggccctttctaactctgtatggacaaatgatcaatgactacttctcaaactttaatgtaaatcagaatcacctggagagtttctaccttagtagattagggtggggctgaataatgtgcatttctgttcccaggtaatcttgatgctgcttgtctgggaatctcactagaaccaatggtctagatttctagggactggaacttaaaactaggcagcggattccactgtaggtcatatccaatttcttaaaaaaaatgttaaaaattttagccaaaatttgacttcctgtaactctcaccatggatcttaattttgcctctgggaaaactcagaacaaatacaataggccctagaattttccattctaaatcctccatggaggaattttgttcatatacttctgatacatggtccattcccctctgcctgcttgagcattctcagtaacaaagagcttatttctttgcaaagtatggtcccgatataagaaccagggcctcatctgtctccttccaggaggaaacacagcggatcatattgttctctcaggaattataccctcattctgagaagtacatgtcagggatcataagattggttggtgtgtctctatttaagctgaggcacccaaccagatagacctggctctcagcatcttaaatgcaaagaggattcacaccagatctctgagaaggggtgagaagggaatcccccacccttgccttcccttttatcctctgtttgctaaatgcaggtcacctgggcctgggatacaatgaatcatgtttcttctttgatcctttgggggtttggggatgatggagatgacagccatttgggaattgactggagaataccacgagcaagagctgtgtctgaatcagaggctcactgcctctagtcagatagggagtcagccataaacagcctgatgacagtggtgtctggaggctgcctaggaaaagagaggttaatctcctggcatacatcacctgcctttgctctaggtcgtttccctgccccttgcaatctctcccctagcactcctggcaacctgttgtctgcactgggaggtcagtgagatccaggctggcttataggcaacatgtatctctgaaacctaggagatttgccactttcccaccctgagtcttcaggaacattctagcacttcttaactctctccttgatcttttcttaacttcctgcagcctgaggccatttgatactgacctgtataaaaatctgctttacaaattcttcccttacaggtggcctctgtcagcctcttgcagctgggccaggagactgacaagcttaaaaccagaaatcgagaatccatttctctgctcatgcgcttggtaagtaccttatttaaattggtgtgagaatagggaatggaagggccagagggagacttctgtttagggtctttgcatccttgccattcttgtcacccaaaagcattaactaaggacttaactctgcataaccctctgaatgtagtcctcacattctgattaacattctaaacttgtcctataatcccagagtagagtcttcaaggacttctgcaagacagggccttcctggcccctaagctggctgggcccatgtcctgcaatgttcccgagtctgatctgatagggcagctgtgcccgttattggtaattacctgtccagtacatgtttggtttcacttgacaattttctaccactgcatttcttgtttttaagagtactatgaaaagagtgctggataacacagagctgaactcagaggttgaggggtgggggctcagaggagggaaaggattttagctaaaaagctctaaggcagggagcctggtgggccatgaatcaggcagctcctgctgtctcttctccttgcttcccaagctgtgggcttctctctactctggcagaaagttttgggaactctgactcagttaactttaaaagtttttttcctcatggccctgtttccctcttcaacactcttactcactcttttgctctgattctccatgttagtaatgcacttaggtatggacaggaagggcttttgccctgggcccagtgtttaaaaggccctccttgagccttcctctagtagagtgttctggggccctcctctggccaatgggaagaggtagagcctgtaccccaccttgaggcccatacgagagatatctggggccccagaatattttgctaagtagcttcagcccacttgtagggcctgtgttaaacttcttcctactgaggcggaccgtcctactggtggatatacctctagtgcccaagggacgtgtggctggagtttagatatgcagataaggaagtctacaagtgcacacaaaatccctctaactgagggtgggaggagaagggggactgggctggaagcttgtttcttcccttcaccctgttctggtgcagaacttggaggagcccaaaaattcttaattcaaacctgggcttccataagactacaaatgtacattgtgaaggttgaaagctagaatatactagtttgttagcttgatttaattagtcatgtggtatgtggacctccatctgtattcttgtccgaggcccagaaatgctaggggccagggattcctgggattccctccaggtctccttcttgaaatacacaggcactgagtgatatttatgccttagtttctccaactagaaaaaggcctaggctgggctggttaaggattatgagagagaggagaatggacttgggggtggatgtatttgtgtgggatgtgtttggtgaggcaagagggcagaggaggtagatgaggggagagtgagggcagtgcccatggtggtgggctatgtgggggcacaatacatagagcagcagcatggccttggcaaggcaatgaactcttctgagacttcggctctctatccataaaagtgggtaataatccttatgatagagtggttagaatccgtaaggtattatgcgtgaaagtgcctagtacatagtagatgctcagcaaatgttagttcctgctgtctgcagctcattttaggttctggattactttggcatgactcttcacttcctcaggtagttttcacccctgtcaggttggaggtgattctgtattacccacctgtattcttacctccttctgcttagaccccttccaacaccccaaaatgtggaaagtgtttgcccctgtggccttccaatgaagccaacagagtgacgggaacagagctaggatcaggtactttttgttggagggagaaactagagggactagttgctgtgaagcaatttaaatgcaaatgtttccacagagaaattggaaatgaccgaaggtgaaggagctgtattctgagttaagaggctactcatgtagcctcaaattctgaccagcacttctgtccccagagtctttctgttttggctgtcaagcctgggccatgcctgcacctcagtgttgccagtctgttcctggcacaggtttcctggggaaagacatggctcttatagaatcatggaatcctagatgccagaaccagaccagatcctggcaattagtccagtacttacaagtcataaagatgaggaaactgaagaatagggagggaaagatgacaatcaaggtctcccctaaaatatatggcagatttgggactagaacccaagtttcttggccatcactctagggctgtttccactcccgtaaacttctgccacttgggagccctgttattttcttgtgctttatggagaatagaaagtcttgggccagtggatttgcttgaagtcattattcatttccctgtacctgaggatagcaccttggagaagacagctcatctctttcccagctgagggcttgaaagtcttgcctagcaagaaattctttgatatttaacctatcatcagggctgcagttttaccagcagatttcccttccttcagcctgcagtttctgctcttttgcagctgttgtgtgtgcatgtgtttgagaataggaaaatcttacacattttaaaacttgaaaggacttcagagagagaaacacgttagagtagatatggtagattctctttccttagtgaattttcaggacttggagtaccagatatattgtggagaacccatctgtgtgaattgccagaggatatgggacacctctccagagtgtgttttttagtctcattacctcttggataaggaaggcactgaaggaaatacaccctgctccttcctcagggatggggaccctccagtccaccgctaggctatgctgctcttcatgaacatgccctgtccacccacctccccctcttcaccctcacccccactctcattcttctccgggcatcttgatctatcttcctgcttggctgtgggggctgctgggattaccgcagcacacaggcttctaattaaactaattaatcatgcctgctcctttatgcggcatccttactgttccccaagcactgtactgagagagggaggagactgaggcccaacacaagaggacccatgtggattccaggcccccttccgtggcctgcagtggtgtttgtttctcttgctgcaaagctttgtaattagcacttttatacatctttacctgcatctgtgtgctgcccacccacatgtgatttagcatccagaatgggagagaatgggttttgctgcactgggaaagtggttctctcctgctgtctgcttctgtgcccttcacatagtcctgatgagggggtcagggtcaatgataatggagctgaagatgccacattgccttcctgcagccaaaccaagtgagggaagaggggggtgtgatttggaaccctgttcacttgtaactctcagggcctcagagggcctgggaactatgcaaaaggaacagggtatcacagacaaatgccctacctgaggttctcatctcttggccccatctctttcaggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctcccactggagctgctattgtctcctgcacattcattaggaccattatcttctctcttcctttttcaaatgtgttcagcaaacattcaacctgctcctactgcagagtagcagcaaaggagcccctcttttcctttgtggggctcttcgaggggtcattgggtctcttcctttgcccccagcttgactgcgtttcctactggggcaaggaggaagtgcccttcagagatgttcactgcccacctactctactacattgtttgttacaagttctctcttgctttaacccctcctgctttgatatctccacaacccagagcagagggtcagttagtctccgtcaattctaggttacatgacaactgattggcccagacttaggtgggttttccctcctgtaccatttgggggtactctgccttttattgggagggactaatttaaccccaaatccttttgtcagcctgggtacagctgttgctccaggaagggatttctcttctggatcttaaatttcacagacctcattaggttgtatggccctgagagtgggtatccttgagggagtacaagctgtttcaacttagcccttttctgcgctaattagaatttcaagcgtcacagagcctgggggctttcaagatagcactaaactaggtttacttaactccttggcaggaaatagtggcccccatgcatcacttctgtgaatccactgccagggagaagtggagaaacagatcatatatgtcacaggtctagagtggttggaattgacaaatataattagctagttggttaattagggtcatgtccatactttcatgatgaaagggaagcagttgtcggttttcagcaaaaacgattcagccttcctgaagcctatttgatagctgttttggggttttgtacaggtgtttgctttttatttcttgagacccaggcttagtcaatactttcttaacttggcacccataatcaacatacagatttttcttagcaacagttgtctgctctttagggtggaagcgatagagaatcctgcttcgtgcatcagcaaatcctccttccttgctatgggaagggcttatgttctaaagggtgattcagtgtcaggcttatgagactgagagtaaagttgatgaggaagagaaggctcagaagtatctgaacaactactctatatgtttatatttttctgcttgaggggatagagatccctcctccatctgcatctgcatatagaactgcttaagaggacagcaagacaagttgctgcagggggatggagggtagacagaatgcctttttttaaaactgaaaattttattgagatacttaatccacctgcacttgtaagaaatcatacagagaaattctattttcctttacacagtttccctgaatgctaacatctagcaaaactgtagtacactgccacaaccaggataactgacattgatataatctactgatcttgttcagatttccttccccagttttgcttatgttcatttctctctgtgtgtgcacgtgtgtgtgttatctatttctatacagctttatcatgtgtaggtttgtgtatctgccactgcagtcaacatacagaacaggccgggcgcagtggctcacgcctgtaatcccagcactttgggaggccaaggcaggtggatcacctgaggtcaggggtttgagagcagcctggccaatatagtgaaacaccgtctctactaaaaataccaaaactagccgggcgtggtggtgcatgcctgtagtcccactactcaggaggctgaggcagcagaataacttgatcccgggaggcggaggttgcagtaagctaagatcctgccacagcattccaggctgagtgacagagcgagactctgtctcaaaaaataaataataatttaaaaaaagatacagaacagttccatcaccacaaggatccctcgcattgctcttttatagcaattttatagcaattttctcc

SEQ ID NO: 13409 - DNA, 21394 bp, Human
caagtgttctctgaatacctactctatactaaccaggatgtacaaaaggaaaaccaaaagcgcaaaaatcctcgatctcgtggaatttacattctaggaatctacagacaaataaataaaaaagtcctgttagatgacaatacatgttattaaaaaaaagacaagaagtgtgtgtgtgtgtgtgtgtgtgtgtgtgtgtgtgtgtgtgtgtgtgtgtgtgtgtgttggacagggcatcattctagacttttcttcctcctcccttccctttgatctgattagcaaatgctttaccacctacctccttagtatttcaccttttcttactcatattcttcaaactcatggtgctactttaatttacacagacacaagaggtttctttctctacccctactaccccaattcattcgcctcactttggccagagaaacctattgaaaataaaatctgatcatgttagcggctgcaattgttcagcacccaggcttgtcaagcaaggtactctcgagcgcccccgtgggtgaagaaaataacaacatctatagcctgagaaatagcagaagctgcctctaaaaacaaaatttattttcgaaggcatatatttcaaactttgaaatccatgtgaattttgcaattgttccataatatagccctgatagttttaatatatttttaatgttttaactaacttgccagccaaattattcttttagcaccacccccaactccaaagacccccttccaaacaggtgctgacttgagaccgtgactatagagcacttgtctctaaaatgtacaaaatgaagagaaatctcaagatgtcccactgagatgaagaaagaaagaagaaaatatgtatgtttgtatacatgtatacatgtatatatatgtatacacaaaattagaaaagttagggtctactgtataaattaaataagcgttgacagtgcttttgattttaatctgtatgtggtactttgcctgcttaacacccttatgtggatttcctgacggacttgacattcctgtcaggaaagcattgcgtacttgctgattaaaaagcatctaagggccgggagcggtggctcacgcctgcaatcccagcacgaggcaggaggatcacctgacgtcaggagttcaagaccaccctggtcaacatggcgaaaccccgtctttactaaaaatagaaaaattagccgggcatggtggcgcgcgcctgtaatcccagctactcgggaggctgagtcaggagaatcgcttgaacccgggaggtggaggttacagtgagccgagatccgtctcaaaaataaaaaataaataatgaaaaaaattaaaaatttaaaaattaaaaaacatttaaaaaagcatctaacttagatgggtaatgggtcaaaagaaaggcagactgccacatgcagcgcctcatttggatgtgtctggagtcttggaagcttgactaccctacgttctcctacaaatggaccttgagagcttgtttggaggttctagcaggggagcgcagctactcgtatacccttgaccgaagaccggtcctcctctatcggggatggtcgtcctcttcgaccgagcgcgcagcttcgggagggacgcacatggagcggtgagggaggaaggggacacccgcctagccagccagatcagccgaatcaaccctggcgatcaatggggtgacagatgtcgcagccagatcgccctcacatccgaggtacccaggcggcgcacaagctatataaacctgaaggaagtctcaactttacacttaggtcaagttgcttatcgtactagagcttcagcaggaaatttaactaaaatctaatttaaccagcatagcaaatatcatttattcccaaaatgctaaagtttgagataaacggacttgatttccggctgttttgacactatccagaatgccttgcagatgggtggggcatgctaaatactgcagtctccattggtgaggtcgtcccggagcctcgcccagctcccgcgcgctagagccgcctgctggtctcacccagccgggaccgctgacctggcgctttgtgcggctccaggcctccgagtggactccaggtctgtctccctcctgcggtcgcccccttcctcgccctttctctcttcttttttttccctcccctttactctctgagtctcactctcgcattcttccctcactcccccagttcagtccttctcttgtcttttcttcctcttgtcctttgtcctcctgctccatccagtctgggcagaggtgggccccttggctggagctggggtccttcttggctcagtgtgcgtatttttttttaaaccccttctgcggagtctgaatgcattggtggaaggtgggctcggatcgtccccgggcctggctgggctgccgctacgcccctgcatgggctgagcggggaagacgagcatgggagagtgcgatctcagatggccaagccctggcccccggctcgttttacaaggccgggggctcatctccctgtaggggtggtggacacgcgggacccggggggcgcagccaccgcatgcgtgacggtggacgcacattttgcagacagtagtagtactcggcctgttcaccttccagttgccgtgataataaaatatgatgatgtatgtaaaagcatgaatacttgaagagcttccagtggctgtgcgattttccttcgctaccctcttcaacgcctgccaccccctatcccccagctgaatttggaaaatctgagattctcgaggtcaaaatatataatattctgaatttgtgaaatcccgtactgctagcacatatgtttttacaacaaatggccccagcttcccaagatccaggataagaagtcataaatagaaatcatataaaagccaaggtttttttctccatgttttaaaatggtggtttttttttcttgagtgagggaaaatgcagcaacaaaaataaagaacagtttcccgtgccaaaatcctgaatattcatttcgcccctgagcactgggttgaagacgcgaaattgggactgttggtctgcgacgagctgctgcatttgtatttcagaaagcctgaaaagctatcatggcagcaaggcccaagctccactatcccaacggaagaggccggatggagtccgtgagatgggttttagctgccgccggagtcgaggtaccttatatgctgtttcttcacggatttgtcatacagcttttgagacctttgaaagaaaaatacgttttgaagcaccgttcagttctagttctcgtccaccaaaatcacaggcacgcttcactgagtcagataccatccctgaagggatttttctttataattagaacgtagttgatggaattctattttccttttgacttttacttaattattggcttctgatctagcaccagtgaatatttattaataagaagaaaggaaatttacctgaaaattgtcagttactctgagctcttattaattatgcattctcagggtaaatttcttgttttcttcagtggcttcaaactggcagccttggtatcttgcttacatatgtgtgtgtgtctgtttttgttttcgttctgttcttttagcttcttagtatggaaattttcaaataccaataaatgtagagagaacattgccatgaattctatgtactcatcacccgacttcagcaatcatcagctctatgctaatcttgtttcatctatcacctcccttcccttgttttgtgggagtattttaaagcaaaatccaaacatcataacatttcatctgggagttcctcaacattttcctctaacagatgaggattttaaaatgtaacaatattattatcacatccaacaaaattagcaattctttgtcatctaaccttcagtctgattgtctcaaacaggcattttgtttgtttgtttgtttttatagtttgttttagtttggatctagacattggtctacgcattacatttaaaatggttatgtttctttcggtattttaaaaacctgtaagtttcctcttcattttttacaaatttatatttgggaatattttcagatttatagaaaagttgtaaaataatacagtccctcattcagtctcccttaatgataacatcttacatcaccatgtcatattacaaaattaacattggtgcatgactaactaaactacagactttattcagatttcactgttttttctactaatgttctgggtttttttttgacggaggctggctctgtagcccaggctggagtgcagtggtgtgatctcggctcactgcaacctccgcctcccaggatcaagcaattcccctgcctcagcctacctagtagctgggactacaggtgcacaccaccacgaccagctaatttttgtatttttttagtagagacagggtttctccatgttggccaggctgatcttgagctccagacctcaagtgatgcacccacctgggcctctcaaagtactgggattacaggtgtgaaccaccacgcccggccctttgctaatgtccttttactatcccgcgatccaacattatatttattcatcctgtttccatagttgccaacaatccatgacaatttcccagtcgtttccttcattttaccatcttgacggttttgaaaagcactggtcagatatttttgtagaatcctctacaaattgggtttatcttgtttttttcatgattagactgaggttatgggtttggggaaagaatgccacagaggtgaagtatgttcacgtcatcatattaggggttacgtatcaacatgagttgtcactggcagtattaacctggatcacatggttaaggtagtctctgccaggttgctgcattttaaagttactatgtttccttgtattcttctgaagcagatcatgaagtccagcccacattcaaaatgatgagaattaagctctacctcctgggtgagggagtatctacatttggaatttttatataaggaagatttatctccactcatttcttcagttattcaattctttgtgtcactatagacctaagtatattgattttatattttagattatagtctgatgacttaaattgcctaaattgtttcagctttagccactggtgctctttcaggtttacctttttttatttcagattggcctcttttttgttctcagcactttctgacagtataaaatgctctgtgctcatcttgtattaatattttcccttccctagccctagaatcaggaatttcttcaatagaaaaatggtattaaccagccggcacggtggctcacacctgtaatcccagtactttgggaggccgaggtgggcaaatcatgaggtcaggagttcgagaccagcctgaccaacatggtgaaaccccgtctctcccaaaaatacaaaaattagctgggtgtggtggcatgtgcctgtcgtcccagctactcaggaggctgaagcaggagaatcgcttgaactgggaggcgggggttgcagtgagccgagattgccccactgcattccagcctggacaacagaacgagactccatctcaaaaaaaaaaaaaaaaaaaggtattaatagccaagatctgggtgctagatgtctacgtttgtttctagtgccatttatttttggaagaaactgccctgtagaattttccctattctggatttggtttacttaccctccaggtgttgccttgaggtaacatggtaaagtgaggatacctttattttaacatgctcctctattctctgtacttcccataaattactagctggacccagaggcatgatcacttcaggctccttttttctttctctttaactttttttttccctgccagactatgtcagaagagatactgtgaacacacttctattgtatcacatcaggggttgtctcgttttcagtgatgccgaccttcatcggtgtgttcctgtgatatcaaccccaatccacacattatagtttctcccatattcttttcaacttgtggttttactagctattgatcatcatcattgttagggattacaaaatggcaattctttcaatttccatcatttcacctatgtttatgaactgtgattctcttctaagagagtacttgtcactcattaactatttaattactttaaaatatgcttcatataggaaaggcgaggtaaatgcttgattataaattttcacaataatgcgttgttgccctagcaacctccaaagatgcaaatgtgagttgttgggttatgcgttttgtgtttgttctttgtttttattttttgcctatgacaacttgccacatggtgttttacaattttctaaatgagttgacatcattttcatatgcaaattctgatttctgacttgtctttagaaattggaagatgtggtgatcctgagctcattttcacagggcagcaattgttggatctgaataaggactgccccacctcgccctcttgtttcagggtgtgtttgctaactgttaagaggaaagtgaaaaacattcatggtcccctgaacctgctcaacttcacttgtgtctgtcatttttctaacccccataggcttctgagtttgtaattcttgatttatttcataggttttgaatggatgtcttatatatgtatgcaatataaccctttgtcaaatcttctctcttcattctaccctgcccctcctactcacctatgagtcaacatttttagttacagtaataaaaactcaaccctaaataagttaaacaaaaaaagaacatgagtcatctgacccacctaccccagtccaatcacaggaacaggctgatcaggtagagtaatgagcccactcctcagaccagactggatgaagctagattggtctctctcccagggtgaccacatggtttacaaggtggtggggaggggccctccccgtctctttgccagctaagtttgtgctcacatagatctgagacagtcgggagggaccagctggcagccaccagacaagtccatgattctcaatatcccacgattgggttgaacctaaagttgaagcacacacatctgagtaactaggtcactaaaacctactgaaaaacagccttttctaattcagggagttctcaatgctggtcagtcacttaatttgagtcatcattgacattgctctatgttggttgtttcttccatgcttggaactttacttgcccgaagaccccttaaaacccaggcaaatcccctttgagacgtggaggatttacaccatttctaccattaactgggagcatcagttgagcaccttgtccctgcatatatcatataaactttctgagctaaatgtggtggcttgagcctataatctcagcttcttgggaggctgagggtggcaggatcccttgagcccaggaggttgaggctgcagtgaactgtgattgagccactgcactccagcctgtgtgacagacctctaagaaaaaataaataaataaccctttctgttaactaatatgatgttttgacttttgattttagtatgttgtagtacaaatatccagggacaaattcctcaactgaatctatctgagagacaaattgtcaattgatccaggagtactgcctgcactacatctgaccatctaggcttcgagcattgttgccccaaggatactgttcatgagcattagatggagatcctctgggagcattgaggctcctttcctcacaccatgagcacccactctggcaagtagcagaagccaagcctatgatcctgattctgccccacccctccaagttgaatgtttttcaactaaattcaccaattgttaacattttgctacatttgctttctcccttccttttttttctgaattgtttcaaagtagttgcagacatcagcatgtgtcttcctcccaatgttacaggaaaggggtcctgatccagaccccaaccgagggttcttggatcttgcagaagaaagaatttcaggcgagtctgcagtgcaaagcaaaagcaagtttattaggaaagtaaaggaataaaagaatggctactctatagagcagtcccaagggctgctggttgcccatttttatagttatttcttgataatatgctaaacaatggggtaaattattcatgcctcccctttctagatcatatagggtaacttcctgacattgccatagcctttgtaaactgtcatggtgctgtttgggagtgtggcaatgaggacgaccagaggtcactctcatcaccatcttggttttggtgggatttagctggcttctttaatgcaacctgttttatcagcaaggtctttatgacctgtatcttttgctgacctcctgtctcatccagtggcttacaatgccttaactgtctgggaatacagccccccagtaggtctcagcctcattttacccagctcctgttcaagatggagttgctctggttcacacgcctctgacaccaaggcaaaataaataattgtcctaataaccacaataccattgtcaccaccaagaaaattaacactgccttcacaacatctaatatgcaatccatattcaaattttccgttttcccccaaatgtctatataatggttacacgtctgtttagcagttataacagtttcctctcctctgaaatctacttccaatttggttgttaagtctctagttgattttcatcaacaggacctgacttttttttcatgccttcgactcttgagaagtccaggccattatgttcgtaaggtcccacatcctgaatatacctgattttcaccttgtgtgtagattcagggtaaatatttttggtgttgttttagcaggtgtgactgtgcccttctcactttgttaacaacagaagcctcaggatgtcagagtgttctccactggggagccaagtttgattgtttggttagacagagggtgagagatctcccgatctctccattataaatcgacactttccctttatcataattaagtaacttaattaagtcttctgtaaaaaagagcttttccttcctcctaccttttttttttttagcatcatcatttatggacatagagattttattgttgggtgttataatccataattgacatcattctttttgatgcttaaattttcccagatttggtagggattccccttacagggccctccatgcctttctctttcacatttgagcacttccttgctttctggcataacaaaatcaaccttctcttataggacccctagttccttttagggggcagtgatatttagaaaccaagatgtggatgctaagtctgctctttctctctgcttcttaagactgtttaacttggcattttttgtcctgagcctgtatgatatttacctccttttggagggtgaggatatctttttaaaaaattgatgcataatgtacatatttggggaatacatttgatattttgatacatgtgtatcatgtgtagtgatcaaatcagggtaattaggatatccatcacccacctcaaacatttatctttcctttatggcggaacattccaattctcttctagccattttgaactgtgtaatacgttattgttaactatagcctactgtactatcgaacactagattttatttcttctgtctagctgtatttatgtaccattaaccaacctcttttcacatcccattcctctctacacttcccagcctctagtaagcaccaatcaactttctatttccatgagatccacttttttagctcccacatatgaatcagaacatgcagtctttgtctttctgtgcctggcttatttcacttaacgtaatgacctctgtttctgttggtgttgctgaaaatgacaggattttgttttcttaatggctgaataatattccactatgtatatatacgtttcttttttaaaaatttagtttgatgaagaatttctggaaacaaaagaacagttgtacaagttgcaggatggtgagtatgaaaatgaaacaactgcctctaatactgattttcctttaagagctgctgtttatgtggaagggcaaaagtattcaatgacactgaacattcagaacagtatcctaaaaccaaaaaaagcaagagggaataaatagttgaaattgccaggaaatcacttcttattcaatagttccataaaagctggccgaagggggtgagcagttccttccacatcccggtgaacagctcctctccatccctttcttctcccctctcccctccaatctcttcctccccctttctttctctcccttgccccttccctccttctcatctttccctacttccttcacactatctgaggcatcctggcctgcttgaagtatgcaaataaatatccccatttacatggggtactttctgaagtaaatactacacagaagtgaaatcaacgaactgccccctcccttcacctttaattcctggtcagccctgctccctccttgcccatccattatagcaggagccaccagcagacccataaagaatgcgcccatcaaccctgtgagcagcctccctcccagccaacagcagggtcctcaggcccagctggaggctcccctgtgtggtaccggctctccagggctgtaaggccaccttttgtgtgtgacggtggctggaagccactaggcatgtgctaagtactcctcttgcctctcccctcacctgctccgaatgctcaaaccctcaaggccaagctgtaccctataccggcatctctccccagggtttggtatgtggaaagtgttggattcaggtttgttaaataaaacaatgggttgtttttttaactagtgacagcaaacttggtagtaaacggtctgttctgtggctacagagtagccatagagtatacatgagccaaagagtatacatgagtctcagctagttacttaggtttcatgatcagattctctaaaaacagtgctgtccagcagaacattctacagtgaaggaatcgttctattctgcattgtccaatatggtagccactaggcaaatgtgactgttgagcacatgaaatatgtctagtgcaacttagggactgaattttaagttttaaaaattgtaattaatttaaatttagatttacatagctgcgtgtagctggtgactgctgtattggccagtgtagcactgaagaaatatcttcactacattcccctcaatcccttatcactgtggataggtatttttcctggggtgaaaatgaaaagggaacgtttataacaatgctagttttcagccttcttttttttttcgaggtagagtcttgctctgttgcccaggcgtgcaatggcgcgatcttggctcattgcaacctccgcctcccgggttcaagcaattctcctgtctcagcctcccaagtagctgggacaacaggcatctgctaccacacccggctaatttttgtatatctagtagaggcggggtttcactatgttggccaggctggtcttgaactcctgacctcatgatccgcctgccttggcctcccaaagtgctgggattacaggcttgagccaccacgcctggccccttcaggcttcttttgtggctaaatctgctctcctgaatgaagttaaggttatctgtcatctggaagctttacactatttcctaaggccatgattccaccgtttcttttcattccacagagcattttttaggggttgggggacagagaagaaaagatcacttctaactctgggcttccattctcaggtaaccacctgctgttccaacaagtgcccatggttgaaattgacgggatgaagttggtacagacccgaagcattctccactacatagcagacaagcacaatctctttggcaagaacctcaaggagagaaccctgtactgtggcccctctcgagtgttgtcacttgtcagcttactgatgccttagctgattagcaacctctgtagcacaccacatttactttatgtcttacatagttagtgagatcagggaacaaaaacccaagaaggtcacgaagaccagttggaacttcagtagagagagtctgagtaaaacaaaagaataggattcagatattgaatactatatctagggtgtcattgtttcagatttcaacatttttaaatgctttgatactgctttttccctttcttgcacattcactattgttaagtattaggaatgaggagctgctgtgacattcaaggcctgggagagtgagcattagattataatttgaaatcaaagcctggtccttgcaccccttagatgtatgaccctgggcaacgtgggtataagaatagtacatttctcatagtgtcatgtgatttaatgagataatggatagagagtgtttagcaccatgcctggtacactctaagcactcaataagtggtattcactatttttataaagttgaagtttgacccatacgaagagaccaaaacatggatgctggggtaaaagtggaggagtaggatgccaggagagagagcactcatgactgtcaagctgtctgatctgtgacagatttttctgagttacaactagaattgaccttatatctttgctcttaagagacaggtataggtaaatgcttctagggacttaagttgcagcatctttaaaaaaaaaaaaaaaaagcactctgaattcttagttgtggaaactgatggcttcaaagagaggagaaactgagacaactgcttttttgttttaaggattgacatgtacgtggaggggacactggatctgctggaactgcttatcatgcatcctttcttaaaaccagatgatcagcaaaaggaagtggttaacatggcccagaaggctataattagatactttcctgtgtttgaaaaggtaggtggcagagatgcctacatacacagagcaaccaaaccacaaaccacaaagaagctgccacaaacacccttttctgtccaaggattttaaaactgagcccagttgaactaacctaagcgctaatggactcctaagagcgaatagtagccacagcacaaagctggtgtcttagagccccttggactctgctaggaccacatgattcagaagtctagaaaaagtatgggctccctgcctttgttccttattgttccttgcattcaccaagttcccaccttgtgtggatacagcagaaacttcagaagatacagaaaacaaaaactacctcattcattcattcaacaaaagttgtcgaacagctgtctcagctgacatcctccctgataatttgatatgagtagaagaaccatttccattttatttatcttccctttgctctttttgtttttggttttgttgtttttctcttcttgttatatctgcttttctgagcttcaaattctttattcctgaactgggaggaacttttttagtgtttcaatgcaaacactaaagaagagggtgtgaaaatatgggaagacctatttggcaagcttcctctgaccatctttatggaactagatttaggaaaaaggagaggtattttctggggtttctgtagctaggttttatggtatctttcccacaggcactttgtgaatgtaaaataggataatgaagaaatgtggtctggaacgggcacagaggacctggtgctttggcaaaggttcactgctcattcttaggtcccaagggcccagactgtgtcagggtttcttgcaacacgcctatgaggtgagaaccgttgtcccttttacacataatgaaatgaagtcatgaagagattcagtgacctgtccaaggtaacatggccagaaaatggagagcagggttggaactctggcctctgactacaaattcaggatgcattgtactatgccactctggctccagtagctatatttgacctggaattgtgttcggagtccctgtgacacacacacttgtgcacatgcagacacccatgggcatccaagagttgactgtgaaggggatctcccctttgctactactgcttcttgcctctccctaatcacaatctattcttataagccccacacctatacgttaccctcagaatgggagtcaagatgaactcaagcttttcattttctctgttttgggacatgtaagaggaagtctaattttataattgggttgagtttatgactacacctcttgatgttctagcagcagaactgggaaataagagtgggccccttgaagatgatctatcacttagatttcttaaatcaccctgcccctccccaagcctcctgcatgcatttctgtagatacatttttggagtagatatatcctttcaaaacaccagatgctaaatccagaaataaggaattttcccttccccacttcaatgtctcattcagatccacagcagatatttaaggatgctttcatttccacaccttttttgtactttctctctctctctctcgctctctctctctctctctccccctctctctcactctctctgtcagatatagggtgcgttctcttaattgatgttatttatgaaagcatgaaatgacaaggtcatagtttcacctcttctcagatactgcactgattcaatagcctcatcactctctccatgtggaatattgtaactgatgcacaccatttccctacagattttaaggggtcacggacaaagctttcttgttggtaatcagctgagccttgcagatgtgattttactccaaaccattttagctctagaagagaaaattcctaatatcctgtctgcatttcctttcctccaggtaaataaaactatgtattagaagattggcctagaactcttgggccttccttcagtgtctattgtttggttggctttggggagtgtgtgtgtgtgtgtatgtgtaatatttttaagattctagtttggcaaatgaaatgaaagtaaggacccaaagttatttttctggtccttaaatccttcaagttgaaagatcattgaagtgtaaaattttttttttttaaggtgggatcttactatgttgcccagaatggtcttgaactcctgggctcaagagatcctcccacctcagtctcctgagtagcagggactataggcatgtgccagcacacccagctcagaaattttcatcttaattttgttccataactgcactcctggaaaaaactccatgcacagggagtttgcctcaggggactttccatagaaataaccatagagatgaggtggtctcacactcacatgtatctactgatggaatagtgggcgagataaacatcaaaacagtctcattcatcaggctatgactccctttctcagaaatagtatggtctcaagttaggaaattctaagcctgagctctgagagcaaatgagagatgttagcaccctaaacatcaccccaaaggattcctaccattctccttctgagaattccaaggaaagacttgtgtggttcaaattatccctcagggttattctggcaggattgatcatagaactttaaaggagagaagggcctttaaaaaaaaactcatttaatgacttcaatattcacttgaggaagtagagacccagaataaagaaatcagcagccaagctggcttaggcagtggatgcttgagttttatctagaaccttagccttttatctccaagtctaatgtgcagactgtaactcctgggccaaacctggcctgccacctgtttttatacagcttgtgagttaagaataatttttacatttttaaatggttgaaaaaaatctgtggaataatatttcatgacacataaaaattatatgaaattcaaattctagtattcataaatttcattggtacaaagccatgcccactcatttacacaatgtcaaggttacttttgtttttctacagcagagttgagtagatctgatagagaccatatggcctgcagaacttaaaatatttgctgactggtcctttatggaaaaagcttgccaatccctgaaacagcctggatacagaccaaattgctatatgtttgaccaagttatcaaaagccaagagagatacactaactctccaaagagtaacacacatacttaaaacaattttttgccaagtctattaaatattttgatatactaatgagagcaattaccaccagttcaataagtacacccagaaaatgagaataaaaatcttcaacaaggcaataaaccaccatatcatttatgttatagtttatatttttttttcaatttttttttcatttacttttgcagacacagagattgactttccttaatttgattttattcattcagaacttaggatacttttcacctgaagtattcttttgcactgttaaaaaagttacttgtttagcagagaagggaaattagaggaagggatctgcaacttgttgagtgccagcttcattccagtcagtctgctaggcacttacatgcatttgctcatctgtcccgtcaaccccaccccaataaccctaggagatgggcttcactatctccattttacagatgaaaattaccagcttggaaacattacattctgcatagttgcaagactgtggatgactgagttgggagccacaggggagtcagggatctaagtctgtactctttccactagactgtgtggtttctgagaaacacatttagaagtactagaagtacctttggccccaaataggtgggatgctgaacccagaagtaggtagaatgctaagcttattaaaggtgaaatctaggccgggcgcagtggctcacacctgtaatcccagcactttgggtggctgaagtgggtggatcacttaaggtcaggagttcaagaccagtctggccaacatggtgaaaccccatctctactaaaaataaaacaattagctgagcatggtggcatgtgcctgtaatcccagctactcggaggctgaggcaggagaatcacttgaactggggaggtggaggttgcagtgagccgagatcatgccactgcactccagcctgggtgacagagcaaaactgtgtctcaaaaaaaaaaacaaagtgaaatctttccaggcatgcatatatatacatgcttgtgtacacatagacacacacctcacaggcagtaaagtacttttcattgaatggacacaaaagattttaaaagtctagggtaaatgatagagatcaaggttttttggtaaactgtagcaccaggacctattggtattttacattgatgatactataataacaacccttttttaagccccaagcattatctgcgtaaatacagttttaatctgtgatcagattgagcatcaatattttaaaacttcagaatcggacaccagatctgtgttgaatttaaagggttattcctgtgttgattaatggatttaaaaagtcacaaaaattttactatactttgataactatgaaccccagataaatcttgaaacaatacatcatttggaacaagattctaaattttggtataatatttaaaatcatacaagtagagcttaagtacgtaatgaaaagagaaaattgtcatatttatatataattaattggcatcattattagggtttttgttactattagtgacgtatgtatgtttgtgtgtgtgcttaattaaggctgtgccttgcacataataggcaattaataaatagtagctatttaaaatgacctcttcacttttaaataaatggttttatttaaatatctttaaaaggttttattagaataattatatatgatgagcatatgcttcttcatatagttcagatttttcattagatcaaatgggcttttcttctcagttactgagaattggtaagatttgattctgtgaatgaaaaatacaatgtttttcttccattccagtttatataaatatctggtatctgagccagaggctatgaaaaaaatgcaactggctatttcctgcacatagccagaaagaggattcacttactgataggagtaaaaactctgaagaagctgaatcttaagatataaattgtaccatctagtgactttttaaagcacctttacttaagtggctcatgcattttctcccagcagatcagtgcacttcaggtggctagtccgagtggtgtttacagctaattgatcacaaccagttacagatttctttgttccttccccactcccactgcttcaaattgactactgttaaaaaacaatacaaaacaatacactggaggtgttttcagtgagttttccccttccttttttttcaccttaagtgtcataattctattttgagtatgtttttacttttgccatttctgtaaagagtgcttacctttttgtgaacctggagatttgtgtaaactctgatcttgataccggtgattgatgacagagattgtaaataatcatagagatcagatcttaacctagccttgtccaacccacagcccgcgggctgcatgtggctcaggacaactttgaatgtggcctaacataaattcataaactttcttataacattatgagatattttgaggtttttttttcagctcattagctacctttagtgttagtgtattttatgtgtggcccagtgaagccaaaagattggacacccctgctaaacaaatgctaaatttcatttctgcttggaactcttcaacaagtatttattgaacaaattttggtgggccattttgcataaccatatcttcgtagtatctaataccttttttgttagccttaaagttttggttttcctttttcaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaacgagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtattagccaaaataaagaatttatgagtcattgctcattgtcttgttgtgagaattttttaattagtttttttcaaatatagaatacatttgcacggttcaaaaatcaaaaaagtataaaagggtctacagtcttggaagtcttttcaaccctgcttccccgcaaccgaatcctgcttctcacaggcaaatgcagttactatttgtgtacccttccagttacatctgacacatgtataagaaaatgcaaatatatattatttttatcttcttactacccaaaatggttatttgtaggcttctaattttttgcatttcagaactaaaagtatggtctgttaatataatgctgctgttaaactggtgttgattcacgtctcaaatactcatcaagcatcaactgggctcagggtctcccagcactttaggaggccaaggtgggtagatcacctgaggtcaggagttgtagatcacctgaggtcaggagtttgagaccagcctggccaaaatggtgaaacctcatctctactaaaactgcaaaaagtagctcggcgtggtggcgcacccctgtaatcccagctacttgggagcctgaggtgggagaattgcttgaacctgggaggcggaggctgcagtgagctgagatcatgccactgcactccagcctgggcgacagattgagaccttatctcaaaaaaaaaaaaaaaatactaatcaagcacctattacatgccaggcagactgccaggaggcagaatcgtagagcaaagcccctgctttagaagaattcagcatagggtagggggagacacacatgtaaacagcagaagtaattttaaaaaggaaagaattgccgcttttggagtatctactactcagaaattttaaaactaaggaaaggcaagtttttgatgagagtctcactcatttatctcgctacagaagggattttttgctcagtggaaacaaaagaagaaaagacaagtgggaggtgatcattgtctgatgcaatcaatactgttttcgtcagaggaaaatcaagcgcaaacatcaaggcagtgatttgccttcatatttacataatgtgagcactctgttatcaccctgatatttaaaattcctgcaagagcaaaagcctggtggcaggggcagccccgaggcaggcctgaggaacagtgctgacctaggctgctgttctgagaaagaggcccagccctggccaggcccctgagtgcagtagccaataataaaaaaagaaaatgggaagtgtgtagtaaagactttcaccctgccccaacagaggtgtggcctttgcttctggaaggcagtctctaagtcctttgaatgctagacctgacaggagtgtctttgtttgcctgggggtcttgggccacccagctagtaacaatgtgatttagggtgagagctttgagccacaccagcaatgtgatactgggtgagagctctggttcacgtggtatcagctcaactctggagggagtgaaaacagatcacctgttgggcagtcagccaggcctacctgatggaccccccagtaaaaaacctaggctccaaggcttgggtaaacttctccagttgacaatacaccatgggtattgtccttcgaatgaatcatgaatcatccaacctaagggtggttcccctcaaacttccctctaaactcttcagggaagataaacattttacacacatttagagactatacatgagaacaaacagttgacttgacaatcctcaggggtctgtattacaggtggagcagcccaaatctgaaatccgaaatgctcagaaattcaaaatgctttaaaatccgaaactgagtgccgacatggagctcaaaggaaatcttcattggagtattttggatttgggattttttggtttgggatactcagccagtaaatataatgcaaatattccaaagtccaaaaatgttctgaagtcagaaacacttctggtcccaagcatttcggataagggatactcaacctgtactgagttttgtgggatggc

SEQ ID NO: 13410 - DNA, 50597 bp, Human
agaataacccaatgatccttggatgtcttacctacatgggaaacactgtttctccccctctcccactacctgcttttcacggagaagctaacatttattaagcacacactctataccaagcacttttctagaattaaaggtacaaaaggcataagtcatctgtgccccagaggaattcactatttagtgtggagctatctttaaaatgactctatcattaatgtacgaatgcaaccaaaacacagagaggaataactgtgactcaagagatgaacatgagtgtgtcagatggagaatttcaagcaggaaaaacaacagagtgccagaaccatatacagatctggtgaggttggtgggagggcaaaggaggttgttgaaaaggctgtggaaaaattagaatgtggtttgatttctatcccacctgtgtgatgaggatggaaacatcttctcctgagcttcaaacatccctaccacacacagacacacacacacagacacacagacacacacacacaccattgtggaaatcccagccagaccttgggtattcatgcccccaagccctgtgaggggcacatccaatatgaaggctgtgggagaagagaatcctgctatcatgtactcactcatttagcaattaataagtgcttactaaatgttaactctgtagtgcgagggaagagggtatgataaatacacactttctgggtaggtacatgtatgatctagttgccttcacttttcccctgacaggtcattgctctgtcaacacatatttattaaacaatcacttgggggcacggtacctccttcctctcctttccctccgagataaggccaactctaggtgttcccactatcttcaaccccaccccacggtaggctcacaagaacgtcattttgatcacttaagggatgaattttaggtttagatggaggataaacttttggagatggttcctcatatggtctgtctggagactttttgcaataaatggtgtccgtgccatccagagaacataggtcaccagttaatcaagacagtagggaataatgatttacacatgttgacaaattgattcctcttaataaccaggtcaattttttggccaacactatacacatgtacactatgcacataattacgacatctataaaagatagaattaatctaattttatgcagatatgggaagaactcgtcccaagtctcacagtcagtaagtgatggagcctagagttgaactgtttcacttcactaccatgttaatacttttctcaacacattctgccgctctcactctaagtgtgaggccctgtccaactaaaacataatatggtgagttcgtcattgattcaaataatcaactttcttcccgaatcccaagtttatctcttctgattaggaaaaaaaatgcattttgatatgtcgcgtttgcgtaaagcgaggccgaccgcacgcccccttctcgcgagctgctcccctcaactgcgacccaatcacccttgcacacgcctcctgagcccccgcggttcccaccgggcttcaggccacgcctccgccgctgcaccgcctcctctccccgccttcgcccgtagtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtgagcgcccgcggtccccgtccccgccgggcacccgtgtctggccgcccgcgctgcctttgtcttgccctacgcccccggccctatcgcggtccgcgttctccactgcgcccgggggtcctcgagcgcctcccggccccgggagcatcgtccctgctttcgcctagtccgcgtccagggccatcctcctgactagactcctttcttgttcattcattcttttgggttttccccttcattccataaacacggattgggcgctgggagggcgtgagcatgaaaaagtgacattaggtgctgcgagtcttcaacctagtgtatctgcagaccggcaactaccatgatccaccttacaggctcaaaattcgcttttgcggtcaatatgaaagagatttaagttttcctagtaggcctgctgcttttagaaatcaggtcttcaggatgtccacttctgccctacctcatgcaggtgtcttttccttaaacctctccaacttctcatcttccctcccctccaaaacacacacacttcatagctataaattgaaaccagtaaattacggctcagtttcctacatgggggaggaaccttccctttcctgtttaattctaagtgggaatgcatttagagtttcaacattaggatttgcttgtgtctttccatggcctaggtccagcaactaaactttacaaaccagtgttctgcctagagatgaaatgtctctagattctcagtaggttgaaccattgtttattggaatgatctggaatgcagcaatgttaaaactgttgatttagtgtcatctgccaaaactttttgtgccttccctttctgtttttgaaaattacgtgtgtatgcagtacacattaaatgacttcttgagaagtccatctctgtttttgtttttagcttttgccttagatggcttgccacctgtgtaaattgtttatcttttggccagtgttgttatcaatcttggcctaagtgctgacgtgctgttacaccagtgcagaatatctcctttcaaaaagttagttttttttttttttctaagattgggattctacctcctacagctgaagaaattgtgctgttttaaattaggaaagtatgatgactagtaattcacatttctacaaaaagtggtttgtcacacttctttgaacagaaaaagcacagcatgtgttttggtgatgattcttcagttttactgtaaagttcatagtttctttacagcatctgccattttgtatattcatttttgtattgtgtgtcacaggaaaatgtaagacgaaattgggcagggacattatgcttgttcacctctgttttcctagagcccagccttgtgcctggtgtagttggcatcaggtccttgtggcatgaatgagtgaatgaactactatttcaagttcccactgtatggtaactagtcattgtagagcagttcaaagtttgacatttttttgtgctgctctttttttttgagacagaatcttgctctgtcgcccaggctggagtgcaatggtgtgatctcggctcactgcaacctcagcctcccgggttcaagcaattctcctgcctcagcctcctgagtagctgggattacaggtgcctgccaccacgcccagctaatttttgtatttttagtagagatagggtttcaccatgttggtcagggtgatctcaaactcctgacttcaggtgattcacccgcctcggcttcccaaagtgctgggattacaggcatgagccaatgtgccgggccctgtgctgcttttgacatttaactaggtctctctacaaagacaggcagttcaagtctttggtagtcattgtcccaggtagaactacatcaacaggaaatttgcagcacagttggagctcagcaactccttctggagacaacaccccaccccccaccaccccttatccatctttgtcccatttggtgtattcctgcaagacactccaggaatccttaatcttacccttttaaaaaaggcctctcctgttggcaggaagagcatttagaactacctattttaagtaacttttgtagttgttgggtaaattgaagtgggaagagctgaagagtagagccttgaagtacgtgtctctgctttaacaggctttcatggagagatttgcaataggtttacctccttcccactccaaaagatcaaggggcttggaaaagagtggccataatgcaaacttgtattatgcatctataaaggagagaaaattggacccagcatttcagccaggtcataacacttcttgaaaaaattacgctgagcagatctgtggagaattagactttggtattgtattaagactctaataatggctgggcgtggtggcccgtaatcccaacactttggaaggcccaggcaggaggattgcttgagcccaggagttgaaggccagcctgggcaatatagcgagaccccatctctaccaaaaataaaaaattagtggcatgtgcctgtggccccaactactcgggaggctgagatagaaggatcgcttaagcctgggagtttgaggctgcagtgagccgtgattgttcaactgcactctagtctgggtgacagtgagaccctagccccctaccccaaaaaaagatttgataacactgctcttaccttaaaatgtgtaaatgatgttcactgaaaactttctttagtgactgttaagactataccttcacatttcttgttccaaatactctgtcataaattaaatacaaagctataaattgattttttaaacctcatttgaaatgctgcttttaccagcattttactgttttatgatctatcctttctgtttccctagactattttgttttccacaagttcctttgttcccccaccgcccccccaccccactaacatattaatgtcttttggagtggggagtaaacaaactgaggtggaaaactcatcttagaagaaaagcataacccgctgctcattttttattattttaaatttgcttcagttatgtctctgggtggagtatagaatttttgagaagaataacattcctgccctgaagtgttgacagttgcccgacacaaaggaaagaattaagattgtgaagactgcctaggtgattaaagaaaaagaagccccactctactttttcctcctgccatggcacttcagtgaaaccttggtctcccccgcgcttgttctacctcccgcccttgatctgggatgcagatactaattctccattgtggtacctctctacatttctttttttcttttttttgagacggagtctcgctcttgtcacccaggctggagtgcatgacgtgatctcggctcaccgcaacctccgcctcccagagttcaagtgattctcctgcctcagcctcctgagtagctaggattataaggcacccaacaccatgcccggctaatttttgtatttttagtagaatcggggtttcaccatgttggccaggctggtctcgaactcctgacctcaggtgatccacctgccttggcctcccaaagtgctgggattacaggcatgagccagtgtgcctggccacctctctacatctcttatatgcagagagaaggtgtgacttttttttgtggggtgaggatgggagggtctcatcatgcctaagtatttgctgatgcctgtaaccattcctctagcggcatcatcatgtgaatctaatcacccttttgtaagagcattatttttcagactgcaggtcatgattcagtagtgggttgacatacatttagaagattccaaccaggacttttgtgtgtgtgtgtgtgtgtgtgtgtgtgtgtgtgtgtggcaagacacttaacatgagctctacctccttaacagatttttaagtgcacaaatatagtattgttaactacaggggcaatgttttacagatctctagaactagtttatcttgcataattgaaaccatgctcaccgattagcagttcctcaattttcccctccacctagctcctggcaacaattctgctttctgattctatgagtttgactactttagtacttgatataagtagaattaagcagtatttgtccttctgtgaccgatgtatttcacttaacataatgtcctcaagggtcatctaaattgtcccatactgtaggattttctttttttttttcttttttgaggctgaataatattccattgcttgtatgtaccacattttcttcattcttctgtcagtgaacgtttagttgtctctacatcttggctattgtgaataacttcgatgaacattggagtgctaatatctctttgccaacaggactttttaaaatattaaatggaatagggtgaagaatattaatttatcataccatagtaagaatattatgtaaaacttctgagttatcttctgaggaggtgtgtgaagggtaggcttgtgcattggattgcatgtaaattatttcttactatggttcacagttgaagagtttgaaggccacagtctcagatttatttattcaatgaggtgagcctcgtgaaaaagaacaggttagcactaatctttgcacatagtaggagctcactggtacacattctgaatagaagtgtgaagacaggtcagaagcctagtggctcagatgcaagagagcttgtttgtgtgcagaagccttgagaaataactgagaaacaggctgcgcagataaaagtgtgtgtggtagataaaagtgggtgtggtggatggtgtgccacgtggagatgaagaatggcccgcaggacagaaagtggtgttttggatgtgatatgttgggctttatgggcatcatatcaaaatgctgctttttttgcttactgttgcacttatagagccatggacttggattaaaaaaaagacaaaaatgaacttaaaacgcgccataggtatggttggaaggagaggctgccactttagaaatgctcagctctacttactaggatagtgtttgtctcttcacaccagaaagaaccttggatttggggttcagtttgtgttctcatccaaggctgaagtggattgtcttacagaggtgcgtgtatgctggctttttggaactcaggtattttcctgtgagaagctccaagatcagcctacagatgcctgtttcacctttaatatgacaggtcctaactctagccaccatttactgtgctgcttctgtgggaaacagaagttccaactcttaggttccagggagatacctattttgccccaggatgaggagaggtaagggggatattcctgggtgccctgttgcctgctgagaatacaaacaagtaagcccttctgcacagttcacatgcagcttttcagatatgggttttgtttgtaacttagatatgcacattaaaagacagatctgggaaatctatgatgtaaatgtaacaaatatgacttgattttttctgatgactccagtgttagctgcctgccagaccttttcagctacttagtggcagacatatcatcagcattgaaatctgtctgactccaggtccagtccttaaacattataccaggttttgggttatttacaatcataaatttcattgaatttctttttacagatttcaaactgtataggttgtagagggtcagaaaacaacatttaaaactaaacttttacttctaagtttgtaacccagtgcagtggctcttgaaggcaagaaggtaaattgtcctctagttagcagaaaagtccatgtgaactttgagaggaaaatgcaatgtatctttaatctttatgagcatgttcttatgtgtaaaacagagatgagatttattaagggctgatatatcatccattgagtttgaacttccaatttgcctatgctaggttcagaatgctgaagtgactatttagaaaatgcatagctgggaggccgaggcaggcagatcacaaggtcaggagatcaagaccatcttggctaacatggtgaaaccttgtctctactaaaaatacaaaagaaaaaattagccaggtgtggtggcgagcacctgtagtcccagctactcgggaggctgaggcaggagaatggcgtgaacccgggaggcggatcttgcagtgagcctagatcgcgccactgcactccagcctgggcggcagagcgagactgcatctcaaaaaaaaaaaaaagaaaatgcatagcttgccaggcatggtggcttgtgcctgtaatcccagctacttgggaggctgaggtggaaggatcactggagcccaggagttcatggctgcagtgagctgggatcatgccactactgcactttggcctggatgaccaagtgggaccccatctctttaaaaaaaaaaaaaaaaaaaaaaaaaaaggaaagaaaaaagaaaatgcctagcttattaatgaataagtgtatgatcctatttaaaaatacagtcttgagtgataaatttagaatggacaaaaacacaattatttgagtcaaattgaaggttctctatagctttgggcaagttgcttactctcccaacttcaattttgtcatctattaaatgaggacaatactaccttccttgcagggttattgagattaaatggggtaatattagtgaggtggtttgcaggtgcctagcctgttaagtaaaatctcacaaatagcctaaaccatttacttagaaaatttaaaacatccagtatatcttatttaaatagctgtggtcattgaggaatgaaacattccacatatgtagggttttttggtttttttttacagttaactgaaacttgcttgttcagatacaattatattccattaacagtaattttttattgtatttcttttcttttttttaatattatgtatttatgtatttatttatttatttatttattttgagacagggtctttcttgctctgtcacccaggctagagtgcagtgacaccatcacagtgtgctgcagccgcagcctcccaggctcaagctgtttagatcgtatttctaagttgcgcttcaaaaacgcattgacacaggctcaggctaggcttcttaaaataagatatagagcacaaattaattatttcttaataggcattacaaagattcaggttccttctataggtcatagcgtattctgtaacacaaaaagcaaagttgtcgcatctctctatcttttttagctgtcactggacattgattcaacagcatttattgtccgttaacccctacccacccccagaagttcccttgtgccctttgcacgtgtgtgcatgcgtgtatgctagagagagagggggagagcacttcagttgattctggttttccttcagacaccacctttgagaaactgccttaaagagtgtgtggtcattaattagatgaaggggagaaaggaaggcattatggtcaaaagaacagtgtaacaaaggaggaaaggtgagaaataccattggatagtatgtgaaggttattgtgcagtttagtgttgtaaatgcagtgaataggtttagccagcttgtagaagtctttgtctagttctcaaaaagtagaggttatgttgtactttaaaagcatgagaaaagtagaatcgaaaaaaagtgtattagtcttctatacctatctcctacagaaaaaatcttttaagacttatcagttactgtgacctaccatatcatggttgaattcctccatgttaagaccctactgtctagaagtatggtattagcagatgtactcattgattggtactgtctgtagtttcattttgaagcataaacctgagtaacattcagtaagactctgtatgttcagaaaagatgtcacaatattaattgagcctctaacatcactatttatgtttctgaacatttttacatactgtcaaggcatctgaatatattcttaaagttagaaaactgtatatgaagcattactgatattgctggtattactggaaagaccatatcctaacgagcttgctaattagtactctgtttctacatttcatgatataatcaggtgtttttaaaaaaacattttaacagctttattgagttataattaacataaagttaactgcacatatttaaaatgtacaatttggtaagttttgatatatgtatacatcataaaatcacctctgataataagtatattcattatctccaaaaatgtcatcatgcccctttggtaatttcttcctctggccatcccatgcagctgatttgctttctgtagtttgcattttctagattttcatatttaagaaatcatagtttgcatttgatatctagtttcatatacctaggaaatcatccagcatatcctcttttggtctgccttcttagagtctacataaatattttgagatccatccatgttgttacatgtgtcagtagttcattccttttcgtcgctgagtaatatttcattccatggttataccagtttgtttatacattcaccatttgtgttgcattcagtttttcactattataaaaaaattatatgaacattaacatacaagtttgtatgtatggactaatgcttttcttcatcttattaccctaggagtagcgtgttgttaactttttaaggaaactataataccaaacttttccagggtggttataccattttgcattctcactagcagagtatgccagttcagttcatccacattcttgttaacaccggtatgggcagtctctttaattttagctactctaataggagtgtggtggtacgttgttgtatttttaaattgcattttcctgaagatcagtgatgttgagtatctttttatgtgccgatttgtcatgtgtgtatcttttttgtgaagtgtgttaaaatcatttgtctgttctaaaactattgagttttgagcgttctctatattttggatgtaagtattatcagacacatgctttgcaaactttgcaaatatttcctctcagtctgttttcattctctttttttattttttatttttttttgagacagagttctcactctatggcccaggctgtagtgcagcggtgcaatctcagctaagtgcaacctccaccttccaggttcaagtgattctcctgcttcagcctcccaagtagctgggatcacaggcatgcgccaccacgcctggctaattttgtgtttttagtagaggtgaggtttcgccatgttggccaggctggtcttgaactcctgagctcaggcagtccgcctgccttggcctcccagagtgctaggattacagtcttaagccactgtgcttggccttatttttatttttaagagatgaggttctgctatgctgcctaggctgtcctagaactcttgggctcaaacaaacctctgccccagcctaacaagtagctgggacttacaggcatgtgccacctcacctggctaatggcatactcttttgattgctgaatctttataataagccatgagatcatgtagtattagctctctagctttattctttttcaactggtttgactcttctggatattttgaatttccacgtgaattttagaaccagattggcaatttctacttaaaacaaaaaaaccctgctggggttttttattgggattgcattgaatctgtagatcagtttgggaaaaattaacatctcaacaatattgagtcttcaagtatatgaatatctctccactctacttacatctttcatttctcccagcagtgttttgtagtttttcgtgtataggtctttcacatcttttttgtcatgttatccctgaatgtttctcatgtttcagttctattgtaaatggtttccccggaccttcagctccatctcttccacccagggagtccactgggctcttcttcaccttcctgcccatgacctggagcctctccccaggcagtaagtgggggcaattgtagggcccactgattttcccccgtttctcagggatcctttcttatctgatacgcagtgtcttgaaaattattctttcatatattttctcttcctctctcttttttttttttgttttttggtttttcaggtaggagggtaaatttagcccctgttactccatcttgattagaagtggaagtgtttcccactttttctatccttttagctgtgttctcctttgtctgtaaactttgtccaaagctggctatcattgtggtttataagatacttgccagcacccaagatttagccaagtttttaaaaggtcaggattttctttgctcttaagccatagttttcatcatttagtatctctgttatcatcctgtgactggatatttggtaaaaacacaattagtttcaaagtcgacatacattttattaatgagctttagtctgaagatcagagtcgaagacctggggtcaccccgggttgtgtgagcttagaaaacagaactaaagactgggcgtgatggttcacgcctgtaatcccggcactttgggaggccgaggcaggtggatcacttgaggtcaggagttcaagaccagcctgaccaacatggtgaaaaccccctctctactaaaaatacaaaattagctgagagttgtggcacatgcctgtaatcccagctaccagggaggctggggcaggagaatcacttgaacctgagaggcagaggttgcagtgacctgagattgcgccattgcactccagcctgggcgacaagagtgaaactccgtctcaaaaaaaaaaaaaagaaaagaaaaacagaacttaaattctttggaccacaatttcctcatttgtaagactaattaaaaaaccctatcatttggtgttttgaattgcatgtttatatatatagattcttttagttgtattttttaacaatttttaattgtttcagaataccttaatacttaatactctgtaacttatgaaaatcggtaaattctaccagaagtggtagaattcattccccctgcaacctttcaggtttcagcattttctttgagattacatactttaccatcaactgaaaaagtaatcttaattaatttcctagaaatttgatgtgggagttagtagtattgctgtgtgtaggaagaatgatggcaggctttcaagaggtggggaaggacaagaagcctctggatttgccagttgggcaggtactgggggcgtctggcaacaacatatctgaacatattaaggatttgggagaatagcaaaagttggtgtcagatcaaaataaatgccacaaagcccccatgcatgtttttacatttcatatgatgtttgaaatcttgatgatagtttttagaaggagacaggcctgcactgggacagcatatgagtttgggtcactttggtaatatctgtgtggctaagttatcactggtgtgtagtgaaactgaatgagtgatgacttaatctccacttaatggttctgtttctcagacatggtttaaaaagacagagaaggatgtaatgagcctcagacttatagccaaaagagttcatatttgatatatctttattggcacttggaaagtttggttatttagattggtatgttctgagcgagtttctatgactaaggttctactctgatggatgatctctaaagagctttctgtattagatttttgtgtctgttttatggttagagtttagtagttgaacttatttccacacaatactacgaaagagcccccaaaacagatgttcctagttacataaatgctcttacagaccccctgttgtctttgtccccctcccccaagattctgtttttaggcctttggattcagttaactcgtttttgaagtggatggtgacttagcagaattcagactctaaggtgagtgactccatgacgcttttccaggaaactagtaaaaatctgggttgtaagtctgccccattcagattaactgctggaggggaaccagagcttcacagagatagaaaaggtcatagaagctgctgttttccagcagacttttcagcagtcctgcctgagctaagcagggtagtaccctggcctgccagtgtgttaagttgtgtctaggggttatgatctgttggctccactactcaaatagagcaagaactgggaagtaaacaaaaactttattcctggaagcatatttgaggcctatacgcagatcgctttatacatagttcctgcagactcggtcatttagtatctcagctcaggatgtactgcaagaaattgaggcagaaatgagagggcgcagtcgagagaggagctgcccaaagcaggtccagatgtggccttctgatatgcccacaagggccctgccctgttatagctgtagttaaagaagtgaaattgccaaaaacatctgaagccctaataaaaagtgaaagtatgtgtagtatcttcctattgatagcagatagtcaattttagaaagatttccactcacgtatatgtaaactttttaaagaaaacatatgctctaaaggggtaagttttgggtaataagaaaattaatttcaataaaatgaatgttctgtgtttgatgagtgaaagaaaaatgatggtcttatactaagagtttctggaagactttaatttcaaaaacagtagtttagaactggaagggacattgggttttctcttattttcagatgatttaaaagccaaagactacaacacattctaagtggctatcattagggaaaattaaggctgctctgggcaggataaataccttgtacaactttaggaggcaccagggtgggtagcaccccttgagggtggaaaggggaaggagttacagtgttgggggttcagcaaaggtctctgaaggagtggcacttgacttgaagcacacaagagccagctcttgaaatactgaggtaaaaatcttccaggcagagggaacaaaagtgtcttaaaggccttgaagtgattgttgtagagacagaaaaggccagtgtagctgcaacatcgtgtggggtgggttgaaatgaaggaggctgagaagattggtcctaatgctctttaggagggatgttggagtttctgctgagtgtgagccatttaagagtttcaaggagagtgacttgacctgcttgctgaaggaccatggtcttcctgactgtagggttagacagcattccatgccagtagctttcacctttgactaaaacaagcgctctgtgaaacaacatttccacgaaacagcagttcccttcccatgagtgacatattctgatatttctattctaccctattaacgattattttttgttatgttgatcacaactcatcatggcccacaaaggagctgtaaccaatgtttgagaaacacaagacactattctgtgtcaatcagtgtatcactgccctggagctagaaaatagtaaccactaacccctgagtggtacagtgtacttaatactgttttagcactttacatgcattgttttatgtaatcctccccagcagccctgtgaggcaagtattacctccattctgcaaaaactgaagcatcgagaagttaccaagattcaaactgattgactccaaagcctgcactcttagctgctcccccacctattaccgcccaaataggcaggaggaaaagagctctgtgacagttttaataggctccaaacagagatgagattgagggtggcgaggaagagaagaaagaatagagaaagggatggtggtaatgcaggaagtaggctttttgttttttaatgaaaatatgaatatgtcatcagccacagatccacgcttaagcattttttggtaccccatagcaggtaattctcttctagtgaaatgccagcactctttcaaaacgacaccattgaatatgcttggtaaaattctcggtctgcaggacaaatgctaacaagtttagtaatgtgactgcagccttcccagctaatctgctggcaagcgagccctgtgaaaaggcagatgcaggacgagccctttctatgaaaatcaggctgacctcatttgatagttatgcagcctgtgtcgatctcttcccagggcagcaggtagcaggccagaatcagaaccccaagtcaggagctttaacttatctgagattttcatcctttagcatgaatttcaaatatggcagggaaggagattgaattcacaaaaacctaaatcttccaaatcccacaggttacagttactctgttggtgggatccactataacacccaggtacgattcctgaatgggaacctgatgctgcctttgtgagatgtggttatgacacagtgtctgcactcagattcgtatgatggtggaatggcattaaacttggaggtcttgaagccctgtcgtcctgtccctggaggcataggtgacccccagtgagcactagcagtcactttggacttagaattcctgtatttagcattgactctcacttagtctctttagaaaactctcttttttctctctgttaggttgattagtctaacttcagttcctaggaactaaaatcctgaatttctcataggcagtctgaatttagggcagcctaatttataacatgccttagaaggaaatcatgtgtgcattcttgcttgctcagcccaagaagtgtatcaggccctgagcggggcaccgcccactgggggatgtgttctctgtcttgtccccatgctaaagccctaaactctcctgcacctagagggaaccgctgcagaaattctccatgattctcacccactacagtgccccagctctggctactgcagggcagttgatccaaagcagcttctgtctggggatcaggatactgtttcttgtcaaccacgtggtgactagaactctagcaggggaatacgttcttaggaaaaagccaaggaattcatttgtctttagaactcagaacctattgtactgaagtacagatgattggaggtaaataaggactattcatacttacaatgttgtttctttaagagaaaatgtgttctggtttaggtttctaaattacagagtacctgagtaatgctggtggccataagcagacatccccattggcaacttgatgtgctgtcttttctgaggttaatttgtgtgagatgactggttaggttttgctagatttggttcagaaataaagtaggaatgccttaatggtctttataattatcagaaaattaaaactaacatatgcctgaattgtggtagcatgatgtttttaaaaaaatcaaccaatgtaaattcagaggcccagaaaatgtctcatgcatccgtggagcatgaaagagcaggtctacattcaaggatttcctttgtgccaacaataatgaattagtgtgtccaggtcaaattaattttaggattgtgttttctcttgggttttggtccagtgctgtctagtacaacctctgcagtaagagaaatgttctactctatactatccattagggagtaggaaactgatttttttattttatgttaagtaattttaaatccacacagccacatgtgcttagtgactagcataatggacaacacaattttttgtgttcctttggtgacaggtgacattttctccctgtatgagagtcctcccagtttaccccgcaactctcactgtctttctctattttattaaagtcttgaaatttttctcttgggactcatatcactaatctaggcaagttaagaatgttttctctgtttgggctgagacaatattgagaaagttactccacctaatcctataggaaattaattgatttttgtgcagtattaaaattgagattaatgtgttataaataaaaagcagcctgctctgtgctacagaaaactagatcagggagaggccacatttattttaatttctaaaagtgtaaacctttcatagtatcatgtgaaattctttagtatgaatagacatttcaaagtaggaggaaaaaaacctattttctcaaaatatatgaaatgttagcagaatttgatacagctttagacaaaactgctaaaacattttctttttggaacatagaacaatttaattattacagtatccacagtcatcaaatatatatatatttaaatcatcaaatatatatgtttaaaatatagttgtgtgtgtgatgttatgtatgtataatgtcatgtacacaaaagcacatacagtttctactttgtacttactggtcccctaaaagtgcttggagattaccatgtcaaacagtggttttcctatttgtgatgtcatcattagacatatctaacatgggagtccatctttaaaaatctgagccatatgtaattttattacatctgtattagaatctcatattcagttttctactttttaaaacacagctcctcttttagtcttgtcagtcaggttgtcctatgttactgtgggtgtttaaaaattaagtagcatcactatggctaacacctctttgggtgctccaagtttgggaagtgaatgccatccaacttgatggttgagatttcttttaaaaaaaaatttgtcattaccattttgctgtgagaggaaacagtcttctgggcagaaggcattgagtccctaactttaaaacagtttataacctagagggtgactacttggcatgatctctgtggggtggatgcagtgatctgcgtctttgacaggcgagagggtgattgtgctgcagtcagtggtgcagctcccctgggggacgggatcctatgggaggttgaattttatgttgaaggatccctagaccctcacctttgcctagccagtccccatgtaaggaatcaacttaaatttaaatggcacttcctctgggaagccttctgatcttctagaccggcttagactgtgctgttacatatgcacagctctctttggtcattttgagcactcgttcagataattcagcaatagcgtgttattggctgtcagtccagccagtgtaagcctgagaacaggagccacatctgcctggctcttcacagtattcccagcacctgcttagcaaagagctttgttgaatggatgaaaggacaaaggggttagtgctgggggtggggggcagggagcgtgtccagcaagacagtgttttttggcactgagtagtcatcaactctaactagagccttagtcctcaaaatggttgcaggcttgtttaggagttagtgtaaggagaaaactaagtctctgagaagcaacagttggttctagcaaaaggatcaaaactattgtttgggccagtgcaagagagccagcagtgtggaatggaggagctggccctgaaccccagatgtcagtaggggtctgaagaccctgccctgcacgcatactctacctggactaggtcctggggagcccttcactgtcttgccctccttggcctgaccacctggatagagatccttcccagggtgtaaggaggggaaagtcctcatgctgtctctgggaggaatgtaggacctcacagctcatagtccctgaagggcttggtgtaggtttcttctcttcagaggtcaagcatatgatgggttaaatagtttgagagggaaaattccttccttctcatttacagagaaactgacaaaagaactttctccctaaatggggaactgcctgtaactgctctgagtattatagaactgtattgtttcctaattaagcattgtttttacctctaggagtagatattaagaaattagtatttcataaaatacccagccattcctcaaattgtttttttttttttttttttgaggcggagtcttgctctgtcacccaggccagagtgcagtgccgcgatctcggctcactgcaagctctgcctcctgagttcacgccattctcctgcctcagcctccttagtagctgggactacaggcgcccgccagcatgcctagctaattttttgtatttttagtagagatggggcttcaccgtgttagccaggatggtcttgatctcctgaccttgtgatccgcccgcctcggcctcccaaagtgctgggattacaggcatgagccaccgtgccctgcctgccattcctcaaattctaagctccctgaaactcttacccttaaggtagagtatcaaaagtttttaaaagcaagaaaagaaaatttttatcttatgctagtggtaaatgccatttaaagacttaaatcctaaaagcttgtatttacccttaaacttcattgtcacaggtatttctctgtctgctgtatattcagcattgtactgagtacttacatcgcctcagttaaaattctttgtttttgttggcctaatttcagattaacataaaagtacctcacccttgtttaaacctgcattaaatgacttggattactgtgtctggagttttcctagcaacactatttcacacacaaagcaaagtacatactagccttttgtatgtgtctttgtccttggttcaacagctcagggatagtagtgtattaatgacttttattctggtcttttatatgtgtctttgtccttgatttgacagctgagaatagtggtttttattctagtaggataaaatttagccttttagcactagaagtctaagagattttaattttcatttgtaaaaatagtgcacatttaaaatctgaatgtcttgcagagtggtcaggcatttttttattgggtctcttctccctcaattaaaaggataactgatgggtgccaaaaaacagtatcccagagtcaccttcagggcattgtgacctgtgtattgcagagaatagaggtcggtgggtatttttttcccctacttccaagatgatatgttaattgcacaagtttaaattggtcactctgcaacccatttataatgctctttgggtatgtatgcttttggagttgtatatatgtgtaaagtacataaatatatttgatgttgctgcaattctgggtttacagcctagatgctattcaaagttagtaagctgatacagttttatccttggaatcagtgttgtgatacagaaaggcatctgttttattattttcttttgtatgttgttcctcttatcctttggattcaaaaatgaagtttagaatggggatacaatccagaaatcataaaataatttattggggctttagatgttttatattggaaaatcgttgtcttaatgtatcactttttattatcaccaatcatctcggttattgcgtcaaaccccatttcagctctagtttgacttttaaatatgcagttacgattcagaatgctcatatagacaggctctaatcggaaataaacataaatgtgttgaggtggtgggggtgtttaacaaaaagctaaaagtttgaagaacctctttgaggactagtgcagaaagttcaaggtgactgcagagaaggagcacttcagaaggcattacattttagtttgaaaaaccgtcaggaaattcttgaggcttccaactgatgattattctattgaaaagtaaatttggttttctttctcatttggtaaatattctgatgtttttctgtttcatttgcttaatgagatcatgaagtgattatactttaattgaggagagtttggtttgttaacattttaaatgtcatccgtttggcatttaaaactgatatttaaaactcagaatgagctttaactttttgttcttttgccctacccatgttttaaacttgtgggctaagagtgaatttgaaaactaaggatttcaatttttttcaaagttaggaaactaacaattaaagttattgcaacttagtttatataattgctacaagttcttgctcatttggtaaaaaataaatgatgcactcagtaagcaaggaagtatctcttagactttctttaggaagcatgttttctagttaagcaaataacttaattccagtagcagatgccaggcagatgagttggagtctaagtgagtgaaggaggaagtactgaagaaggaacatttcctcctagctgggagagttaggaatgctacacagagtaagtgggttccgtcctgggcctgagggatgggccagttcatctgttaaaatctatgactgtaactattgttacagcccagcttccatgatataatgttaggaccccttccatgaaatgaaagcataatcaatttgagatagtttcatccagtattataacttttccctgcttcatataggttataacaattttataaaaagcttatcttcacttaccaagattggcaccctctacagccctagcagcaaggtgtgctgggccttgaggccagacggggctggcttcaaatctctgcctgacacttgtggccttgagtagcttacctctctgagcccctttgcccacctgtgaaatgggtaatcaagcctgcttttgcatgctgggtttgaagattaggattcatatatgaaagcatatcctttctcattatgcttatttaaagattaacttgtatcttttcacatacccattctgagactcaaccaagttttctgtttccaggttttagctgttccggagtcacagatctatagatggtatcttgcaacctgtaattgttgttgcgaacagttccagattctgcagcctagtttttagtcagctgacactgagtgattctgcaggtggagatctcatgtttctggttcgtgtacccaaatcaagcagacttttccatttcttgagctaaaagattctgatgagagctaataaacgttaactgaaagtttattttgttgttgtttaaatctgctaggctatctcctacagttactaacatttttttcctctttataatcatattacttagcccttaatgtttctgtgatgaggacggctgactcaaatgccttccaagaccagggaaatacacataaataagggaataaactgcagacagtgtgcacccctgaaaagcaaacagcccagtcacacagtcacaggcttcgtgctgggcttctgggtattgttttaagactgagaacctagatttacatgtgaaatatctgggaaatagtggatatacggttgcctgcctttttattttttctaaactactattgtaggccaaaccaaatacactgtagcctggtttgccttgtgaggaatcagtttcctacctctgtagtaattgtattggtgccatgtgcaaagggtactttcaagggcttgcctgaataattctgtatcttttcacttatatatggataatggatgttttgtttccatcacacacagtgattcataatcttcactgctcacgccaactgtcatgattgaaagcttgtaacttcaggaaaaacaaaagtaggttctagttgtattctgcccagaagtctgactttgtgtttatgtcctttatttttactagaattccacgaggtattgttaataaatgtactagtgcaccctgcattgcaaattttatatggtttcagagtggagaagttgccttaaattacttgagataaaccaaaattaaattgttgaaacccctcaaataacttctccacacggtatatttatgattatgatttaactctccaaaagtgggactggtagtgggattatgaaagtgtaatctaccttacttattactctgccagtaagtaagtgtaatctaccttgactggaatgtccagataacctctttcttaaacttatagtaagccaactgaggaaataaattttaaaatgcagcttcttttttacaacagcaatttacagaatctttgcttcaaaacacatcttttttttgaagtacagcttgtcaaaatgggtatcgacctttccataggatattaagtaggacagaggaaagaagggatggaagtggcactactgactgatcctttctacaggtttccatattatgcatatgaacacttatgtgctgtactgtaaacaaatgtgactgtctggagttactgtggatcctttacagacttcacgtttccctgcctttttcttctggaggccacactgaaaacaagtctggaagaatgttaatttttctcacctttattttcaataggtggaatacatgttggtatcttttgatcatgaaaataaaaaagtccggttggtcctgtctggggagaaagttcttgaaactctgcaagagaagggggaaaggacaaacccaaagtaagctctcatgtgctgatttagtgtttctgaaactgctaaaacttctagaatatagagttttttctcaattattggaggcaggatagcctaacagttaagagtacaggctctggtttcaggttgccatagtttcaaatcatggttcctttactcaatagctgaataaccttgggcaagttacttaacttttctgtgcctcagttctctcatctgtaaagtaaagatcatagcaatacctacctaaggtgttggaattaaatacattaatatatgaagcactttgtacagtaaactaaatataaagcctgttttttattaaaacatttttgggaaaaaatgtattgcagaagcgtataactgggatcacaaaccatgatgcaagatataagttgcagatgggctttgtttggctttgtttggctggcatgatttttttttgagacggagtctcactctgtcgtccgggctggagtgcagtggcacgatctcagctcactgcaagctccacctcctggcttcacgccattctcctgcctcaccctcccgagtagctgggactacaggcgcccgccaccacgcctggctaattttttgtatttttagtagagacgggggtttcaccgtgttagccaggatggtctccatttcctgacctcatgatctgcccgcctcagcctcccaaagtgctgggattacaagcatgagccaccgcacccggcctggtgtgtttttaaggtattcctacatttaagtagacagagacggggaggggaggggaatatatactcctctgctcattttccactcattcgttttggggaagctgcatttgagtttggagggcagcactgaattgaaagaacccttaaggcctcatctccttctctgcagagtaggttagtttgtcctggacagtgagtgctctgtgtgcattttcagttacttataaagattttgggttgggcatggtggctcatgcctgtaatcccagcactttgggaggccgaggcaggcagatcacttaaggccaggagttcaagaccagcctggctaacacggtgaaaccccatctctactaaaaatacaaaaattagccaggtgtggtagggcacacctgtgatcccagctacacaggaggctgaggcacaagaatcacttggacctgggaggcagaggttgcagtaagccaagatcgtgccattgcactccagcctgggtgacagagcgagactctgtctcaaaagaaaaaaaacattttggacccaatacttgttgacccttatgtagttgaatagctatggaaaagtaataatcactgagaactgtgaaggacttcttagcttcatttatacctaatggtttctacacttttaaagcaactttaaaaacttaaaaattgagcagactatagcaaaagaataagatggaactaagttatttctcctccgtagccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccaggttagttcctatattaacatgccccagcagatctctcagagatacaggtaatgaaaagagcaagtcacgacccgggcattccaccttacaatcctcatacgttacagatggtttatcttttatagactgcacttgatagactctgtaacagtagagctgcagacacagttgcatgccagcttctgtcagctgtggtggctgcaccgtggtgagtgcactcagtgggggctcagtgggaaagaccaggatactgtgatgacagaccagcagtgtggccgtgtctgccgcaggcgagggtggagggagcagcacgcctgccacacagttctgaccctgtaagcagtagccaaagcttctggaatgctgtcccctggtgactgtgacagttgcgccctcatgcactttcaaaaagcagcatttacctgctagcatatggtggcatcagtggcagatcagaggatctgcagtgctcccaaagcactatcgataccgatgctctatgaacaacgtgagtcattaggtccttgcatattgttctgaaaagaagatttagggtttgtcatcaaatctagttatgaccaaaagtacataaaagtaaatagtgaaattatgttcttcgcttagaatgaggtacatgaatatcatatgtattatacatagaacctctatgtaaaaatacatttctgccaaaacatgaatgtgatttatctatgctagatgtctgtcagatggtgacagtatacttagctcctcaaagttcaaaggagctctgggggttggtatcaatggtggagaacactttgaactatttttataccttttctctgatacgtgtccgtcagccattcagggtcatatcattggcctcagaggggcatttaaatgggaattctatttttttttttatatctctactgtaacatctaaatagttgaaaacttatttaagccagccatctaacatttatagaagcatctctatttctgtgataccttcattctgtatgtacaggtcacttctctctccacccccagaaggaaaaacccagctgggtgagggtggacagatttgttttgattagagtgggcacatttcttcgacctaatgtttgaaagaggaggtgaaaaatcattggccctgccattcactcagacacttgagtgcctgctgcaggcagaatgggcatgctctcatgagtgaagacggacagctctgtctctgtggagctggggggttgaagaacaatcaaatacccatagattcataagcgtcaaagtggggctgtgctagcaggaggagatggggagcaaagagtacaacctaggtatccagtggactctggtgggtggagggggagggggtgggatgtccaaggttccaggaggagtgaaataggaatgaggagcggaggacagtcttagggagggggagcagtgtgtgtagaagtcctaggatgaaccaaacaagcggggacttcctgggaactagaagaaagcaagctggccagtgtgactaggaggctgaggaggaagtgcaggtatggggtaaagggaagctggcaggtaattggcaggccaggtcaggttaaccataaattttagttgttctcctaaaagcagttgaaggccttggaaaggttgggttgggcagatggcatcccctttttgctttgcagccctcacttgggctgtagtgtgagagtagctgtggagctggtgccagggcttactaggaggtgagtgagggagctccctgaggggagacaagggctgcctggatgcccgtgggtgctggtgataggaaaagtgggtggtttaaaagatgacagagtcagtgaactgctggggagagaagacacatcaaggcttttgctataggtcattgtcctgaaaaccttaagagtactagagtagaggccaaggagtaggttacagatgttaaatgacaacttctagtgaactggaaaatttaataccttatatgttcatttttttccccttaacattaagagggttgtacatttcacttagcaaattaagaaagtgggaggggatttgtaacacaaaccagaactgttttatatattaaagctgaagaatatataggattgatgggcagtggtgtttccttctgggccagaaaataaagttttgggttaagcctaatgtgccctttaccttgagaatggttccatatgggatagttgcctttttaaaaaagatttagtgtctgggcatggtgtcttacacctgtaatcccagcactttgggaggccgaggcaggcggatcacctgaagtcaggagttcgagaccagcctggccaacatggtgaaaccccgtctttacaaaaaatacaaaaattagccaggtatggtggcatgcgcctgtaatcccagctactccggaggctgaggcaggagaaccgcttgaacctgggaggtggaggttgcagtgagctgagattgtgccgctctgctccagcctgggtgacaaagcaagcctccgtctcaaaataaataaataaataaaaataaaaagattcagcatcttaagtcattgtgaagggaaagttgagacagaggaataagctttattctaaaaacctgtaatttagaaaaaattatatgtataattttttataccctgtccatataggaaggtattttgggacttgaaacaataattattagttatttagtggttagaagcctccctatacatccacaataaatgataaagttttgttgtagtataggatcaagagagaaaggagtgctctggttcttaagtgtaaacagggtgactttataaagatgcaaagatttatagtgtggaactctagtccaaaacagtaatcatgtgactatttaaaattaaaattatataaaatgaaaattgtagttcctgatgtgactgaggaactagcctcatttcaagggctcagtagccacgtggttagtgactaccacatcggtttggatagtggagatattaaacatttccatcactccagaaagttctgtgggacagcactgctctagaatgaagcagtgccgtaggtgtccgaagatgcaagttctgattctaccttctcccttccacacaaacacattctcattctctcttcatccaatctgattctggtgagcaaggaatcccctcagatttaagtttattactctcccaaaggactattcctaaggttctaggctcatagtaaataatgcacatagcttcaagaattctcaagaacccttgtagctgggaactgttttctagataagatcactaccttcaattgtttacaaggtggatttgggcaggcaacagatactttattttatattaagaaaaggtaggggttaaaaataaggcattgatggccaggtgaggtggcacgtgcttgtaatcccagtactttaggaggctgaggcagaaggattactggagcctaggagttaaagaccattctgggtagcatagtgagacctcgtccctggaaaaaaaaaaaaaaaaaaaaaaaaaaaaaacttggtacagtgactcatgcctgtaatcccagctactcaggagcctgaggcaggaggatgacttgagcccaggagttcaaggctgcactgagctatgattgcaccactgcactccagcctgggagacagagcaagaccctttctcagaaaaaaaaaaaaaaaaaaaaaaatttttttttaaaagatatgagctagtcttgatcctcaagccaaaagtttcttcccactaatttaaaactcctcccttgtttggctttcgcttagtctttgtcctccctcacagcacatgtaatattgacctcaaattcctaacttggaaaaactggggccatcactaaaagtgatgtagaatttgagctttacacttaggaataaatatggagcttcatttttctgtgttgaaattagagctccttaagtcaagtaagagaataggattgggtttcagacttcagagggtgatctcaggggtagatggggacacctgcagagacactccctaatcttgagggactcatgaggtgacctatagaggcaaaaaacaggctccttccagattcagagcctaccaggaagtgggaggcagtggtgccatgcagcaggtccaaagataatctgagagtttagagatggaaaaggaagacacctcataggccatgtaggggacacctgtcacccatgacagctgatgtgaccaagggaaatgacttctgtgctatcagtccttcctattagatgaagagatggagaggacccgagtaagtgctgtgtggtttgtgagtgagtggagacttggataaagttagtagtgggctggaattaaaagaagatccttgtgagcaagaagtgtggggagtggttgtaaaggggcacagtatttacacaacatctgttttgtaaacacaaagccctctgaaaaggggatactagaaatgaggtgtctttggcaggtgcagtgatggcaagactgcacacaattaattcttgaaaacaaatcccatctatttagttcttcaatttgttgtagattaggctgtcctgggttcacactgcccgaggtcaaacccaacccagtggaaggaggagcttccaagtccctcttctttccagatgaagcaataaacaagcaccctcgcttcaggtgagtatggctttgtgttgaaatgcagatgcccttcactagacccctgacttctgagagtatagtatttctgtctagaaatcctttttgagcattaactgagttttggctctcttcctaagtaaccagagaagatagcagatgtgcacctgttcacatcttcagtacccccaggcttcttggttgttgatgcgtgcaccaggcttgatttgtcaattctccaagtcgtcacaaagttattcgctgagccactgcgaataactcttttaatagggagattattttcagtcctaggtctgtaaatgcctactgggattttttttttctcttagttatttctccttttttgtcctctctaaccatcagtatctgtgatttgcccatcttactctatataacttataaaataggtgcagtacctgatatatataataggcactctcttccattaacttcaagttctgttggtttgttgttcaattctgaggttttaagttgctttaaggctctcactagcctgatcttagctttgtacaatgcatgctcatctgtcatcctgagcctaggctcctgatccagagtgggaacatggagacttctcagcgttcattcctttaacaggccctcacgtttgctatgtgcagagccttttggggaagacagatatttgtagacgtagtttctaacttcatatgttgtcatgtgtttaaaggaaaataaaaataattcagctgctcaagaagagatagattatgacagatgtcaaaagatgcaccagaaatccttcttggagaaagtaaggtgcttctgactgagggaatcaaagcaggcttcacggaagaggtggcatttaagctgagtctatagcagcactgcccatagaaacatgtaattgtaaatgttctcatagccacattaaagtaaaaaccagatgaacataattttatattttgtttaacccaaaacgtccaaaaatgttatcatttgatccatgtaatcctttactcacaagtaattttacattttttttgtacggagtcttcaaaatctggtgtatattttactctcacagcatgtgcatgttttcattaggacaagccatatttcaagtactcagtggccactgtgtgcctggtagcttctggactaaacaagcatgagtctggaggataattattaatcctgcagagatgagggagggaggagcaaggtattggggctccagagatgcctgggcaaagtgggtactaaagtttgaccaaagtctttggagttaatttgggacatgttgcaaacagtgaaagcagaccatggcagactttgaacacctgaattgatttggtaagttacagggagccttgggagcaggggttgagcaggagacagaacggcattctcgagcaggagccaaagaattgatactaatgcaaaatctttaatcacaaagttcccttgtagtgtcttgacaccacagatacattttctgttgagttgtcttagataactaatttgaggtatgatttcattccacttacttgtatgtaatcaaattcttcttttacacgatgactcttaggtgaccaatttatgacgtttggttgtctgttttagtaccttaacaagaaatatccgacataggagaggagaaaaggttgtcatcaatgtaccaagtaagtctactgagaggtggtggggtgggagagagacatgttgtattgttgtttaatcctggattctaaaccatttttatttttgtatttttataatacagtatttaaggacaagaatacaccatctccatttatagaaacatttactgaggatgatgaagcttcaagggcttctaagccggatcatatttacatggatgccatgggatttggaatgggcaattgctgtctccaggtatagtttcaaatatacagagaggcaaagtgttccatccatttctgttttttaacttctttatatatgcatgtttcctgttccaaaaatcacattttaatgaggttgaaatggtagctggtatgcctttctgaaaaacatgaagttatattagtaaattcattggaagctgtctatgactaatagttctacagactctgttgttcaccacaaaggtatatacggtatatatacctttataactgtaatttcagttaacttaaaatgcaatatattctgtcattgtttcccttctctttttatatgcctagtttttactgccatctcgtgacaggctagtgaggtggtttaaatattgttcaaaactctgaaaatgagctctgatggaagtattccaatgattttgtgatccaagggatttgtgcaaagctgtctagcggtacaaaaagaataaatatttagcagcttgtgtttgtcttgcccctgagtaaagtatacaggagcctgtctctgtttacccatttaaaaattttcctggatctgtttaaatgatggtgcccctggcagtgagtgtgtccaagctcacttaggaccagagtggaagagcatggaacccatcaggtggccacacacaagcctgcagttggcttttggctctgtcactactcaggtttttgggcaactccctttacttcttttggctcagatttttcatcagttgaaagaagggctgatattaagtccccttctaggtctgactctaagctaatatttattttattgccttaactaacagaagtaaaagagagaggctgcttgttatttaatgtccaaggaaattttatccagttgtgattacttcagctgattcaaaacagcgtccttagaggcacagggccgtgcagagcctggacccatgtaagatccctctgagccgccagcctgactgctctcagtgcaaagacccagaacccagccttccttcacctgaaacagctgcagcgtgcacacacacttcttgtgcatatatctctggtctatttattttcaaaactaagtataatccaaattgaatgctggaatcagatttttccattctgaatgtgtttaaataacatggccaaggataatttctttctgttttcttgacatttataggtagtataaaatatgtgacttccaaataaacataaaccatcacacttcacgaaaaaagagatctttcgacttttaactgcctgtttcctatcttaattacaagtatttctaaagaaaaccattaagttctagagcttacagtacatggttttaaaattgtataagtgctgttaagagtattgattgccttttcttggtttaatattaaaccagggtgttctgccgaagaccgcatagtttctctgatatggttccaaagggatattctttccactgaaacactgtatgtatactagtaaatgcttcctaatggtagatgataaatatttttgttgcttgtagatagaatttttccatctagtgtaagcttaggattgttttctttttcccagtgacatgtacagtttcactactccacttaaaaaaaatcgttagctcagataaagtgtgtggcacatgaaatgaattttgccaattcaccaccgaaatccctgctttatatctcttcagtggaacactaaaccaacttctttcccaagtacactgatttgatctttacaaattatatgaatgtattaaattatcacatgtgccctgaaactgtgtacatctattatgtatcattagagagatggaaaaaaaaaaaagaaactgcttagtaaagtagaaaaaatagttttaaagtaattttgtaaggctaatggaagacttactgtataaagcaaaaaggattttaaccacattcaaattattgactgttttggggcttttcaggaatcacttaaaaagcaccaagttcacagccaggcacggtggctcatgcctgtaatcccagcactttgggaggctgagatgggcagatcacttgaggtcaggagtttgagacaagcctggtcatcatggcaaaatctcatctctactaaaaatacaaaaattagacctggtggcatgtgcctgtaatcccagctactgaggagtctgaggcatgagaaacgcttgaacctgggaggcggaggttgcagtgagccaagatcgtgccactgcattccagcctggggaacagagcaagtctttgtctcaaaaaaaaaaaaaaaaaaagcactaagttcatgacaggttatggtagcccctcccacccccccccccaaagtcatgtgacttcaaatctgggttgtagataaagtttagattagatgtttcagtttctaacatatatgttccttagttcctccctccacccccaaccccacccccatcagtttcctagcaacattgtgtgtctccttcatatgatgcctcaaaacgacactagaagcccaaattagtcatgtattcatagctttttaaggtataagaactttttttccttccattaaagccattatccacagtgatgtcctatttaatttgattgcatatcagctgtagactaagaaagctaattactaaatgcatttaaaataactaagtcacttcactgttgtatacttctctggggttgaatttcccaggattcacctacgaattatgtattgtatactaggccatctaagagaagccagttgaaaaactggaaagaaaacctgcttctcatagtatctttttaaaaacaaaaatgacacatactcaaatacctaagagcaacacaaaaaagacctaaaaaatctaagagatgcatgttcaaaataattctttagtcaaaatacttgggaaacatgtagttttttgttttttggtttttttaaaatctcaatgccttgtcagtttggcttttggggtcccggtctttcaggtttctcactatacctttgaccgcatgtcatcctctttagcaccccccccccacttttttttttccaagattctcatttgttaagcactaaccaggtatcagatgctgtcctgcgcacttgggatagagaatgggaagaaagatccccgcccttctggagcttctacttcagcaaataagtgcataaagactttgggtaccagctcccatttcctcactgctcatgtaatttcatgccatatgcaaagcgatttccaagttcccacctctttgcagaaactgcccttggtttggttatcagtgacttaattgccaacccttatcaatttgtgtctactttaacctttgaaactcttattctttgatgcctatgacacagcttttctctgtgttgaattaattattaaattagtaatgactagttaatacagtctccacattgacatgaaatgtggttataattgagcaggcaaacttgagtctccaatagacattgctgtggaaaacaaagttgagatctagctaaaaccattggaactaacaggttgagattataacagtaaaatattcacttagctgctgttatttcaagtcttaaacactgaaattatgtcgtgtaccaacactaaattcaagctgtcattaatgaataacaacatgaaattcaaactgtcattattgaataacaacagaggagattaaaactgttcccaacttgcagttattacaaatgtgctaacaaacacaatttgtgttccttgccccttctaccgtcttggaaaaaaaagcaggtttttttttttttggtttctgttgggtaacaaagaatttatgctcaccaagttatatgatcttttctctgcctaactcttaagtgtcctacctaccatccttgtgcaggcttcctgggtgatctccccatcttcaggacattctctgagcctactccccaggtctttctacaactcgggtttttcttctgggcaccagccctgaagacctagccacttagagggcctctttttctgtctgttctcttggcctcgtaagtccatcatgtcatgacacctctttatctctaacctctgaacacccaagccaaaacctaagccatcccctactctcagtctccccttggtcaccagtgcctgctactttgactttagtatcactctccccacatctttcctcagccttttccttgacaggtgcagtattttaactgcttccctgtctttctagtctttcccccttccaagctcttcaccatactgccaccagtgaagtttgaaaacaatagttggccggacgcggtggctcacgcctgtaatcccagcattttgggaggccgaggcaagcagatcatgaggtcaggagatcgagaccatcctggctaacacggtgaaaccccatctctactaaaaatacaaaaacaaaattagccagtcgtggtggtgggcacctgtagtcccagctactcgggaggctgaggcggaagaatggcgtgaacccaggaggtggagctttcagtgagccgagagcgcgccactgcaccccagcctgggcgacagagtgagactccatctcaaaaaaataaaaggaagaaagaaagaaaacaatagttaacatgtccaaatcccttttgcatccctcactgactgaagggataggaaggcaacaagccagtagaagagaaaatgctttgctaaacatcatcgtatgtctgtgtcttatttttcttttttgactatttaatcttatttcacttaggaccttggttatttatattagttgtctataggcagtggaacataattaaataccattttctagttaaattcacctaagacaacttttaaacaaaactcttgcgttaaatgttgccattaatgaagcgttgttaacttgcccctctctgcccagcaccttccttctctgacttcactgcttggggagcatgctaatgattccttggtgttaataactttgcaattcttaaacaggtgacattccaagcctgcagtatatctgaggccagatacctttatgatcagttggctactatctgtccaattgttgtaagtagaaattacctcttattttaaatactacttcgtatgaaataagatagcatgtgcagaatttactgacagtgtgctatttaagtccagttaagacctcagtcagagatggactaatataaatagtatgtaggtttaggtataatgaactgagagtctacactgtagaagtttactcttgctagtacaacattgatttgttaaatgtgaagtttgaatgtggccattttccctcccccatacttcatgtcctcacattagagagaggatgatttaagtgaatcaaacccaaggaactggattcttcctggtatatttcactgtaagataggcacaggtacatgtgctctgtatgggttgcataaacatgctttttgatcagaaatataactgcatggagctttttttagcatgtaagtgacactttgaatttgcaggagctgacttttgtttgtttttagatggctttgagtgctgcatctcccttttaccgaggctatgtgtcagacattgattgtcgctggggagtgatttctgcatctgtagatgatagaactcgggaggagcgaggactggaggtgggaattgtttttccttaatagcccttttaagtcaagcaggtaaaatggatcttttgtaactacttgcaatttcaggatgtctccctgcaatttttatctgaaatggggaaaaagatttggtctaggtggggagttaatttttatcgtatgttgatgtctgtatttgttttagcttcatttaaaattagtagtccgatttttctatattttggaagtgctgatggctgtttttaccaaaaggctttttggtgccacatgagtgttttgtatatggtgctttctgctgtggaaagtataatttgttgtcagagattctttttccatgtaaaaggttaggcattgactaataagggtgagatggcacctcttgtttgcatgttgaactgtaaagtaacccttgcatctctccaacaaggggtgtgcatcagaaccacccatggaaatctttgaaaatagacacccagaccctatcctagacctactaaataagaatctctaggatgggacccgaacaagggtgtttttaaaggagccctcataagtggttttgatattctcaaccagggctatactactactgctctggtcttcatgtaattgttcataaattgttgaacatgctttctaagtagaaataaactttaaaggataattattttgataggtttatcttacgttatagatttatttatttatttgcttttaaccttagtatttattttccctagcttaataagaatgaaagtgatctgcttttaaaagataaaagtatatttaaatcataccagaaaaaaagggtatttaaattgccttcagattttaaaaaacataattttccttaataatactttttagggctcactaactttttttctgtatcttatgttgaggtttttatataattatcatatataaaaatatattccactcattttatatagcatattcatttatatatatttttaatctttagccattgaagaacaataactataggatcagtaaatcccgatatgactcaatagacagctatttatctaagtgtggtgagaaatataatgacatcgacttgacgatagataaagagatctacgaacagctgttgcaggaaggtgggtttctactccatctttctgggtttgaatgtacgcctttagttcttcaaagctcttttacacttttttgctgactcctggtctggtttctatttttagtgcaaagtctttaacttctctcatgaggctacttgttcctaaagtttcaggttccaaatacttgtgagattttcttgatttttagcaaaaggagcttactttggaggtctgtgtctaggtccacaccagtgccccagcaggcattgtgtaagtagtgaataaaacgctgacactcccgcagtgtccgcaggataaaatactgggtgaggtgaggatactaatcaaaccagctatttcaagcttctagacaccctttcttcaaacttcctgagctatcctgtcgtctttctggactaagaggaagtggtatctctcgctttgcagtgagttcccatgtgatctctttttgcaggcattgatcatctcctggcccagcatgttgctcatctctttattagagacccactgacactgtttgaagagaaaatacacctggatgatgctaatgagtctgaccattttgaggtatcttctcagttttatttttatttatttatgtattgacttctgagagtctggaatcctctgttttatatgcatttcacttcacaaaccaacatggggaggcagttttctgtacctgtggagaacacaaaagaaatttcataagactttcatttacccagtgcagtaaagaacttggacaaataaaaaatcggtttcaagtactcttattttacgattcttactgtttatctcactgattctaatttttttttttattgttcagtattttcttatttgcctagtggtgaaaaattcaaacatacactgcacaaaaaataacctgatcagttatttcagtgcttcagacatatcaccttttttttttgtagatagacttctcatagatttatttctgtgtcatgttatatgtagacattgacatatataccttttgaaataccatctatatcccctttctttcccccaccaaactcacaaaaggagatataaatccttccagtcttgccatcgggtcccaagatggtcaggacggagaaagaactctctctcagtgtattgagaaacagctacccttcttaggctcttgggtcatcgaagcagcagcattcccaggagaggaggaagaaaggaaacaactgtcatgtgacagggttctcagatgaaagtgtccagtgtcacctggaaaggcaggctggctcctaaaattctcagggatgaaggtgggggccccgtggctcttcagatgctgctctgtagctgggagatagggagtaggagctgggtgagattaagcttgcagtgatagggcctcatagcttttgttaaacacttggctgttttgttttcctaaaagagcacactcgaagaaaatcttcaattgtacctttttgtctttgtcaattgaaatttggtatggacagtgagcagtcttcttccttaattaaataccagatcatcttaatattttcctggatgtgtgaaaagttggttttcttctctgcttttgtatcacagaatattcagtccacaaattggcagacaatgagatttaagccccctcctccaaactcagacattggatggagagtagaatttcgacccatggaggtaagacacatgcatcagcaagaactgactcaaaagtactctttcgccagctgttcatcacccttctgatgctgctatgagaaggctcttatatataaaataaaaattaagtatgtgcatggtagcaagtcagtccaagttaaggagggttgatttctgagaatagatgtgggcaaagggcttccagacccagatggggaattaggagatggcttgggaatgacatgatctgaggaagggcctgggtcagggaagagcatgtttgtgtagttggttcataacttctctgggcttctgcttgtctaggtgcaattaacagactttgagaactctgcctatgtggtgtttgtggtactgctcaccagagtgatcctttcctacaaattggattttctcattccactgtcaaaggtaaggatatgtttctttatggtgatgggtatagatctatctgtagatatatttatttatatatgctatttatttcccacctgatttcatttgaaattgtttaccctttgcaataaaatgtttctccatcagccctattctttattttcttttaaacctaagcttaatttctagacgctttccattcaagatgattgatggctagaagtagtcctacacattgatttcatccaccacaaaatcccaggttgattacaatgttaaattaggatggggagggaaagtgtaactgctggaatgccggtaaaagtctcctcagtagaactgaacttgagatatttctgaagaattcggatgggattgaactctcagaaaaacaaattggagttaatctgccccccaaaagaccaaaaaacaagctttctgggaggagtttgccagcaaaacaactccaggtgatgagggagcagagctgtgggttgtggagcagtagctgaggaggtgaacgcctttggtttctgggccagggttcctcttggcagagagtggctgggaaaaactgctaaatagagagggccctgccgcaggggttcctggttgagggtttcggggccagagaatggagaagtagggtagccctgtcacagcaaacatggaagcaagaatgaaactgcttagctccagcatctgcccctggggcatctccttcctccatgaggggtttgccagactgtgctcatccccacaccccctgaaggaaatctggctgtcagcccatccctgcctgctcctcacacccagaccaaaggtcacccacagaactctgtgggcccacattgccctcatgcctacctactggggagaccaaatccatctaagagagattccatgtaagctaccagtctaagcctttgcttataaataagaatagatgcttggaaggcaacagaaaattgagaacaattaacagccttaaagagaagggcctactggtcttgcaagggcatactctgtaaagtcaaacttagttacttcaaggaagtaagctgggcccagcgcaaatctataatctctgctcctcaggaggctgaggcaggaggattgcttgaatccaggaattctagtgcagccccgacaacattgccagatcccatctcttgaaaaaaaaaagcaactggaaagaattactattttttaaaaaatacttttaaaccttttttagagacagggtctcactatgttgctcaggctggtctcgaactcctgggctgaaatgatcgtcctcctgctgcctcagccttccaggtagctggaattacagacacaaaccaccatgctcagctttggaaagagttcttaaaggaattctaattagtggcctcagacaaattctagagaggttcagtcacatccataaaacaagtattatagattgtgcttatttaatggtgagtattctcaccagtagagcagatgttgaatatccaaggtagtgatttaaaagaccaaatgaagattaatcccagcaggatggtgaagaaatggaaattatggaaatcctgaagcatggaaagctctggaaaattcaatgtttgtgtaataatttagaagaggagaatagtttatataggaaagatatacaataatcaaagaaataatagaatttttccttaataagtcttccttaaggatgagacaaatatttaactcaaatgtaggcatttattaatctcaaagagaaaattaactgtccggacaggagaaaaaattaggagacatgaaaaggggggaaaatcaactgatattacttttcatttgcaacattaaatgctagatggaaagaagttttcagaatctcgagaggtaaagaattaacaaccacagaattatcttctcagccaaattattctttaaatttcaggtgattctaacaaaactgaatggatcaagttagggctaaaagtatgccagaagtcttatctagtgtcttggtttgtttgggctgctgtaacaaaaataccttacagtgggtggcttataaacaacaggaatgtattgctcacagttctggaggctgggaagttcacgatcaagtcaccggcagtttcggtgtgtggtgagagcttttgctctctggttcatacatggtgccttcttgctgtgttcttacatggtggaaggagctaactagctcttcagatgtctcttcgtaataccagttatgagggtagggccttcatgacctcccaaaggaggtcctcccaattgcctcccaaaggccctactttctaatactgtcacaatgggcattaggcgtcagtgtatgaatttaagggaacacagacattcagaccatagcaccttgtaaggggatatggaaggagatgaatggtagatactcattagtgcttgacacttagagagttataatttcaaaactacctctttaaggaaaactattaatagtatagaaacaggatttattacttttaaacttgctggcgaaagggtggcaaaatgaaccacaaatacatttcagtgccacaaaattgggtgtggggccaggggagtgatgaaacaatagcccatagaacataaagtggtgaaaataaaatgaaaacaaatttgaatagactaaactctatcctattaaacagctgaaacagataatataaaatagcaacacagtttgcataagatgtacgtagaacaaggacagatgccgacaagagctgcatagtgaccttttggaatgatagcaggaatggcaaagcaatatcaggcaaaatgtgaggtagaaattattaaatgggatagagaaagcagttttatatattcttccaagatgatgtgaaagctgtggtcctttttgtaccatgaaatgtaacatgaaaagagtttagtgtgatgggtaatacatggctttgatgtgagaactaaatgcataaatccctggtactatttactaggcttttaacctggacaagtgacttattctcagtgcctcagtttcccacatgtatcccagaggggaataagtaggctgttgtaagcccgtgtggggattaatggaggtaaaccacttaacagagtaccttgcatgttactcagtaactgacaggccatataatcaaaggatgggaaaggccatgggggaattaaaggcatggttaataagcttggttgtatgcgtatattacgtatctcataccacatcttttttcaaatgccatgagtaagatttacaaaaattaaagaaaatcttcacttctcaaaagtagacataatacagcatgcgttcccgctaaaattcaacgaaagagatactctggagaaatttaacattggaaattaaaaatgtctttccaagtagattttagattaaccaaaactagaattacagattgtgtaggaaagtgaaagacatgctggcagagctgatgtctaaggaaaaattatagctttaaatgtcttaacaaaaagattttaaatctaagtcattgagtatctaaagagcaaagtaaaatatactttgaaaggaagtcatcaaagcacaaattataagtggtcgttatgaacttttttcaagactaaggaaaaaagaaacaaatattaataatgaaagcagatgttcacagccatggtggaatgtatactatttatttgagtatgctcctagagtatctagattcttcagaaggtcctgtgtgtctcttaaaaaatgaaaccataacaatcgcactccctgcataatgaatatgggaggagacttggtaatcaagagagcttatgtaccatctgtcccatgtcagcctggccctctaactggtcactgttgtatatattgaggtcccacataagatttcattatagaaaataagggattactactaaaacgttttttaaattctgctttgagagtcttaaaaagtcattggagatacagagaattcacaaataaaacagttttcggtttcatgagtgagtctacatgtccggaggcaccagatgggtaaaacagcagtgatcttctgcccttgggagggctgtaaccttattccagatatgacaacctatgaactgtctttgcctttcctcactaaagtggggaggcaaaaccccaatggcgaggcagcaggggaagagcactcaacttagaagaaccgggttataggccgggcgcggtggctcacgcctgtaatcccagcactttgggagtctgaagcgggcagatcacttgaggtcaggagttcgaaaccagcctggccaacatggtgaaaccccgtctctactaaaaatacaaaaaaattagccgagtgtggtggtgcaggcctgtaatcccagctgcttgggaggctgaggcacaaagaattgcttgaacccaggagacagaggttggggtgagatgagattgcaccactgcactccaacctgggcaacagagcgagactccatctcaaaaaaacagaagaagaactgggttctagtcctgccttctgccttcgttaccctgggactcctggtgagacactgctatataaagggaaccagccacctgccctcccaacactgtatatctgttgcaaggctcagtcacagaggtgctttgaaatgcagacgttccacatgaatataagttttgggttttaagtttctcttaaaattccctgattggttgaaaaatcacataccaatccatgattgagtgatacagtcctcacataaataaaaagcctgttcctcccactgggaagcatttgagcagaaagtagaatccctaagggaatgagtcctaattgcaaaggtgaggaaggtgctgcaacttgtatgtctgatcaagaatattttgacttagtcgtgattctttttttcccttaggttgatgagaacatgaaggtagcacagaaaagagatgctgtcttgcagggaatgttttatttcaggaaagatatttgcaaaggtattacattatcttagatttctaatgtcagcttatgctgcaacaagctgctaaagctcccctgaccctcttctccggcaggtggcaatgcagtggtggatggttgtggcaaggcccagaacagcacggagctcgctgcagaggagtacaccctcatgagcatagacaccatcatcaatgggaaggtaggagggtggccctgtacagtacgcctcactgtgcacatcccccggcagggagttcataaagtgtcctgcttcttgtaggaaggtgtgtttcctggactgatcccaattctgaactcttaccttgaaaacatggaagtggatgtggacaccagatgtagtattctgaactacctaaagctaattaagaagagagcatctggtatgatatctatttttcttaatctcataatatagacagcatggtataatcttagaatgttcaatttcttaaagtagtcttttaaaataatgctgtattcatgcacagtttcacatttttatatttctgcaattgtattcaccttataatctttgacactcataatttagattagtagtgctttttttcttatcagttcataaaataggggtgcatctgaaaatcactggcatcttagatgatgaaatggcatctggattgcttacttatcatttacgtccaactgtgttgatcttacatcatcatgggcccttttatagggctaaggaactctgtaagttaaataagctgaacagttctttagcctgcctttgtacatacagtgaggctcctgagaatcccctttctttgttagttttgaggaggttacatttacaatacagtacagtaaccaagtactgctaacacagtacttggcacaagggagctgtcagctgttaataaagtgacagcaataatggtaatggcatctgtatttaactcaaggcttctgtaaactttctggagtcacaaaggatagccgtagaaccctacctcacccctcaaatggtatactgccaatttcccacttcattcactctacttactgttctttattctctccacctctttgatcaaagatcgctcaaggaccctacagtcctctgaggcagtctcatgacactggcatttgtagtcctagccctctggccaaatgggagggcacatgttcttgtacacatgtgctggctcctgttccttaagagctggcagtgtcagcatatgggtggcatctaacaggtaccatagaaactggatgtatgtgttctcattgcctgcctgcaacctagaattcctgcccaggaggagttcttcaaacgctatgaaagatgttcccaccccctgccatgcagctacactaaaaggacatattgatttctctccagaattgtgtttatgctgaccactaaatatcaacttattaaaaaaaaaacttacgtggttttaatttttttttcgctcccccctcgcccacaggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagccagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaacctttgagtgtgtgtgagttccacagctaaacaaatagtagaagagtttggtttttgtaattaacccaaataccatgaaattattttttcatcattgcgacctcagatgtttctagaaagaagcatagtgatgaagacaaacagatgccgtatctcccctagtagctatcaaccccggtggggagaaagaacttgaagtgtgactgaattgactgctgtgccactggaagattttttttttcttttttactcccaactgctgttgtgctgggtcagtgggtacatggtgaatgaatgttgagtaacctgggtgctgtgcacactgcagtctaagcaggagatacttttctaagcaggagatacttagactgtgagtcagcaagtcctgcagagagctgttttcgactcctgtctttggatcagtattcacccacacacacacagagttcgtgaaataatgttcatctgagaaacacacttttctcagagctctaatttctttatttgaatgttcctagggcagtgcttatcaaactgtagtctacatacaaatctctttggggtgtcattctggcttggtaagtctggggtggggcccacatttcttaacaagctcccaggtgatgctgatgctgtggatttgctggccccatgaataataaggactttctctacctgagttatggacacatcaatatcaagtctcaaataacacttgcttttaagtctaatgtgatatgtctacattttctcttattaaagaccagatagtggtcttctttctccaggacagagaatgtaagcctcacagctctcatgagctttaccatctgaacacagctaagaatttgggattttaggaacagaactgtaaatcttaaaacaagcaaaaagtgctttctccttggtagaaatacctgtggccaagcccagaccttcagatcctaacttgggatacaactgattgttacttaacctgctgctaacctaaagactagttttctgctcatctagtcccctgtgtgaataagaggtttcctcctggtcccaggatgcctctgctgctcagctcatctctgaggctgtctgtgagccttcagttcagaaattgagggaaaatccattgccttggatgtctccttccaaatcaccacccaaaacaaaaattaggagacgtagaaatccaggatgtgttgtggg

SEQ ID NO: 13411 - DNA, 13030 bp, Human
cccccaccccacaacagtccccagagtgtgatattccccttcctgtgtccaagtgttctcattgttcaattcccacctatgagtgagaacatgcggtgtttggtttttttgtccttgcgatagtttgctgagaatgatagtttccagcttcatccatgtccctacaaaggacatgaactcatcattttttatggctgcatagtattccatggtgtatatgtgccacattttcttaatccagtctgtcattgttggacatttgggttggttccaagtctttgctattgtgaatagtgccacaataaacatacgtgtgcatgtgtctttatagcagcatgatttatagtcctttcggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtcataaatgctcttaatggctgcataaatgtcttcttttgagaagtgtctgttcatgtccttcgcccactttttgatggggttgtttgtttttttcttgtaaatttgtttgagttcattgtagattctggatattagccttttgtcagataagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgagtggtattgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctaagggctctgttctgttccattgatctatatctctgttttggtaccagtaccatgctgttttggttactgtagccttgtagtatagtttgaagtgagatagtgtgatgcctccagctttgttcttttggcttaggattgacttgatgatgcgggctcttttttgttccatatgaactttaaagaagttttttccaattctgtgaagaaagtcattggtagctaaaaatggtaacgtctgcaggctgtaaatagtcaataatgaggcataacaggaagaaactagtctgaatgtcagaagacctaggttctaatccagactttgacactaactagctagttggcaaattgcacatactttctttggggttcaacatattcattacaaacctggaggaagggctagctagatcccttctagctcaataatttgggaactcttgaggggagaactagatatatcaatagaacatatagtttttataaggcacatgaagtcaccaactaggttggaacataatgcaagtcagtagtgcctggaataattaccaacataaaaataaataaatgaaaacaaaggtcttacacaggaaagcctcagaatctcagagggaccctgtgaagtcacattggtgttggacctgtctagtgcaaacagaattcagaggtggaaacaatcctgctatgaggaaggaagacactcctgttgttcaaccattcatatactagcgtgcattttgcttctctagactcattcattcatccattcatgcattcattcattcattttagagaaaccaagagactgttaccatggcagggaagcccaagcttcactacttcaatggacggggcagaatggagcccatccggtggctcttggctgcagctggagtggaggtatgttctaagttaggtcatcttaagttggacctaattgactgtatcaaaatattttagtaagccaagagacttccatactagatgacctgtgaatattttggcctcaaataaaagcatccccagttatttttttaaaatggacaaattttaccaaatgaaaatttaaaaatctgtccattaaagagcacatgaaaaagaacacatgaacaattaaaatatattttgaaaagaattaactaatcacaatgagtggaccttatttgcattaggatttaaacaaactataaaatataacttatgacacataaaaattagaaacctgaatattgattgaatgttagataatattaaagaattactgttaaattttttagtgtcattttgtgatgttaggtatgatgtttctgttatgtttcagagatacacactgaagtatttaggatgagataatatgatacctcagatttgtttcatattatgacagaggaggagagaagctgggcatacaaatgaaagacaggcttgggttggtgattactgcagctagatgattgaaacaaagaggaccattgtattttatgtgtattttttatatatatgagaaatttatacaataaaatgctaagtacatggaaactaaatgtcattaaacataaactataaaccacaatgaggtcagggagggagtggattgtgacaaactgcctgttaaatactgagtatattcagccagtggttattttgttgtgcacctattaagtgccaggttctgtcctgaggattggcagtgaacaaggtagacacaattcctgccctaaggcagactacatacatgtctacaaggactcagataagaaaacacgtggttaaaatcaggggtgggggcttctagaacacccaggcattccccagtgttaccaggccatcctcccagtgtttgagcaggaaatgctgggaggtgtctgtgggactccgctaagtgctgccttctagaggtgtcactgagaaaaacacttcccagtccagaccagagtccctcagtaactaactgcctgagggttttcctccagagtaagtaatggaaaaactcagaagatcttgtccctcgggtgtcagcagaaaaggagggtttcaggtgaggtggcgtcctgtgaaaggaacttctagcgcgccccttcagcctcacagcgctgtgtggacctgaacctcggggcggcactttctccaatgcttcacgagggcttgggactcacctttctcaaacctatgaggaaataagcacacaagaaatccacacacttccattccaggttgttttctgtgtacaaatgaataccctgtttcattgtcacccagacatcagctctgcagctcagtgcctttcctccagtgacgttccctccctaatcatggacatttgtgagatcgtggggaggtgaagtaaaagacggagcaggccaggagcagtgggtcacacctttaatcccagcactttgggaggccgataggggaggattgcttgagcccaggagttcaagatgagtctaggcaacacagcgagaccccagcactacaaaatagaaataaaaaattagctggatgtgatggtgcatgcctatagtcccagctactcaggtggctgaggtgggagggtcacttgggcctggtagatcaaggctgcaatgagccatgatcataccactgtacttaagcctgggcgacaaagtgagactctgtctcaaaaaaataaataaataaataaaataaaaaagaagattgagcagttctgacccattgtcagacccatgagcatgagcatggtctgacccatgcctgtttcttgagggataaaatctaaatttccaagcggccatgaccagcttcttctgtgtcccctgccaaactcagaaatcttatgttctccaaattatgtaccagatggaggccattcaaggtcacaagtctgtaatgctatggaacgaactaacaagaacccatttactgtttctgcttccagtttgaagagaaatttataggatctgcagaagatttgggaaagttaagaaatggtaagatcaagtctctaagtgcctctgatgagggtatctagtagagaaggtaccgctgaagattgatttttttttttttttgacggagtctcgctgtgttgcccaggctggagtgcagtggcatgatctcggcttactgcaagctccgcctcccaggttcatgccattctcctgcctcagcctcccgagtagctgggactacaggcgccagacaccacaccaggctagttttttttttttttttgtatttttagtagagacggggtttcatcgtgttagccaggatggtctcgatctcctgacctcgtgatccgcccgcctcggcctcccaaagtgctgggattacaggtgtgagccaccgtgcccggccacagttgaagattttaacaccaggcgatgcctatgtgtgtgtggggtggtagctgtggtggtggagagggagaaggtggttaaagtggaagggatgtggctccctgaacaggtctggcaactatctccaggctaaaaggccagacctctcagagtatctgctagaggaaccatccccagtgccctgagaatgccctttccttgttttcatgcttggggcaccgtgaatgagctgaggtcatcagctcaggatcccacacagccttccccatccaaggacacacaagaacatgaataagacgaaaagaatagaaatagatgtggccattaccttgagttgttttctttcatgggtcatgtgataaggtcatattgtagtaatactgtaggcttggaagaacacagaaagggacctctgcataaaattgtgtctcagaacctactttaaaggccatgaacaccatgagacttaccctgagaagttctcattttaagtgacatctctctggcactcccgttgtaacctgtctcagctttttcctaaaatatcatgacgataaatcaacgcaagtaaaatacaagggacctactatgtacctggatggggaataaaaacataaatgaaataacaggctaaaaggtcaaaggaatcaggtcagaaaaagaactacaggcagctaaaatcaaaatactatttcgtttttgaggttagcaggcaataatttctttttcattttataacctcagtcatttcaaccatcatttttcttcctgaaatagtgggattcatagaaatttcatgttccttttttttccttctttctaaagatgggagtttgatgttccagcaagtaccaatggttgagattgatgggatgaagttggtacagaccagagccattctcaactacattgccagcaaatacaacctctacgggaaagacataaaggagagagccctgtacggtatattttgtgttcttccatccacagagaacacagagtgatttaggtccttccttgagtgggtgagaccatgacagggcatcatgaccaggagcaggctgggccttgggcgtgtatactgaggtccagtattgcagagtcccatggggatgaggaaacagtgaacgtgaggagggttcaggtgagtgtgattctagaagaggatgcattccatggatccagcaccctgacagaggtttccaaacactgatgaaccatgaactcaggaggatggggaataatgattccaggtgctcaagccttcagaggctggactccagccaacagcttaggacaggcatagaatgtttgagagtctgtagatgaaggcctggggagggaagactgcaaagaagctgaatctcaggtcccagtaattccaagaatgatgcccaggaacccaagttaccagccaattatatggactggtcaacttgagcagggctagtagaggctggcacccagaactctggggttgcctggaaacatggattcaaggctgaagcagctagatttatcgaataccagcaaagccatggggtctcctcactgttgcaatagggctgcctgattctaaataacatcctatgtgaaactgttggcagttcttcaaaaagtttagtgtagagttaccaatgacccagcaattcctctactaggtatataccaaaagaatcaaaatacttccacaccaaatcttgtacataaacgtacagtgcaaataacggcaattttcatggtattcaaaacgtagaaataacccaaatatccatcaaccaataaatggaggaacaaagtgtgccttagccatgcaatggaacaatatttactcatgaaaagaaatgaagtactgatgcatgctacaagaaagttgaaccttaaagacatgttatgtaaaagaaattaggcacagaagtccacatattgtaggattgtgtgtatgaaatgtctagaatattcaaacccatagaggcagcaagtagactagtggttgcctgaagctaaaaggtttggggtttggggaaaatgaatactcaatgggtacagatgtccttatcagggtgataaaaatattctagaattagagtgtgatgatatttgcagaattctgtaaatgtactaaaagtgactgaatactataatttaatgggtgacaacgataatgtgtgactatacatcaatgaaactgttgttttaaaaagtactgtggaaaacctaattaaacacaaaagaaaaaaaggtttcctaaaatatgtcctggttgtaactgtgtatagaatttcaccaaggaaggggatcttttaggtggggtctcaagtaaggcacacatggctagagttgggcaatagcacatggatagggctgtagaattatgtttcatgggagtaattggaaaaactgctaatattgggcatagaagtgggcctgggagatgtaaatgatgagacaggacaaggaacatgactgagatggctgtgccagggactctcttgggattacttaggagaaaagtctttggccatttgactcacacgaagtttatgcacagaacaaaccacaatggagatgataaatcctggcacagcatcggtgggtactggcagtgattccaccaatttctctcatgactgtgactgtagacaggtcaccgatgctctttgtacctgtatttggtcatgtgcataacaaagattttagagatatatctacctcgataagttgttttaagaaataaaaggcagccaggcatggtggctcacccctatatcctagcactttgggaggccaaggcgggtggatcacgtgaggtcaggggtttgagaccagcctggccaacatggagaaatcctatctctactaaaaatacaaaaattatctgggcatattggcaggcgtctgtaatcccagctactctggaggctgaggcaggagaatcacttgaaccctggaggcgaaggtggcagtgagccaagattgtataacctcactctggcttgggagaatgagggaaactccatctcaaaaaaaaaaaaaaaagaaaaagaaagaaagaaggaaacgtcaacatacatgcaaaaatcagagcataatgactagaatataaaaggcacccaatggagatgaattaccttaccaccatctgaccctctattctcttaggtttttataaacctacaaaatctaaggcaagaggcatttgatgctttggctgtttttgtctttcagaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaaaaagtaggtgaagctgttcagcattttggggcactgagtttagaggccagtagaaaaatagtggctgggcattcctggggcactgaccttcactttcagtgagacttcctgaacaccaattcagctctctgactctcaaggcattttatgaaaattgacttagaggaacagtgataccacttatccccaagttataattttccagcaaaatttcaatttactagaccccagtatagaattctctattcaacaattttatgttcataagtagaacatgggctgtggaaggctctgaaccacactagaggttgctgttgagtctgtggaacacaggctttgtctgaagatgaacatgatgaaagcgatccattagaaactattctggcaccatgtgtaggaagacaggagaccaatttcccaaccagagaatattgtagtgtttcagagatggatatttcttaaaaggatagtgacagtggggtggagaggaagattttttaaaactcattttaaagtaagttgcagacgtcagtgcagttcactcctagacacttcagcttgcagattataacagcgcaggttaggagtcagagccgatattgcaagaaagatgatgaattcaagttcaccctgttagataggagttctaaatttcttttcaaagaattaacatgtcagtatattcaattttttgccttctacttttaaacttaactacctcgtaaagcaatctttttcgattacctactccaccctgactcattccgatcacctgctccaccctaactcattccgatcacctgctccaccctgacccattccgattacctgctctaccctaactcattccgattacctgctctaccctgactcattctgattacctgctctacccaaactcattccgattaccttctcctcctaactcattccgattgccggctacctgctctgccctgactcctgccaaagcactcaccccgtcattctctttaaattagccaatcagaattagtttagccagtgcagtctaaccctagccaataggggaacgacacagcagcagggggaaagacacagcagcaggggccacgtgcgtcagggataagaaacccttcccctcctttgtccaagtgtgcgctcaccgttgttccatctgtgagagcgcacccttctatatagaagtaccttgccttgctgagaattaaaaagaaaattttatattcaagtactattctttttgcgtcactgaaactttatatataacaacccaggtttacttcagatcccagggagatagaacaggaaatgaggaaagcagacaaggcattttatgaagatagacttggaggaacaatgataccacttatacccaagttataattttccagcaaaatttcaatttactagaccccaatatagaattctctattcaacaaaattttatgtttttaagtagaacgtgggctgtggaaggctctgaatcacactagaggttgctgttgagtctatggaacatatggagaaatgaagactctgaaatagtctactcctggaggaagagtgctgtcatgaaggtggagtcactgcccaagggagattggagagggagagagcagattgtagagccacatcctgaatgtcaaggctacacgctgtagggcctggggcagacagaacatgcagtagcaggtgctaaacccctggcccatgtggaaaatgcaagcaggtggatggtgtggatgccacagtgatgtggaatgagaagagaaaatgggagcctgagctccaactgaggagtgagcagagccacattcttgctccctcactcaatcagggaacataaacaaaggcctggaccttcacaccatccagttaggcaacacaggtgggaatgtcaggctggaaagactcagggagaagcaggggtcccatcctgggtgcgcatgtattcctgatctgattcctcaaattctccaggtgttacagagccatggacaagactaccttgttggcaacaagctgagccgggctgacattagcctggtggaacttctctactatgtggaagagcttgactccagccttatctccaacttccctctgctgaaggtgacccatttcacagccctcagagagacagccccacatgtcccatcttgggatctagtatctgggcccttggactggccatgttctgaccccagcctttttcaggccttcagtacccccaggtctccaaaatgagcttccagaccccaattttgaggcatgaaaagactcttgttctggaaaggaaatttgtggtcatgctaccccatgaaaagtattttgccttttatcacggaaaggacccagggcccagcatcttccttcctcccccattcctctgtggtctgttcctgagttctgtgattccctttatcccaagactgtccttgtgttcccacactgaattggtctgagcagggccctttccatctggttccttccttaggctctggccagggtgggcagcaggagctgtcagatagttgtgttcctctgtgcacagcacacccaacacactgcccccaaccctgtatctctcactgagaaaacgtggtcccatggtttgactttaatattttctataacattttcctttccaactcatttctccatattttcacttctgcttagagactgacctgtgttgatatctcacaggcacattattttttcttgtcttatacaagagtcactaatctacaggattgatatgtaaggagaaagatagggatgactgaattgattaaaactttaagacatctttgcggaaaataaagtgagctacatgttcttcctcttatcttcatttatcactgggtgtctgtttctgcctccatgctggtgctgatggaggggactcacttggtctctggcaggaggggtcaaattccctgggtggtattaatggtggtggcagaccttggcttcactctgaggctgtgctttgtgaattacaggccctgaaaaccagaatcagcaacctgcccacggtgaagaagtttctacagcctggcagcccaaggaagcctcccgcagatgcaaaagctttagaagaagccagaaagattttcaggttttaataaagcagccatggaggctaagaacatgcaagaccaatattctaaagttttgcaacaatgaagtgctttacttaagtgttgattgtgcctgttgtaaagctaatgaaccctttccaattatatgctaattaaataataaaaactcctatttgctaacttagttaaaatttaagccttttcattaggatctgatatgaattcagatttctaatctcctcctaacctctttcttgaaattaaaaatttagtaaaaatgggaaatgtaggttatatggtttgacttttaccaagaattatcctgtaacatttgtcatacaatctattaaaatgtcaatgtagaaatgcgctcctgacattttcaggtatgcacaggagaagagttaccattctgggtaatggcataaagacattttcttcttttcctggacagtcattttgtttcagataaaagcgttctttctcctgtattttcaaaacaatgattctgtctgctgtggattcctcagttttctaggaggtgaggaaatattgaagagcaaacagacccaccctctgctctcaggccaccctgttgtcccttacagtgcatgtgctcctggctcatcctcactctgctccttaaggctctgtgggggccaccgtcatgaacattccctcagttccctcagtgccactcaggcctgggctgccaagatacagatggtatatttgaattacatataagtaactactatatgcaaaatcatttttccgtggtgtgtcattgtgccagagttcttagatgaggagtgctttctagctccacccacatactgggcctatagtgttaatctcccctcggacacctgggcttctgcaatttgagctctcctgttagaatgagcttccccacagttggcagaggtggttgagggagcagacagacacaggcttcctacctgcagcttcactttgctctagtctcttctccacttacaaccagcatagcttttctaaaatacaaattggaaaaaaaaatcacagaattctgcagtgagtcctgactgcatatagaaggtatcctcacacccgtcctcactccttgatctccagcccaatcaaccctctgagcatggtggagcctcttgccttcctgcctgggtgcatttgctagccctgcctggcaagctccttcccagtgatcacaattaaatctaccctattgcttctccggagcattgggctgtcctctgtgccctcctcagagccccagtgagcctctaagaacacctgagggccactgtgtctgctcccctgtgctgtgattacgggtatgggacacttacatgaactagaatgctgaagctttgatgaaactaaggaattatagaattttaatatgataagagaatagtgtgattatgtttcaacaggtagttcttcctttctagagataaacagtagtatgtacagaagaaatgatatgctgtctggaatttgtttcaaaaaaatcccttggtagtggggggagtagaagtttgtactgttttcttgtggcttctgtcacagattcctacaaacatggtggcttgaaacaatagaaattctgaaggccagaagtcaagttgtgaggtccacattcccctggaagctctagagaacaatcctttcctgcatcctacagcttctgggggctcttggcatttctggacttccttggatcttggccacatcactctactttctgcatggggcttccagcacctcaccctctttgtgtctgtgtcttctctgttgtgggtacacttctcactggatttagggcctatttaaatataccaggatggtctcatctcaagttccttaacttcatctgcaaagagcttttttccaaataaggtcacatttacaggatccaggggtttggatatggacctatcttctgtgggggccaacataacccactgcatggtgtagatgaagaaaggcttttgtcaatcggtgaatccaggtcatgggtac

SEQ ID NO: 13412 - DNA, 8559 bp, Human
accttaaccctagcaacccacctccgtccccatggcaaccggggcggggcccgacccggatccgccggtcgccccatccggcagcggctgggagtcttgccttcagagagggaggaggagtccgcgcctctcctactggccctttaagaggctccgcccggcaagtccgccactcgctcccgattggtcccgagcgcggccgagcgcagccgaacttgacgcaccgcccgcagccttccttaccaacctcccacgcgactcagcaacctccccaaccaatcgccggccggcgcgccgatcggtatctgcatgggctcgcccggggggaaggtctcacccaatgggaccgttcgccgaggccttcattagcatgccgggggcggggaggggcggggcggccgacgggggcgggctgcgggcggttggttggagcgtcgcgcagtcgggaggtccgggaaagtttctttggaggtgaaaacagccgcggaactccgggccctgagagggggcgggggtgcaggggtcccagggccgggccggggtctttcctggcccgggggaaaccggcccaggcctcccggggggggcaatcgcccaacaaaggattcttggggcgcccgccctcgaggacttccctgcccctggatccggcccccccagcgctccgggcccggcatcccggggctctccatcgcggggtaccccagttcgcggtctgccatcgggcagcccgggcgctactcacctccgcccgcgtccgtgttccaggtccggcccggagcggccatgtcccacggccccaagcagcccggcgcggccgccgcgtgagtgcactgatcccctccccacgccctcgctactttcccggctgcagccctagctcctgaacccctgacccagtccctcccgccggagtcttgactcccccacctgggtcagggggcttctccctccacccaattctgcaccccccacctcggcctccagtccctcccaggagccccgcttgtcccaccttccccggatactgaccccatcagaccctgcctcctcgggctcatgcactctcgctgcagccccgccgtcgggggtcaaaacgccctggggtgggcttttgggggaggggagattcttgggacggggctgaccgcggtatccttggctccaggccggcgggcggcaaggctccgggccagcatgggggcttcgtggtgactgtcaagcaagagcgcggcgagggtccacgcgcgggcgagaaggggtcccacgaggaggaggtgagagtccctgcgctgagctgggggaggccccgggctcccgccccagcctcgaagccccgccccaggctggatttgaattgcttgtggctccgcccacagcccattttcctctggaagctgagaccccgccccgtgccagctgccacgcccctgacaggtcctctgccactctaagtccaggccccgcccaccgcacaatgccagctctgcccactctaaggtcccgcccacttccactccttgggggcggcaccctccccttggtcctgtgggcccgttctccagcagaaaaccacgcccaccaagcagaggccacgcccacaaccgaagtcaacgccaaccctgtactcaaacctcggcccatagttcctcagatcccctcacccctggccagggatccctctaacccaccgtgtcccgactgctgaccgggccctacctccatcttttccgggttcttcctcccagctaggccccgcccccatccccgcccatacgcgttaggccccgcccatgcccctctgagccctgccccagtacgccaggcccccctcccaacgacgcagcccggttctgcagccggtgaagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcaggtgggcggggcggggcgccgagcagggctggcggggtccacggactaccccccagtagccccgacccccaaaggattccacgtgcagggtttttccttcttcctggagaaatgcccacccataaccaactttttttttttttttttttgtgagatggagtcttgctctgttgcccaggctggagtgcagtggcgtgatctcagctcactgcaacctccgcctcccggcttcaagcaattctcctgtctcagcctctcaggtagctgggattacaggcgcgtgctaccatgccctgctaatttttgtatttttagtagaaatggggtttcgccatgttggccaggctggtctcgaactcttgacctcaaatgatccgcccacctcagcctcccaaagtattgatattaaaggcgttagccaccgtggccagcccatgaccagcttttgggggcgcggctagcaagaggcaagacagattgaaaactggatgaccaacaaagatatgtctaagaagtcaggatggggcctggattttttgcgaaacccgattttcatatcctgttagtttaaaaattgcaaaaacatcacggaaatgtaacaaaagccatcactgctttgcatccctgtaagtgagatttcaaagagagaaacgggtgcgggagggagtccaggcatccgcatacgctggaggttgggttcctgcccatgactctggcgtccgggagtggtttgtcagggctggaggtggggaagagtccggggcatgggaagtgaggtgggagctcggaggtccctgagcaacaggctgaggagccggttctgtctgcctggagggaatagggagctatagaaggttcaggagaggggagggtgctgtgaaagcagagtgataaagactggatcctggcgttggaggcttcccctgcttcaagccttctggtgctgccccccagcggtacctggatgaggccgagagagagaagcagcagtacatgaaggagctgcgggcgtaccagcagtctgaagcctataagatgtgcacggagaagatccaggagaagaagatcaagaaaggtgggaggggtcgggcgcggtggctcacgcctgtcatcccagcactttgggaggccgaggcgggtgtatcacctgaggtcagaccagcctggccaacatagtgaaaccctccccctctactaaaaatacaaaaattacctgggcgtggtggcgggtgcctgtaatcccagctactcgggaggctgaggcaggagaattgcttgaacccgggaggtggaggttgcagtgagccaagattgcgccattgcactctagccagggcgacagggcgagactccgtctcaaaaaaaaaaaaaaagaaaaagaaaaatgaaaggtgggaggggccggtgcgagcagttggggtcctgctctgtggggtgcgacctcagcccaggcagggcctccctccgtggggcacagtcccgtgggttgggcgggggaaagatacatagccagacaggagtgaagggggctcactcggtacagcgatgggggatgcccagacgcggggcactcaagtggggagctggagccggctgagcagcgctgacctagggtgcagggcgtggtccctggaggcctgggaggctgaccctgcccttcccctcccccgccagaagactcgagctctgggctcatgaacactctcctgaatggacacaaggtaagcgaccttcttcctctcaaagcacctgggggagaaaggtctggaggcttctagaaccctgagtcagagccagtgctcgcccagatgtgtgcaagcaggggcggtgccactgcaccgtgggatcgctgttgattgtactcccaccggggtgtcccaggagaccctcctaggcttggggcacacccagagagcgtggctgcctcctaccaccagtaaattgccaccttgtcccttcgtcttagggtggggactgcgatggcttctccaccttcgatgttcccatcttcactgaagagttcttggaccaaaacaaaggtgagcggtaactgcgctcctgatgcgaactccgtgaaactgggtggtagaggggggcgtgggccaggagggccccaagactgcaggaggcggatcgggaggttccctatgagcgtccaggcgcacgctgtcgctccagaggctgatgtggagcaggaggcagagggcgcagtgagggaaacctgggcaggggcacgtcccgggcaaaagcccggaggtaggggaaaggggaggcgcaggctttgaccccgctccccccggcgcagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggtgcgggccacgcccatctcccagtcccgccccggtcacccggccccgcccgcctccccccccctcctcccttccccccttcccctgtcgcccggcgccgcccatcgccccgtcccctcttccccagtcacccggccccgcctatcgccccgccctcatcacccccagctccgcctcctccccgacccccgcacccctaccccatagctccgtctggttcttcccagaccacacccgagctccgctccgcgccccgttactcggccggctccctgacctcgcccccaccgaccgcgcctcccggccacgacctctcccgacgcgtccccgcttactcgcttcctcccgcagcccctttgtgcccccacccttcgcgcccccaccgctccctaccggccccaccgtcgctggcccctctccctcgccagcccccgaccagcctgagcactgacccagcctccccgctcgccacgccacgttcccattcaccccacctccccacgcccccgtcacccatccctccccacgccccgctgacgcctgagccccctccaccaccccagtcacgtcccacgcgaccccagccccccggtgtcatccccacctccccgacctcgttccctccgtccgtgactgtcctcagcggaccctggacgcccgccgctctagccccgcgtccccaccctgtccccgtcctcgccatcctcctgccccggcttaccttagcccaccctgcgccgctcctgcgctggcggtgtccggacctctgagcgcccgcgcgacccgccctgagtcaccccctaccgctgcccctggagcccccgccccgcgactccccggcaccctcgcctgaccttcccgcctgtcccccaggcacgggcgaaacgcccacgctgggcactctggacttctacatggcccggcttcacggagccatcgagcgcgaccccgcccagcacgagaagctcatcgtccgcatcaaggaaatcctggcccaggtcgccaggtgtgtgccgggcgaggcggggcggggccggggttcaaggcccggatgtgcccgccctggggttccccaggtccgcgagggctgctgggtgggactccgcagcttactagagatcacctcccggaggggcctacctgcggtcgcccctgatgcaccagtgctaggatggccatggagaaccccgggccggcgggacccactcgggggcaccagaacttccctaaagcttctcagggtggatcccagcgcccgggttagataggttcaacgcctgtcccccaaccctggcatctgttggagcagctgatgggccatggtctctggggttccccagggccggggtgggggccagagatgatgagggcctcatcccgggccctcctctctcgtttcagcgagcacctgtgaggagtgggcgggcccacgatgcagaggagaagctgtgggcgcggccctgccacaccccaccccgtggacgagaggctgggggtccaccctttggggcctggtcccatcctgcaccttgggggctccagcccccctaaaattaaatttctgcagcatccctttagctttcaatctccccagccccctgaacccggaaaaagcactcgctgcgcgatacacccagaagaacctcacagccgagggtgcccctcctcggaggacagccacgcgctacactggctctccgggccacccccaggacacagggcagacgaaacccacccccagcacacggcaggaccccccaaattactcactacggggggctgtgccataggccacacaggaagctgccttgtggggacttacctggggtgtcccccgcatgcctgtaccccagatgggtgggggccggctttgcccatcctgctctcctccagccgagggaccctggtgggggtggctccttctcactgctggatccggactttttaaataaaaacaagtaaaatttgtgttttaagcttgtgagtgtgtaagcttgtttggggtggtgtggagggttcagaaggtgcagcctgggccccccatgacattccctgctgggggcgccaggcctgctctctttacctctagcagagcctcagagtttctcagatagggagacgggagcccaaacttgccggggttcacagagcaagtcaatggctgggcaggtgtctccatccctcccctacctaaagttgggcattgtgggctcagcacacgtgggggacttgaagcacaggggacagtcacggctgctcagttcatccttcaacttgtgtccgcacgggggttcaagtccactttgtagcacagtgactttgggtgggccacggttttgtttattgtgtaaaatacgcaacatgaaccttaccattatagccattttgtttatttattggagacgcggtctcactctgccacccaggctggagcgcagtggcccgatcatagctcactgcagccttgaactcctgggctcaagcaatcctcctgcttcagcctcccaaaccctgggattacaggcgtgagccaccgcgcctggccattttagccattttaaaatgcacaattcagtggcatttagtacatcacaattttgtgcagtcatcacctttatctaatctcaacgcattctcatcacccccagaggaagtcctgtcctcatcaacagtcactctcatcccctccccagctcctggcacccacaaatccccttcctgcctctgtggattgacgtgtcctggatatgggaccacacactgtgtggccttttttttttttttttttttgagacagagtcttgctccgtcacccaggctggagtgcagtggcacgatctcggctcaatgcaacctccgcctccctggctcgagtgattctcctgcctcaacctcctgagtagctaggactacaggcgtgtaccaccacactcagctaattttttgtatttttagtagagatggggtttcaccgtgttagccaggctggtttcgaactcctgacctaggtgatctgcccgcctccgcctcccaaagtgctgggattacaggtatgagccaccgcacccggactatatgtccttttgtatctggcttctctcactgagtgtgattgtcctccagatttatccacgctgtggcctgtgtcagagcctcattccttttggtggctgagtcattgtccagtgtgtggatgaatccgctgtattgaccccatctatctgtcaaaggacacttggctatttctaccacttgtgagtcatgctgctgtgaacattcatgtacatgtttttgttagaatgcacattttccattcttttggagatacagattgctgggagttctgcatttggcttgttttgtgtacgtgtgtgtgtgtgtgtgtgtgtgttgcttattgagaaacctttccagggacttctgcgtttaatggcatacataagacatcctaaaaaattcggagaataatctgaaccccagaacctctgaacgtgaccttatttggaaatagggtcactgcagatataattagttaagattaagtcattactggagtagcataggccctaagtccaagatgactgctctccttataagaagataaaatctggacacagacacagagaagagacagccaagtgacaacagaggccgagactggagtgatgtatctagaagccaagaaacgttaaggaaggccacccacagccagaagctgtggatgccaggaaggattcttcccaggggctccgagggccctgccaacaccttcattgtgggattctggcctctggagctgtgagaggataagtttctgctgtgttatgtctccctgtttgtgatgctttgtttttgtttattttttattttttaggggttgggggggggtctcactatgttgcccaggatgatcttgaactcctggctcaagtgtcctgctgcctgggcctcccaaagtgctgggattacaggcgtg

SEQ ID NO: 13413 - DNA, 116652 bp, Human
  misc_feature (1)...(116652): n = A,T,C or G
tcccaacactttgggaggccgaggcgggtggatcatttgaggtcaggagtttgaaaccagcctggccaacatggtgaaaccccatctctactaaaaatacaaaacttagcgggtgtggtggcgcacgactgtaatcccagctactcgggaggctgaggcagaagaatcgcttgaaccagggatcggaggttgcagtgagccgagatggcgccactgtactccagcctgggctacagagcgagactgtctcaaaaagaaaaaaaaaattccaggcccatcttgaacaccacctcttccagaagcccactgtgatagtgcagtcagatcctgccttccctcctctgtctcctcccagggagcctcaaatcctagactcttttggtgaaacacagggagcatgaagcttctcgttatatggagacctgccttgaattctagcttgtccttgacttggcccatgatcttaggctaataaatgccttgacctcgttgagcctcagttttcgtgcaaaaaagcaggtaataataaaccttagggcaataagggacgtgctctgttcgggcaatgccttccctgctgagtggcgtggccctgtgatttttgaatttggctgattcctctcatatggcagcgcaagcccctcaggacgtctatatccttccacccagctccgccagccctcaggtgcttaatgactgtatttacaggcatctagcgcagccacgcagccccggagctgcatcacctctggctatgcagtctttcacttatcaggagggttaatgagatgcagggtagaaaggtcttgccactcgcccgcccgctcgtggaagccgagtagcttggtaacgacaccacgacttcacgtttagtgcattagacgcgtagacccttaggggaggcagagcttcccggtatcgccgagcgggccctgagggctgaggctgggcacccctgcgcacccctgctgagtgcccggccaccagaaagacagatcccccacctttccttctccctgacccggcgcgcttcctggggaacaaactctcccttaccctcagtggggctggggcctcagtctgcgacatacagtgggactcccatgtctgcatgcctgaggtgggcggaagggggcggtgggtgctgggaagacatccgtccgcttgcagctccgctgagtctccagcacctgaaaagccgcggccgaggcctgagggaccagcccagccgagatatcgggggcggggcagcccaatcccaaactggcggctggacccgactccaactcgttcctcctaagtccgggacagattgtcgggaggagcttgaactgagcttcggctcccgactgggcctgggcccggcccccactggtgccacctccctcccttcctggcccggctcctggcccacactcggccctggcccggccctggcccggcccagacccggcccggccctggcccggcccagacccggccctctgaggctcctccgggctccaggttggcgcaaacaaagccctgattgactgcccggaggggcgggcctcgctgcatggccgcctcctcccctcccaggccgccagggatttgccgggaagagcgggggcagggggagactcccgggggtgcgcaggaccgcggggggccgagtcctcgggctcgagaagattgtgtccacccgctgtccgaggcccaggctgtcccctcaggtcgtcctcctcaagtccaaggagggacatgggagctcctgagggcagggtggggttcctcgcgggccagctgtcgtcctagggtccccggtgccacctcagttgcgggctgcttgtgaggaaggagggtatgggagcaaaaaataggaggggtcttcccgaggctcggggttgatcagtgtcggttctagagcctgcggggaaaagagggcaggagaacaggatagtttgtgcttccttttttccattttaacttttcctctaacgggcatccgggcaagaacagggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcaggtgagtggccccgcacgccccacttggcattttgggcaaggttggccgctcccgctgccaccgaccccatacctcccggtccgaggcgcccctccaacgcgcctctccgactcctccccttaccccttaccccttgccccttgcccctttccatggctctcctagggtgcgggttgcggggctttgggcagcttggactggggagactaggtgcaaggcgtcccgggggtacgaactgggacattcattgatccttggcaagcaatggacttttttttgccctgggacaaatctaaatgcacctttcaggtttaaggtacctttgcccctgtgtgctgggggaaaatatttgcaggactttttttttttttggaggtggggagaagtcatgaggagaggagagaattgagaggcggggcgggctctgagagaagcactgtaccgctgatctccgcagcagccccccggttcctttggggaaacggaggtgttttctgttaaaaacactttaggaatcctgatgactatgagcgaagagtcaaacacatggcaggcgtgcgtgtctgcaagagagaaagggagggagggagttcgagtcggggtgtgagtgcgtctctggccgccgccgttacggcccagctgggcccggcagtcctctgccgccccgcgggagtgaatggatctccgtgccctatgagccgagccccagagcgggcggggaggcggtctccgcagtctcctgccagagaggcgtgaggccgcaggcaggctgggccctgctgctcactccgcaccgcccccaacttcagccctgccttccccggcaacccgcgcctctctgctaccggtggggtgcctcgttcggcctacagcctgagtgccagacccgccattccagctttcccctggagctgacttgatctcagacagagttggggggcatagccctcgctttccaggccagtggacgcaagaccccaggcgtgtgcgctcttctcattgaggccgcctgtgagctgggagaagtcagaggaaccatctcgctttcccagcaaagccgctggcgaaatccctcagcagttctggtgagggattcagacgaagacgggggattgggatgccctctctggcaaggcttgctccctctcgtggctcctcaggacagctcgactcttgccaccagccccaagttcacaactcagaatatgtggcttttcgcagtgttgccctcggactgaggagttccatcctctcgccaacctccaacccccacatatttctactgccatttgaggggacctgggaattattaagtgaacatagaaaccttgaattctggagtgtccacctgtggattccctgggccctctccaggacttgtggttttagtttgcagctttgctggacttccctggcagaaggggctttggggatcttggtgcctcagaccttgtgatccattggcacagcagcggtgtgcaggccccgatgaagatagtgcgtcagtggttgtcaaaggaagtctcttgactacccaggcccactgtgatgctggaatggaggggtcctgggacagtgtagagcaacttctgcggggaagatggctgccacagtcacccctgggaccacctttttccctgctttgatgcagttcaggggctcctgggaaagcaggcagtgtagggactcatgctgttgcctaggttacctccaagggcacctgctgagcattgccctgtggttgaaggcaggctgttggccttcaggatcagtgagtggcaaagtctgagtgaaacttgatgagaagcagtagaggctaggctgaagctaggccctggcatttatatggtgtgaggaggcctagagctgtgatcttaggagtgtataataaaacttggaaaaaccactattttaccaggaagaggctcactgctggggaacagacttcaaagtaggtgatcataggggactcagggggagggctggctgggactttccggtcaagacctcacagtgcagctagagggtgggggtggtggtgggggtgcagttggctatgcagaggtgtggctagtgcatactctgacacagaccaggttcactgaggggctgaggtcactggtttaaattatagtgagtataggtcaggaagaaacagaaaggaatttggtatgtccctagggtctcagaatactttggcttgggtccttgctgtggtgtatcttgaactcactgacattattttttatactagaggttcttagggacaccacagtttttattttggaaaagtcaggaacaccctatcacatggagctcctagaaaatctcatcctcagtactacctttgctgagctcttcaactttcccaagcaaccattcagatcctgagattctgaatgtctttgcctgcagacactttctgctgtttactcaaaatttcccagccgtctgtgccacagcactggtgtctcaaagggatagaagaagctaatagaagtttgtgtcatttttatcagccagtatttgtccaatagccattctgggagaaacagaatgtacacccccacgctcaaggaatttggtgcattgtccatttttattaatatctgacatgacttccatctctaagagtctatgaatttggtgtttggaggcacctcgtaacccaatttctctttgactaggcctaatatcttcacagacctaaagctgtgttgagtggcttaatgggtggaaggtcctgcagatgattgggattgttgtgaggaagccccacagaaaggtagtttcttatactttatttttagagatgggatcttgctctgttgaccaggttggagtgcagtggcgcagtcatatttcacgacaccttcaaactcctgggcacaagcaatcgtcccacctcagcttctcaagtagctagaactacaggcatgcgccaccacacctggctaatttttatttatttatttatttatttaaaaacagactcttgctatgttgcccaggctggtctcaaactcctggcctccagcagtcctactgcctcagcctcccaagtagctgggaagaaaggtagttttgatgtttgaggaacagctccacatcagagtgcctctgggcatgggaaaaagccacagaagttagaagggatatgggattcaggccttactagagcatgcaatgtgcagtttttgtggaccctttgatgtatacagttttgtggtgtcaccagctgtatatcttatcccctctcttcaccagttttggaggaaagccaactttccctgggtcctaggcttgggtggattggcaggcaaaaggtccctgagagggaggcaagtgatcaaactctggtttagtgaaaaaaggaaaaagatcaggagggaaatgagcctgtatttcttgccaagatcatgggaaatttgtgagttccccaacccagaccaaacagcagacaggacaggaggcaaccaggcaattctgtggaaagtaaaggcccaagcatagcttcttggggtggtagggaagccttttggaggaaagaggggaaagagaagcaagacgccattgattgtaggccccagctcaatattgggaccctaagtgagttggacctgcaatagggttagggttgggagttcagaggacaaggcagaacaagccagagttgctaacattggctctatgcttaagtctttttaaaagtactccagagtaaaacttgactgccggtccaccattgagccaaaaaatatggaaggcatttttgttttactgggcagtttataagcatggtccttgtaagctcccaaggggggtcaaggctgaggctctcatcaccagagaaagggacaatggtcaggaaggttcactactaggcacaagatagttcaggctgatggtccactctgatggaaacagaattttctaggcatggggaagaatgatacactctgcctttgggtgaaccaagagtcccaaggttgggtggggccaggtagagtaggctgtctttctccttctcaccttaggggttttcattgcttggttcagtgtctcactggactgtaacactaaattgctgactttgggagcaaagtgtattttgagcaaatctgccaatctcttgacttcagctgaaggctcttgactactgtccagcagagctagatcaggttggcttagcgcctgctgtggtgcttcaagccacacagcccttggccaggcatctctcacgtcattcccctgccccctttccaaccaaatgggatcttgaactatgaccatgactgatactgaaagggatgagaataagagattgggtcatttggaggccaaccaggaggatgcttgtttgagttggggtagctggttgaggctggatgcctggatcactgtacagtggcctcaaatgctcattctaagtctaaaaaagcaagacccagggccaaatctggactccccaaagctggcagtctcagtgataccagctaggcagtaactgtgacttagacaacttgtgcccctaacttattctgtgactttggacaggcacttcacctctctgtatgtcagtttatctatctataaaatgagagggtttgactaaataaactttctagccctaccattctatccttctaaaattatgtgatatcttattctttactattcatatgtcatacattttgactcatttaagtaaataaaagttcgttaagctgcctgaatgacagtgaggatggattgggagaagattgggaaagcaaggaaaagccctatatacatcatttccccacgtcatttgtatttaaagactatggggctgcccatgggtatagatgtgtttaaaaattacccaatcctttttacctagtatgtaagggcaaccctgcatgtggagctgcttcttccagagtgtcctgattggtatagagctgggtctccaagagaactccctggatttggcaggcaagcagggtgggtctgtatgctgctgttttccagcgtttgaacctgttcctcaaaagtattaaattataaacatttcctcaagcctcagtttggacccctcttctgaaactgaatttcccacagcacagtcttatttctcagaaatgcatagtcagtgtgaccttggtttgctgttacttccagctagcagaggaaacggattcctaaatgaggttcccttcagaggtcttcaaacagggcgttttgatagctggctcagggccactgcctggatcctgctgtggtggggttggggagggttgctactgtgatcctggagaaggcccattagatgcccacaatccctggtcaactgcagcgtcagggcttagctgagagtgtgcctacggaagtagcaggcacagagctctctttccttttccttggaagtcattggccgtattgcctccagcccatgaagagtaaacaagcagctggactgtcaacatttgtagaagtatataaaggatgccatatcaaccttttgagcagaccagtttcccaggaagatgcactgcttttcccaccagcctcattttatggttttgttgcattttgaaaagatgaaaactactcttttcagattgtgtgaatgacggagtgggatttcctgtcttgaaaggtgttgtctcacttgagattgaatgaatgaaccctagagaaaaggctttgttctacacatatacacatgtgcgcaagcgcatgcgcacgcgtgcacgcgcgcgcacacacacacacacacacacacacacacacccataccctacaccctaagccatagattatgaatattccatctgaaataagtcatttcccatctgttcatggaattaggtgtaccagaggcttctgtaaagattatgctgtactagtgcaaaggaaccagactaagaagcttgctaggcgagagtgatgaaaagagtatggccagcctggattgtacctcttgaactggacccatttgcaactccccagcagtggggctgggaaactttattgcaagtctctttctcccttcatcctcctgtatctctcccagtattcaaatattactgggaagcgggtttaggcaaccccagctctctctggctttaggggtgacagaagactaaacctagagagatttcatcacctgcctgaagctgggtgctatggtagataatgtgaaatcgcttgacacctccttgtggatggggaatgtggcctgtttgggtggcttgaggaagtgcagcctcttcaccctaggagtctcaccctcttttatcctcaacttcgctccagtttccagcattggtgggagaagggatgaaattggctgtcccaatcacatattttctcagcttctcctactttcacagtgcattttttatcacgtttgctatatgtgccatacccttttttcccagtattgttccctcttttctttttcttcctactgctcagttagaggaacaattggggtttgggatgttgtataggcccaactcctgccagagtcacaggcccactcctacacatcctacagaggcctcccttccccctttccccttcctttcctctcttactttccactttctgggtgaagggtgactttcgatggagcactcaagagtgtggaagccatcacctctggattttcgcataaagatagctgctatgacaccctttttgtcacttctacacctctttccacagccctagtaacccagctcagaaggtagtattgtagaaagtcttactcaataatattcaacaaatgtcgtcattacttgtattcctttcttttcaaatcctgactatcattgtcccccatctcctgggccagctgaacttccagagatttcatactggtttttggtagcttccgtgtttctggttcattctattttgagcccctgacatctattttcttgccaaaactgctgcacaattggttgtagaggggtcagagaagggagaagacagacactcaagtcctaacgagagtcaaaagtgcctttacaggaagattgctccagcccaggaggttgaggctacagtgagccatgatcaccactgcacctgtctcaaaaacaaaaagaaagaaaaagaaaaaaataggccaggcccagtggctcaagcctgtaatcccagcattttgggaggctgaggcaggaggatcacttgagcacaggagtttgaggccagcctgggcaacatagggataccccgtctctacaaaaaaaatttttaaaaactaggctggcatagtggcacatgcctgtggtcacaggtacttggaaggctgagatactaggatctcttgagccaaggcggttgacgttgcaatgagccatgatcacaccactgcactccagcctgggtgacaagtgagaccctgtctcaaaaaaaaaaaaaaagtgccttcagggagggtggaggtgggggagtgaagctcccagtttagttgctcttctgcttttacatggctgaaggggaaaagaaagggaaatgttgccaaacaagcaatgcccataccatctttttcctcaacttaacccatggatctcctcacctacccgcttatccagactggaaggatatatgcatgcactcatgtgtccagacctatgtgtatgtgtgtacagcagggtgtgtgatgtctgtccaagccggttagcacagttacttagaacatggtgcctatgagactgaggtcacaggttcagtcacttgttcaggtcactgggcttctcacaaagaaaagagctcttcctttgttcatggcccatgtcccttgtgtggaggtgtcactaatgctaggggagaccaggtagaagaatagagatgacttcttataagccttccctgctactgggaaaaaaatgtgaagcacacagcctaatgatggctgctctgctgcattccacggtggagtttcgttgacatttacctccttacatctgcctaatatgcaccctaataagtataataatagtggtggtagtaatagtaataataattgccaacatttattttacatttagcaattaagtctgtgcgaggcactatactaagcactttacatgtaccaacttattttaattctcaacaaccgtatgaggtaggtaccattatttcctctatttcacagataaagagaagcacacaaattaagtaacttgctcaaactcatagcagataatggctgagccaggatttggacccagacagtctgagtttagaactcctgcttttagacctcacctaagacatagtgaaggtgtagggggcaactaccaagggagttgcagtttttcattcctgtaccttccggcatccttatgactcaaggataaaaagagatgaccaagaagtggttaataaatcaaaagattgatagtctcatgatacatggcatactcttctaactacccattttactctacccagatctatatgcaaagcgtcataattcttgagtccaaaaggtccatagaaactttctcttcaaaatgcaaatcaaaaccgcaatgagataccatctcacaccagtcagaatggctattattaaaaaatcaaaaaataacaggtactggtaaggctgtatagaaaaaggaacacttatacactgttggtggaaatgtgaattagttcagctggaaacagtttggagtttgttgttgttgttgttttgagacagcatctcactgtcacccaggctggagtgcagtggcacgatcttcgctcattgcagccttgacctcccagactcaagggatcttcccacctcggtctcccaagttgctgggactacaggtgcacatgaccacacccagctaatttttgtattttttgtagagatggggtttcttcatgttgcccaggctgatctcgaactcttggactcaagccattggccctccttggcctcccaaagtgctgggattacaggcgtgtgccactgcacccagtctcagtttggagatttctcaaagaatttaaaacagaactaccgtttgacccagcaatcaatcccattactgggtacatagccaaaggaaaacaaatcattctaccaaaaatgacacatgcttgtatatgttcattgcagcactatttatagtagcaaagacatggaatcaacctaggtgctcattgatggtggatcagataaaccaaatgtggtagatatacaccatgaaatattatgcagtcataaaaagaatgaaattatgtcctttacagcaacgtggatacaacatggatgcagccagagaccattatcctaagcgaattaacaaacagaaaaccaaataccacatgttctcactttcaagtgagagctaaacattgacatacatggacataaagatgggaaaaatagacactggagactaccagatggggaagggtgggaaggggatgacagtttacaaactacccatcaggtaccatactcactagctgggtgacaggatcatcgtacaccaaacctcagcaacatgaaatttacccatgtaacaaacctgtacatgtacaccggaacctaaaataaaagttgaaaaagaaactgtctcttcttagttgtttagccctgaataagtcacataactttctgggcttcagtattcttatctacaaaataagacatacagtatctactttaataagaaaatgaagggtcaaatcaaagtgtgagtatgtgaaagatctttgtaaattatgaagtggttgttattattattatccttttccagcctctaaaaacagagtccctatccatttctctaaatgttgctctaagtatttcctccccatctcccaccttcccactccatcttttccatctccccactgtgttcttctgcaatttgacccctgtgtcctgtagctaaatactagctgtgttttctttgttcctcagttctctgagagcccagggagaggaggggccagatcctaggtcatatacattcaaggaagcaaggcatgttgaaatatttacagcacttggcaggagctcacaaacctccctacaagtcaaggactgagtttttttagtaggagttgctacgggttgggggcagatggtggggtggagttagggtgtcacttcctcccgagggtctctcacagagcctctgttctcctgcaggtaacgaagaataaggaaagggatatttagggtcagaaggtctgggctaggggacatcaagcatagaaggagctttgctcctttgtattcagctttggagtgggccagtttccttgtgttctgaacaggatagctccagaaaacagaggccacaggattgtggccttcacaaagaaggattgccaaagcggttttgattaagcatttcaatggccactaagggagttttcattaagacaagctagtaggcaaatcagaacaaaaatgttttgcttttttgttgcaaacaacaaaacaaaattcctaaacccttctttaagactaagatttcaaatatactagggctcaccatattgattttcagtaatttaaatgccttctgatctggaaggcattttggaaatcacacagtcttactccctctggttcccatcttaaggtgaaaaactgagacctggaaagatgtgactttaatcagcattgtgagtagatgcttatagtagagcttggtttgtcagaggactggggaataagcggtaggctgctgtcgcattaggtgttccccagctcaatcactggcattcttctcccctttctctctccctgaacttttcaaagtcaatccccaggccctactttgtgaaaagagatggagacaaaattcaaaaggtatgatggtgaaaagtctctttcccactcctatctcccagccaccctgtttccctccctaaaggccaccagtgttatctggtgtgtcccttcagagatactctgtatatgtacaagcaattgtgtgtgtgcacatgtgtgtgtgtataccctacccttaacactttcaacttttactgtagattaaagagcacacaggccaggcatggtggctcacacctgtaatcccagcactttgagaggccgaagtgggtggatcacttgaggtcaggagttcaagaccagcctggccaaaatggtgaaatcccgtctctaccaaaaatataaaaattagctgggcgcagtggtgtgcacctgtaatcctagctacttgggaggctgaggcaggagaattgcttgaacccaggaagcagaggctgcagtgagccaagattgtgccactgcactccagccttggcaacacagtgagactctgtctcaaaaaaaaaaaaaaaagtacccgtgcagatttcttacgtgggtaaattatgtggcgctgaggcttggggtcttaatgatcctatcacccaagccataagcatagtacccaacaagtggtccttcagcccatgcacccctccctcccctgtctaagtgatccccaatgtcgattgttcccatctttatgatcatgtgtattcaatgtttagctcccacttataggaacatgtggtatgccctacttgtaaagtacaaattgtaggctaccatccaccttatcctccactttgcttttcatacttcgaactatatcttggtacattaagttcataaagtcttcattttttttaaatgattgcaccatattccattttatggccatatcacaatctatttaatcaacaccttacattcatactgctactaacctttgactatggggctttagtgtcaaacagtgctagattcagattactttccacatgacttgccttgacaaagttttaaaacttcttggagtctgagttttctcatacataaaataagtataataataccatctgttattgctggtgtggagattaaatgagatgaggcatgtaaaacatctagcatacagcctggcacgtactaagtgttcactaagtgtttgtgctctccctgctcaccagccctccctataccttccacctccaattcaattaatattggttgaattcaagtcaataggtctttgacctatgttagactggaccttggatgcaccagagaaggaaaagggtccctcaagaagtgtatgattcccttgagaagacataacacaccaaacaactacagttgtgctaagtagttaaaaaaaaagtgtgtatattacattgaatgcaattttcatgtggtgatgtagaaaaagagaaatgattgtgagggcaggaggaatcaaggccctgatagaattggaatttgaaatagggtttagctaagtggagaattgggcagtggcagagtgggggcagagaaatggacagttgggctgttgcttggattctgggtctttgccctctggcagcctagtgagtcactgttccccattaggccttacccagcaggtggggtggaggggcaggaggagaggaaaatactgaggacatttggggaaaaggacacggggagggggaatgtttgggcactgggccacagaatgaggtgcctacagatggtttgtggcacagcctactcagcccccaccacctgctcttccatgtcagccacccaagtgcatttctaagaggtccaaggaaaagaagagcataagtagcagcagctctcaacccctcactctgtgtcccaaacaggtcctcagatcccataagccctaggagagggaagaatattgaatgataaaaattccctgtgtgtgtgggcattgtagtttacatcttagtttgtttttttttttttttttgagatggagtcttgctctgtcgcccaggctggagtgcagtggcgcgatctcggcttctcggctcactgcaacctccgcctcccaggttcaagcgattctcctgccccagcctcccaagtagctgggattacaggcacatgccaccatgcccagctaatttttgtatttttttttttttagtagagacggggtttcaccatgttggtcaggctggtcttgaactcctgaccttgtgatccgcctgcctcggcctcccaaagtactggaattacaggtgtgagccactgcgcccagccctacatcttagtttacattgacacttgcaacagaggcagttatgaaataaaatacccaattgaatttcatcatgtgccaatatttttggtcacatcaagtgctatgttgggagtttctggaaaatgaaaagtcaacgtggtttgtgttacttagggaaaaggtcactgcagtgaaggactgtatagagattcatattcccactttacagttgcagaaaatggacagcattttcattgagggcaagtgagtgccctgaggtaatacatttaatatttagcagattaagcccaggagtttgaggctgcagtgagttttaatgatgccactgcaacctagcctggacaaaagagcaagatcccatctcttatatatatgtatatgcatatatatatatgcatatatatatgtatatatatatatatattttttttttttttagtggatctgggactacaactgaggcctcccaattccatgttctatgggggaagaaatgtagaagctacctgaaaggtggaataaaaattttcctaaacttagtagcagcttaaagtttaagtgtatgggtaagaagcagtatagtatgatgaaacaaagaactgagagtctaaaagttcaggggctcatgaaaggaaggatctggacataaataatgcctgctggctgggatcaagaaagagcactggactaagagtcaggagacctgggttctggttctggctctgttactggctgtctttctgaccctgccaagtcccttcccctttctcaacttcaaatttctccacttatgcattgagaaagttgaacttcccagagacttagtgacacttagaaccaatggtatctgtaaaccaaggaggctttgggaacttcctgacaaggggctgagggtgatggagagtggtgaggttgtgagtggaagagaacttctctgatgaaaatggaaaacagatcctctcaaatttgagcaaaggtgagttttggaaagggtatctacctcatagtctctatcctatatccttggagaattctatccaagagaggggaaaaaggaagagtgtgtacgtgtgtgtgtgtgtgtgtgcgcatgcgtgcaagtgagcaagaatttcaatgcgaagctaatgtttggtgggacagattgtaatatgctgagtcaatatctctggaaatctctttaataatctccactttaagatcacttttctaagacgttggttttacttttaaaaaggggtttgtgtcttatgggtaagatactattgaaagtccccctttcatggagcccacttgagtgagccacactgtctggattaatcctggctccaccattcactagctgtttattgtggtaaggcacttaaactctctgtgcctctatttcctcatttgtaacaggaagatagcaagagtacttaccacgtagggttgttaaatgagttgatatctatgtctatatatgtatctctagctagctagcttagaacagtgcctggcatatgcaaagtactatgtaaatgtttcctattcttattatctactgagtagactacagctcatgcatctatacagctgggtttcagagagcaaatatgacccccaagtgagcccaaaggagctcagtattacccagtcagaaatttagggagttaggggtttcttatcaaggtaccttctaggctgttctgatgttggccacacctaggaccagattaagacctttagaggttctaaatactggtttactgatggccaaattctgaaataattaaatctatgtttttctcatttgatggtggtcctgcttcactggtgccctaagctcatgctcatccatctattggataatcctgtactggccacgccagcctgtatgctcctccctatgctctggagggaaccaatgactaagaggggtctacacattcacaaagaacagttttgaacccaagctgctccatccacagcggggtgccccgtgtcccagcttctgagagcttaacctgccaagcctcgtgacctccttgccggttgggacctcccatcctgttacttggaaggatggtttatcttctggggccaggggaagagaaggacaaatgcctggaagtccaaataaggccccctgcaggaagctctaaacattagcaagttaaagttctagtgacaagttcagatgactgagcatggtcatgatacggaagaggaatgtgtgaggctcttttgcctccacatgacgaggagatcaagctccttccctgaaccctaacttgttcaaggacttcagttcagtgttcccggaaaacttggagtcactatcagtatcttcattaccctacacatcttggccaggttctaaccatccaaatggtgaacagcacagttttatgttccaagagccagtgttttttgccttaccctagatattttgcctatggaaaaactagccaaaagcaaggtttccttagatctggccaaacagctgcagggacctggtggcctggataacggaggtcagcaggactccagacaggtttatttgctgccttcctcacagaatatctcaaacatggaaagctcaggtgaaaccggtcagaccagatgttgagaaactgcagcttttaggaagagaagacagatagatccacaggcagcaagaagagagaatagggaggtaaaaaacctattgttccagctcctaatcacaggacccccaccctcatcacacacctatgggctccagcatatcacttgctcaagaaggcaatggctcatctgtgtcccatgagtggatctgcttattatctccacgtaagaccacccaacctaaaggctactttccaggccatagctcaacagagactaacatttgccttgaggctctctttttaaaaatggaatctgtttttagcactaaaggaaaagatagccttggagtgggaagtcacaaagaagaccccaaagttcaactctcctttgcctcacttttccacatgctttgtagtatagggtaaggcacaggatcttataacagacagaccagtgttagagtcctggatttgccatttacctgatctgcaatcttgaccaagtctgagcttcactccctatctgtaaaaaaggggcagtgggagcatcataatccctacctcacagtcttacgataaggttcaaatgaaaagatggatgtgaaagccctttgaaaacagctttgcattatcatcatgattaccacatacataagtttatctatagacttgcacatgtgcttatgcacgtatagccagattgatataccacccatgatgcacacgtgtataagcaaccacttatatgtacaaaactacacatacatctgatcttaagcctgaactcatgacacagacaattaaaagtgcatacacatacacatttatccacatggatatactttctccttctctcacacacgtacacccacacaagcaaatgtatatgtatctctgtaagtgtgtgcatgcatatgtgtgtacatctatagcctcatagctgtacaggtgagcataccatacccttcagtttctgcctagataatccagttttccgggggtctgacaaaggccctgtttgtaaattcctccacttgatactgataatgtcccttttgcccttgctgaggcttcttctctgtctccaccttgtttgcagagtagcacagctgctgcaaaaattcaagctgcagtatgtgacatacacatgtctggagaacatggatccttgtccagttgctctttgaatagcactacgactctagcctgcacagcatatttatagccatgtttgcaaagagctgacagcattttcagacttttttcaaaacgtagttaatccagccacaaaaatagtcactggcccatatgccccaaagctaaaagaaattgggcagcgtgcctaatgaaaattagtcacagagcctaaatgaagttgaagttgaatcaaactctctctctccctctcattctctctctctctctggcttgctcaactctttctttctttctttctttctttctttttctttctttctttctttcttccttccttcctttctctctctctctctttctttctttctttcttctctctttctctctcccttccttcctccctcccttccttccttccttcctttcttcctttctttcttttttttttgagacagggcctcactctgttgcccaggctggagtgcagaggtgtgatcatggttcactgcagccttgatcacctgggctcaggtgattcttccacctcagcctccttgtgtagctgggactacagacatgcaccaccaggcccggctaattttttttttttttttttgtagagatgaggtctcactggtctcaaactcttaggctcaagtgatcctcctgcctcaacctcccaaagtgttgggattacaggtgtcacccaccacacccagcctcactcttgcgctttctctctctctcttttcccttcctgccctctctttgccactgctttttattctaaggatctctaagcctagggtatgtgtggtgggggagtggggggtggtaccatgaagtatatttgcttcaaagaggtcctggggtcattagagcctaaggttttggagagacagggaggaggaagagggaaagaagagggaaaagtgagggtattgaggtttataagcaagaggaacatagttggggaattaaatgaggtgagacaaaaaggagaaaagttacgcccactttgaggccaactagaattttggtggctggataacttctcaaatcaaatggcagagtccttcagcctcccctcaatcactagaatgtaggctagaaaattgttttgcttatttgcaaggttggaacaaaaaagaattcctagtgatagagttgaagagttaagcatggttagaggagagcaagatggtttctcaggaagagagaggcctgggctttatgtaatgggctcatcttaggtggcccagccatgaccagggtgaggagggttttagagagggagtagggttatcatatcatttattgtccaaattgggacacttttgagggtgaaagagaactctattaacatttttgttggaaccacaggcataaactagaattgtcccaggaaaaccaagatgtgtgttcattgtaagtttagaacaaatcgctccagcttgccgggaaagggcaaactataagggctcctcacaagatgtctttaaaaaaggtgtgtatgtgttctgttttgtttgtgtgtgtgtatgtgtgtgtgtgttggtttgggcagtagagagtagggcagggagattattcagccttttcagccttgggactggagattgtttactctgaatataaattcctttttttttttttttttttttgctgctgtacataaatatgtaatggagctcttagccaagcgtgtttatttcctggtcaacttcagaagagaagagagagagagtcaattgtggtgtgtggttttgtgtattgtgtgtatgtgtttgtgtcaaagctgtggaaagtatgtatgtgtgtgagtggaattttaagtatatccaactgtgtgtaactatgggcatgcatgtaggtgtggatgtgtgtggacgtgaacacggatgtggtaagaataaatgagggtgtgtgtgtgtgtgtgtgtgcacgcgcatgcatgagcatggatagggtagagtcaggtctgacctctggttcactgagttgtgaactccttaactttcaaggagcaatcacatagacgaccactttattttacacgtgaggaaaaaggcatgtgtaacgagacctacacactttgttttttgtgagagggagtctgtctctgtcgcccaggctggagtgcagtggcgccatctcggctcactgcaagctccgcctcctggatttttttttttttagacggagtctgtctctgtcgcccaggctagagtgcagtgacacgatctcggctcacggcaagctccgcctccccggttcacgccattctcctgcctcagcctcccgaatagctgggattacaggcgtccaccaccatgcccagctaatttttgtatttttagtagagacggggtttcaccatgttggccaggctggtctcgaactcctgacctcaaggtaatccacctgccttggcctcccaaagtgctgggaatacaggcatgagccaccgcaccaggcagagacctacacacttttacaatttgcttggcagtgattgagagtatactagcagcagtcacaataatcctgattgggaaccagctgctaatccatgcattggaataaaagcccagtatttatttaaggtttctgcaaacaatgggtgcttgtcaaggtgggttgagggagctgcctaagagtaagcttgaggtgtctgtaggcctagacttgagcagaaggagatttgacaaatggctgatccaccagacctgtctccctgaaggaccatgtccaacagtggaaactttccagggctttgaatatgttcaacttcccacctctccaaccccaccacctagagatgtggtttgccttggagacaaaccttgatctctattagagatccactagaggccttcacaggatgtaggccagacataagctgaaagtgtccccagactgggcaataagagacaggaaagcctccccctcacccccagtctctgaccttcctgtacctgcccttatcacttcaggttctggggcaggggaaatggctagagatgccccaggagtgtcaggactggctgttgaaatgggaatttgcagccgggtgccatggcttatgcctgtaatctcagcactttgggaggccgaggcgggtggatcacctgaggttgggagttgaagaccagcctgaccaacatggaggaaccccgtctctactagaaacacaaaattagccagacgtggtggcgcattcctgtaatcccagctactcgggaggctgaggcaggagaatcgcttgaacccaggaggcagaggttgccgtgagccgagatcacgccattgcactccagcctgagcaacaagactgaaactccgtctcaaaaaaaaaaaaaaaaaaaaagaaatgggaatttgtgcccccaggagaagggtgggtgtcagccattagtctcattagcgttggccgaggaattggtcatgcaagttagggtagcccattgctaatgaagctaaaatccaaaaccactgttcttttctcatctgaacaaattcatcttgcttgaacctctgtttgggctgtacccatttgtctgaccagtcacacaaaagatgagacaaaagagtgtgggatgctgcagcatagctctgagaaaacagtccaggtctcatgtcctagtgataaaccagttcaggttcagccaatatttattgagcatttactatgtacctaacatgatgttagacttttacaagtattaattatttcattgaatccttacaatagccctgtgaagtaggattagtcccattaagaccctccaagaggtccaggcgcagtggctcacgcctgtaatcccagcactttgggaggccaaggcgggtggatcatgaggtcgggaatttaagaccagcctggccaatatggtgaaagcccatctctactaaaaatacaaaaaaattagccaggcctggtggcacacgcatgtagtcccagctattcgggaggctgaggcaggagaatcacttgaacccaggaggcggaggttgcagtgagccgagattgtgccactgcactccatcctgggcaatagagggagacttcgtccaaaaaaaatgacactccaagaggtgaagtggcttgctcaaagtaaaacagctaggagtggggaagtgagaattcagtcttaactctgcttgacaaaaagaaattattgagaacctactgcatgctagacattatgctaaaatgtttccatgggttatctcacttaggcctcaaaatagctttatgaggggatattcctcccttttttttcacacattagagtattgaggaacagaaatgttaagtgactcatccaaggtcaagtgctagtattcacagtagatccaggattcaactacagacctgtgactctcaagccgagggtcatctcttccctgctcctctgtggatatctgattccatatctagatgattcctaaggccccttccagctttgacattccagaggtcagcaactctatggtaatccttccccatgaactcgagcagcctcgggtcccttggctgtaatctgccattctctcctccccactaggctctctccatgtgtggtgcagaaaaagagtgggtgagtgacccccagtcagctcgggctgagttggcccggggctctgactcagctgcctcactcctggctccaggtctcaggtgaggtactttctgtaacagtatccagaaggtgctctgggttctaggcctgggccctgtaactctccgcctcctgagaaaaacaggaaatatctctttaaattggcaaataagaaattcctgcaaaatgggctcagggaagccactccattccttgtgtgattgtgcctgtgtttgtgtgcgtccttctctgagtgcatgatacagctaggaggagttgcagacagaggctaaccttgattctgcattgtccacagccttcctgggtgggctgagatgaatatttccttccctgcccgccccatcataccttttcctcttggaagctgctgatggattttctatccccttctgcatcttgagcagaagaggaaggcagtttggctcacagagtaatattatccacagtctggtaccaggtgtgtatgtgtgtgcatgtgtgtctgggggcaggggcaggaggaggtggtggtattaggctggctccagcagagcactgctcagggtctggaataagctaagttgcttgtggaggcaacatctgagggaaaggagtttccctgggagacccctgagtagcacttagaaaattaatatggggaaggggctgtggttcagatacaaaaaccactcattcttcatcttctcttatcctcatgctctctgtattccctctccatactgcctccctcttcaatcctggctgtcctggcaccatatcctgcccctgactcctctacccttgttatttgttacaggggaaggagcatgccacaaggaatccgaaagcttgggttctaccactatctgcaaattttaccaatatctccctccctcttcaatcctggctgtcctggcaccatattctgcccctgactcatttacccttgttatttgttacaggggaagcagcatgccacaaggaatccgaaagcttgggttctaccactatctgcaaattttaccactatctccctccctccctgactttgggaaaggtgctttactgccctgaacctcagttccctcatttgtaaagaccagcctgttttttaaagtttgacacagggttaaatgggaaaaatatatggaaaaaacatctaggagatttctgttgcttgttttgaagatcaaatgagagaatgacctggaaatacttggcgagccctaaagtactgttcaaaaaggaggagttgttattgttaatattccctgctgcctgactgcccttccatatacacaataatgcaaatttgcccagcctagcttatatcctgtccacctccactgtttgctgtaaagacgaggtgatcatctgcttctgtaatgtctatgtccatgacagggaatcacacaggattctcacagggtcctctttcctcttccatggacaaatgtagctgggcttttctgcacagaaagaccttgtcatcacacccacaggagcggtgacaacctcaaatcaatgcaaaccataagagagatctatttgggaagttgcagcttgtctctggatattattattagcccattattgcagataaggaaattgagacgcagagaagtgaagtaaagggcacataaataataagtggcaagttctaagttgcgtgtgtgtgtgtgtgcttgcacatgtgtgcatgcattgaggtgggtaggaagtttttctggaagcatatgagaggcaagggatctggattcgctattaagataaccatcagtctccacgaatcaaataaaaccaggcagcaagcctaataaaaattaagcaatggatcaaaaagatactgactgtgcactacctttctgcctccttctctattcggcttgtgttcctgcaagaagacttatttcatttcactatatatagcacattttgctagatgctatgataggagagggtcaaggggagatagagaacgatgtctcatgtctgtatgtcttatgtctgtatgagcagacatacatacactcatgccatacttgaatcaaggtagaccatgacagatctaccttgattataaaccactatatctctccttatgaagcattatactcaattgttagctcttactgttagagctaacaattgagtataatgcttcataaggagagacatagtgattctagcacctaacacaatgcactatacatagtcagtgcttgataactttgtattgaaatgaaatgagggccaggagtgggagaacatgagcttgttttggggaaggcattgtgggcaagaggggccaagtggttcatgcctctcactccaggcatgctgggcaaagccaggatccactgctgacttctcaggccttatttgcaaggctgctttaaaggtgctttgtgtttgggtttgttttctgacatcattgttcttagcaaccaaggtcagatttttagcttttcctttgactgctaaccatgcccctctgcctaagaaatcccacaggaagcctccaagcttcactttgcctctagacacctggcaaatgactctcccacttccttgccctgtccacagactctgatgctagttgcgggtgccaagatttttttgccccctcctcttcccctgggaccaatcagatttctgagctccagggtagagccacactctcactgatcctctgtccaagtctagaattcccaaagcatggtctgcctcatctgtgctccaggtgcaactgggcaggataaatttctcacacattggtcctgtccttccctgggaagcctggctttcccactcccacttacctaagtcaattctctgctttaaggctgggcgcggttgctcacatgtgtaatcctaggactttgggaagctgagggttgagcccagtagtttgagaccagcctgggcaacatggcgaaaccccatctctgcaaaaaaatacaaaaattagccaggtgtggtggcacacgcctgtagttccacctacttaggaggctgaggtggaaagatctcttgagctgggagattgaggctgcagtgagccatgatcataccactgcactctagcctgggtgacagagtaagaccctgtttcaaaacaaacaaacaaacaaacaaacaaaacaaccaaacaaacaaaccaaaattctctgctttattccccttcatgagaaaagctggcaaggtgaacagactcctctcttgctagcccactgccatctttggataggtcaggcagatagaatcctgagttccagtagattctgccacataattatccagggttcaataatttaagcttacctacctcttatgcaaagaccagagtactgatgaggtaaacttgcagcagaagaaaattaagccaaaagaaagaacttctcaacttaggattctaaagcactgtgacagatacagttctccctaagcctttaggttcaacctcctgcctccagccatgccagacagatgaaggtctctattttcttactgtgggaagttcagattttggcctaaggcctgggtgaaggtgaggatgacagaatgacggagttacttgtttgcaacagagaatgcattcctccccaccctgtcctgccccaacatgtaattgaatatctttccttttgccacccctcaataggcttttgcccttctcttcctaaataaggttattaagttattgacttattcaaataaaagtttgtccaatattcaagagacattaagtatgttctttgggtctgaacacatggtcaatttcaatctttgtgagttttcacagaggcccactaactccctgtgtgaaaaaagtacccagacgtaagtcatatgaagggagttgcatgataaaaagctttctgggggcctggtgtagtggttcatacccgtaatcccaacactttgggaggctgaggtgggaggatcacttgaggccaggagttcaagaccagcctggacaatatagcgagaccctgtctctacaaaaaaatttaaaaagtagccaggcatggtggctcgcacactgtagtcctagctactcaggaggctggggtgagaggatcacttgagcccaggaattcaaggttgtagtgagctatgaactcaccactgcactccagcctgggcaacagagtgagaacctgtttctatgtatttaaaaaaaaaaaaaggccgagcacagtggctcatgcctgcaatcccagcactctggaaagctgaggcgggtggatttcttgaggccagaagttcaagaacaccctagtcaacagtcaacatgacaaaaccccgtctctactaaaaatgcaaaaattagccagacatgatggtgcatgcctgtaattccagctacttagaaggctgaggtgggagaatcacttgaacctgggaggcggaggttgcagtgagctgagatccctccactgcactccagcctgggcgacagagtgagactctgtctcaaacaagcaaacaaaaacacaaaaaaaccttttggacagtgacagtgacattgttatgataaagtacttggtccaaacctgccatacagggctagaaagttctcagcagtcatccatcccaacggttcccaaccctagctgactatcaaaatcatgtaaggagtatgttgaacatataccttccctggggctcatgaaacctactgaatcagaatttctgaggtaaggccccaaagtctgtattttaaacaatcttatcaggtgattctcataataggacaggtttgggaactatttgtctggttgaatcctttggatttttttttttttttttttttttttggatgaggaaaccaggctcagaggggcaggagcctacagcaaagtggccagatgggaaagtaagggcagagcatgtctgccttgcttctcatcatctcctctttgcatagaacacctaatattatgttctctcaccctttctgatcaattacttgtccttccatgtctctagaactgtgagtactttgatggtaggaccatgtcagatccatctctgaggtctccaagtccttgagcttgatccttaaagctaggctcccaacttactaggcaggtatacattcttagaccctatgcctctgtttccagggaccatgggttggggcaggagttggtgtcccccttccttcaaaaagcaaggcaggctgcaaagtttgaagtatgtgaaatatggaggccagttcttgtgccgagggagctggaatgtccagtggcaccaggttacctgaagcttgggctggggctgagtgttgatctcaggggaatttgggcgtcattcccattactatcactgacagcagccttacgtgcagcgataatgacatgctttgaaaaatgcctcaaatgtcagttacccagcattgagacagcccctgagagttgttccttcatgcccgcatctttagctgtgcttatcactctcatagcactgtgtttcaccctgcccaattgtgcagggctgtctggggccttggtcttctgttcttggagccaggataggaagtagaataaaaagatggctgtggaaggcaaggcaggactaaccattcagtagtttgcatttttgtgcgttaagatgagctcgtgccaaactggggagggaagtatgaatgaagcacagactgtcattagacctgggttctaaccttaccactgtcatgttcatttgctgtgtgactgtggactaggcccttactcctctaagcctccatttctgcacctgtgcaatgagtagcttggactcacaacctttctgttctaattgagtgatgctaatttaagagccaagctggagggtcaggggtgggtatctaatgagtgatgctcattccctgccttcattcatcgcatatcttgagtccactcttggaaaacatatgttgttagccccaaaggctcaagatataacctccaaagtaacttgcataatatatttgcaccctgctgtgttggctttgtgctgataacatctcaacacagcctggatccactgtactctggttatgtcaacttctcaaaggcagtcagatgcaattgaagactgcttttcccactggatgtgggtgcctgacaatgtaactaactctgtttttcagggtctcctccctggtcctctcttgttcagctctgcagcatctgtgcgacttctcagtgcattgactcctttagccacacacccctctaagtaggttacctgctggcactggctcagtgccaacaggctgtggtttctctaactgtaaaggccttgattcatcctggttgtgaggaactcttttaagtttggcagctgttttactctgggaatttctcctctgcctaacccttctcccatcaacaagcttccttcacttcttccctcccacctccctcaaaatcccctatggataatgggatgatctttgtcttgcaacagggcactatagacgaccaggatggtccatccttcctccaccactagtgacagcaacaaggctagcttggggaattttagcatcgctcaaagccatgactaataaatagataatttaagcaaaactcatgcacttgctatgctagcaagcatcaaggcaagtcctttagtcacctccttccaaccaaattgctttccctaagccctttctattgagaaattatggaccctccacccccattatatgccccagggcctagcacaagggctggctggcacataatagatgctcaataaatatttgttgaatgaataatggccgaacagatgaagactaaacatacctaaaagctaaaggaaataatgctagctgagtcaggagacctggatcagccactaatccatcttgtgaccttgagcatgttcctctctttgggtctaagtctcttcctctgtagaattttgcactgaactcagtgatcttttaggggtcttccatttctgggagttcataattctgtgatccgtactcttgtaccaaataccacttgccgccaccacccctgctctgccccgccccacccaaagaagtaaaagaaacttccatctagtcatcagatagtattgggatcatgctgatagggaaaagaatataacttggggttttggaccaagccaatatcagagaagccactgcttcccattatgccaatggggattgctgattaggtctcactcctatgacacaaaggcacaacattcaaggtcctccgctccttgcctcctctgccttgtctttgatgtcccatgagaagtatgttgaccagacaatatccccttggctctggtagtggttggagtcagtaagctgttggagatctgggagtcctggtcattgcagaacaaaattcttgtccactgttataagcacataggtcttgattttaaaagtcttatgcagccataaaaatatacacagaccaacctgcctgggattaaagggaactaggcagaaaaccagaaaaggtagagtctctcttagtgggcctttccctttttgtctctctgaattgggtttccatggggatctgtgggtaaaacacatgaactttaaacactttttaaaaaaacttaaaatgacatttaagagacctccaatattggaaatcttttattctctgattcaaaatatgtaaccagtagaaaggtggtttgtttcgtatgtgttcttttagtgtgatgagtcaggctgaagctgggattgggcaatgactatgtgagtatgtggtgaatttcagaggggaagtgctgtttgaggaaaggcaaagcatatttatcagacaaagaatgtatgaagcctaaagcatgtgtttaatactttgagaagctggttactcatacctccctcctccttgacacatacagttaggctccatgatcaaacatcagatttaggctagacaatctttgaggtttgttccagttctgatgttttttctctgactgtgtgagattattcagacttgcaagtgcacttttccaatgaatcccctgtggttactttcaatgttttattccaggcaaggaacaaatgactgtaaagtggctaaacctcagtaggcttggccataaagtgacacggaaaattgatagttagtgatgggccatgaactatgaagtagggtgaaccctttggatcctcaggacccaatagctcaaaaatagatcaagaaggaagtgtgtacatgagggaaaattgcttatagtgatgtgcctatttgcattgaaatgtcatcccttggggggtccccccacctgtcatgggacaaatgtcttatagaagaatgtgacagcaaatgtgccacactgatcagatgcttttggcatacttgaaccttcctggtgttataaataggagggaatgagcctggacttaaatatgtcatgctgtcagaaacagaagggatgtgctaccattaataaggggcttagaggatcctatagttaagagccaaagaagccctctatttcgagaagggaaaagttcaatgactgtccgctatcagagcacaatacgagctaaattactagcagtaggttggtccttgacccctttggatcatagggaaatgatgataatagagttggcaagcccccaaggcgccctccagactggacatgcatggaggctgggtcagccagtttccaccacacttccaattgccagtgtactctcttccttggagcattaccaccacactctcagcagggtggatttgggaagtggcctggaatatggcaggccttccctctcatcctgctgggaatagtcttgtccgttcccgttctaggaaagagaagcagagagatgccaaaggctcaggtacctgttgaatcagagagtgagcagtgagcaacacagaagggtgaaggcctagagcatgtggggacctcaaaggttatctagtaaaatgttttccaaaatgtccattataacccatgaaattaatttagaaggtcacaataagcattttaaaaataatatgcactagaaaatttcagagtttgtcacgcagagtagggataattagttttgtgaaatttgcttgaggtatatataaagattatatatatagttttaaatatatatcagttatatatgtgtacattttacatcacgacacatatgtgatgtatacatatacattattgcatatatagctatacacagatatataaatatacacaggtcgtccttcactgacggtcactgacatagtttcaattgtcctcagcctacagttcactctcctctggacacagtcaagttggttctaaagtatggagccccagaacctcagcagcccttcaaggtatagcctactcagagcagaggaaaacatgactatctcctcatttgttctgaccaagtacattttgaacaattcagttcaagatttccaataaggtagaatctcacaacttggtactcattgaacttacagttgcctaaaactcctaggtatctctcacacatgtcactgctaagccctagctcccttactcccttatcctactgctgtgcaggttgcttttttttttttttagacagggtctcgctctgccacccaggctggagtgcagtggtacgatcttggctcacttccgcctcctgggttcaagctattctcccgcctcagcctcccgagtagctgggattacaggtgccacgcctggctaatttttaaatttttggtagagacggggtgtcgctatgttgaccaggctggtctcgaattcctgacctcaagtgatccacccacctcagcctcccaaagtgctgagattacgggcgtgagccaacatgcctggcagcaggttgctttttaatcctagtacagaaactgtcatttatctttgttagagtttacctttcaccttgactcacctttttaaaatgcatttacacatcccatccatgaccatctctatgcatatttaaatctggtttcattggctcagagggagctgcatttaaaccccacgtagctctctctcagaaggtcatatttattttttttcagactgttcctttaaaaaaactgttattttttatttatttatttatttagaaatagggtctcactatgtttcccatcttggagtgcagtggctattcataggcacaatcccattattgattagcatgggagttttgacctgctccatttctgacctgggcatgttcaccccaccttagacaacccagtggttccccactcctgggaggtcaccataatgattccaaacttagtgcagacacccagtcggcacgaggtgatcttctcgtgcttcccaagtaactgggaccacacgcgtgtgccactgtgcctggcttttaactatttttttattgatacataataattgtacatacttatggggtacttgtgatattttgatatatgcatacaatgtgtaatgatcaaatcagggtaattaggtatccatcacctcaaacatttatcatttcttcctgttggggacagaccattcctttcattgctcatctattatttttctgactaccatgatgcccctattctagccaagccagtgtcctcactgttttctttcctgtactcgagacataattctaccactgggcagactgtaaactagttcaaccattgtggaagtcagtgtggcaattcctcagggatcgagaactagaaataccatttgaccccaccatcccattactgggtatatacccaaaggattataaaacatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaatcatcattctcagcaaactatcgcaaggacaaaaaaccaaacatggcatgttctcactcataggtgggaattgaacaatgagaacacatggacacaggaaggggaacatcacacaccagggcctgttgtggggtgcggggaggggggagggatagcattaggagatatacctaatgttaaatgacgagttaatgggtgcagcacaccaacatggcacatgtatacatatatgacaaacctgcacgttgtgcacatgtaccctaaaacttaaaataaaaaaaaaaattctaccgctgggcttttgactacactaagccttcacttatgataccctctttgccataatgtctttcatggcccaacttaagtcattatatcctccatgattctttattcagtagctctagatcatattgatctatcctctgaatttgtaaatttcaactgtatttcttgtgtattgcttcacatttagttttgtataagtgtatgtattcttataaaaaatacatataaatgtcttattatctgcattgttggtgcatggctgactcacacaagtgggcactctaaagccagaatgcctgggttcaaattcagatgtacaattctataatttagtagttgcatgtacttgtgcaaattacttaatctctgtatgtctcagtttcttcaaaatcaggataacatagtatgtgttgcataggtttgcttagtgtttaaatgaattgatatatctgaagtacttgaaacagtccctgacacatataaacactcaataaatattaactataattatgattaaatactatacgctttcatatattttatctcggggaaagttagagcagggattgtcatccctgttttatggatgagtaactaaagtttgaaaggttaagtgacagtgtaagattatataagtgagctgtctcagggtcattaggggattaactataaagtagaaaatactaaaggccataagagagggaagcaaaagacccttaggaatttagaagctcttctggctggggtgggtaggaaaggcttgctgatgtccatgaagaagcaatgaagaatgtgcaggatagggtcagccttggtaagtgtccatccagccattttaggcagagagggctcaagtggagtaaggggtagtggaggaggtagggtgtggctcctcctacattttgcttccggtatagagggcatggtcagaggccagaggagaaaaaaatctgaagaggagacatctgggcatggcagccatgtggggagcagtcagtagtagttctgtggtatgtgcaggagtatagtgtgtgggagagagaggagagcctgcagtggcaagacaaggctttggacctgtgttccaaaatacctattcacaaagtccatgaatatttggctactgctctgggcccttagaatccttgattgattagctcaggcaactttatcagattaaccagctgacctctttgaatggcacccactgttcactcagttgtgttaggctgtggggaactgaagagaaggaagaagcaaggtctctttcccaaggaagtcccagtctaggtaattgactatagttgattatgtgtgagttatggttgttgcacgaataaattattatttcatggattgtgttctaattcataagtagggctatcagggagagacaagaagtagataaagaaactgccaggtggcaggagggcactggctggggaaaagaaagtgcagagaagggaggctaagagttggattgaaggtgggagaagacattttgcttccttgcgattgggcagctagccattcttaaagtccagtgtgtgggccaagattcttggccaggcccgagcttggaaaatggtgaattgaaatatgagtttccatgtacctttctaccttagttccctgggtcttcatctgcccaggggagataaaaagaatgaataagagagcagttgaggtgatttcaactccatgggatgctgctacagacacacttgagctgtcattattatgggatgggaaaactggatgtaaattaagattattatcacctgtgcaacgacaacaacaacaacaacaaccactactactactactaagaataataataaactcatgtgatgctgccagcattctaaagagcctacctttgggtactgcccctgcttcatgggctcaaaattgaggagaaactgaagactgtttgcatgcctttcaatcttggatctgcatagacaattccttaggaccagcccttgctagtgagctgggttagaaatgctctttgcactcccctgctagccaagccttgtctgtgcaaagccaccgggtcccttctgtccggtaaatttctagaatgttaaagtacttggaaggacccttacaggccatcaagtctgactcctttgttatactgatagagacatgagggttcagagagaaacagggacgtgactagggtcacacagtaatgcagtggcagaaatggccctaatccagctggccctcccagctgataggccagtgtgcactttccatagtatccatctctctctacttcctatccttctatctccaccaatttcagtcacttgagttgttactggtatttctcagccccagtagcccatcaaaatcctctggggagcttaaaaaaatactgatgtcctggccccaccccagaccaaccgaatcgttgtctctgaggaatggagtgattttttttattatactttaagttctagggtacatgtgcacaatgtgcaggtttgttacatatgtatacatgtccatcaatgatggagtgatatttttaaaagctctctaggtgattctaatgtacagtcaagatcaaggatcactgctcaggagaaaattagcctcatgtctatgaggagacctaaaggacagactcccagtgaagcagacttcccagcctccattgactttgggccactctgcacctcagtaggtccccaaaccctggtatgtggaggacgtaggattctgaaagtatgaatttcagggtcaccaatgctgtccttgagctccattgaccctcttgtcattgcctttcccctcatgctagatcagaagtattttatttccagactttttactttttctttacccatcacgaaggcctctgaggagactgcctgcctccagtaggcacaaacaatttgtcccagcttctgactttttggggagacacacacacacaaggaatgtctcttctttggctccttccgaggggcttgtactgagtatctagaaccacccgccagcctccattccatctacttgccattcccacacatagagcttgcttcccaagaaccagactttgagggacagccagcacaaagcagagagaagggaggcactgggcaccgggacccctaatgctgttcagcattttgcctcttgtcttgctggctatgggcccatagttaatttataaacttgacttgcccagggataagtaagtacagatgtgtatctttttccacaccaccagtggtctttcttttttcagaaaataggattcactgaaatattccacaaaactaaacattagtgatactaaagaaacaaaacatcctcttcaacacattacataaacctgccctcaaataatcaggctagaagggattatcaataatgtttggcaatatatagtcactttgcttttttaagtggcctccccctcatcctagctttattggagcataattgacaattaaaattgtatatatttaagttatacaatgtgatgattttatatacatatacagtctgaaatttaccacaaccaagttaattaacacatccatcacctcaaatagttagtattgttttggtgtggcgtaaacacttaagatttactttttctttttgagtcagagtttcgctcttgttgcccaggctggagtgcaatggcgtgatctcagttcactgcaacctccacctccttggttcaagcgattctcctgcctcagcctcccgagtacctgggattacaggcatgcaccaccacacctggctaattttgtatttttagtagagacggggtttctccatgttggtcaggctggtcttgaactcccgacctcaggtgatccacccgcctctgcctcccaaagtgctgggattacaggcatgagccaccgtgcctggcaagatttacacttaacaaatttcaagtacataatatactgctattaactacagtcaccatgctgtacattagatctccagaacttgtttcataactgaaattttgtaccctttatccaatatttccccattccccacaaccaccagccttcagtaaccaccattctaaactctgcttctatgagttcaactttgttagattttacacataagtgagatcatacagtatttgtggtcgtttgatgccctcccttggtaagatttttaatcttccctctacctctttccatctatgactcagtgttcaggaatttgcttgttaaatctcctggattggtgttgtgtgggctttaaaatgtaaaatcaaagttagagcaataaagaaatccctttgggccagtgttgtgaaagaataacttattctattcagtgcagtgggtggtggatggactagagtgcccagaaagcccagctggatccccttaagccagttatagacctctgctctggcgtttacctgtaactgagccatgactccgatcttgatcaaccatgttatttagcagggtgtggtggtcctcagcatatatatatatatatctcacaagtgttcactgcctcctatcaaggctagaaggtgagcggtatcctgggaagaagaggctgaggccagtgcccccccaggggctggagttgagttgaagtcatggctgtcagcagatagaaatgtcaactagtggtggcctccagtggaaacatcttgcagggagagactgtaccccagccagtccctggagttttggaagacaaaacactcactgaaggacagagtttgagttccccctccccactggggctctgccacttagaactgtgtgactgtgggcaagtggcttagatacattctgttttctcagtcatcaagcaggtatacttaatacctatcagtgcagttgtgtgtagtaatgcaggttaagtatataaaggggaggtgctcaagaaatgttagtttcccaacctttccctctcctatcctagtcccaatagtcacacccactgttggaagaaaacaattgcatctgacactctctccaactcctacctcacctccttggccattctccagactcgggtgattaagaagatagaaaagataaggaatgtctggagcacataagggtccatacattcagggtaactgcaagggcttctggagtataatgactttggtcaacaactagcatgggtggcatgagcatgttagcccataacagaacaagtactgggatgtcagggccgtggaaggaaagagccaagactcaaggtggtctgacttcaatgcatcaagcagaggcttgctggtccctgtcctcttctgttctgctttttaaagactaaaggtccctgtgggtatggagaaagcagctgcatctgagaaaataagtaatacagtagaagctaaagatggagttctgtggcacccatgagaatgttcctggaagacttccaactacggggagcataattgaccaagggtcttggctgctgcactctgaaatcgtcccagcatttgtgctgaggtcacacctgctacatggccaagatactaaggtgggcctgttcttgggagacacagaaatcctctgattgccaactgaccaccaactgaccttggtttcatgaatccatgatggtgttgccaaaccttccttagagtgcagggcagactaggaagcttccacccaaccttccctcatcctctctttcactcagggtcagacttacattgcagtctcacgtcttccctagctttctcagacttcctccctatctgctgtcatttctcttaataaatccctgcatatgcaatcccattttattgcctacttctctgaggtcccagactaacacaaattctgaccaacatgaaatcaaatgtattggcctagagcctggcctgtacccagggtctagccttgggccacttttagaaaacattcagcaggttttttgtttgttttttgagacggagtcttgctctgtcgcccaggctggagtgcagtggtgcgatctcggctcactgcaagctccacctcccaggttcatgccattctcctgcctcagcctcctgagtagctgggactacaggcgcccaccaccaagcccagctagttcttttgtatttttagtagaaatggggtttcaccgtgttagccaggatggtcttgatctcctgacctcgtgatccacctgcctcggcctcccaaagtgctaggattacaggtgtgagccactgtgcccggccaacattcagcaggtttctaaacattggagaagtatccctaaagtttgaaaagacttcgggagtgatataaatttattgccctgctttactctgaatgaatatctcagacaaataagtttcttttatttaatgttccaactcagtgtcttatatgccttcttatggaagatgtttctttaatctaactatagtatttcccaggaagctctcattttctcctgtcctccattttggactgagagtcagagaaatctagctccaggtttgccagtgacaaacagtgtcatattggacaagtccttgtactctctgtaaccttctctttctgaacctcagctcttattttttgtgactaccactttttctgtttcctcagttccattcctcagaaccagtgttcaagttctcctaaaagatattggtgtgttagaaaaggagagaaagggagagagagagagtgtgtgtgtgtgtgtgtgtgtgcacgcgtgcatgtgtgtctgtctgtgaaaaagagggaaagagggagagggagaggaagaattggagagaaggagagaagcagagggagagagagggtgaaagaaagacatctctgtgcagcttatttccagctctgcttggcggttccctcacacgcagtgctaggcaacacacatggtgacctacttttgcaagaaggctctattttggagttacagtcttctttaccttcctcctttgcctgggatggctctgccactaaacagcagatacagatgtaaggaacagaggattggtggctctggtatcattaccaaattttaaaaattgtaaggatgaaaggcattccagctcttagctttgtgttaccagaaaccactccagagatttgaaactgaatcacttacaactcctcctaggaggaattcaggcttaatcccatctccatccccatctagagaggccaggatgctttgtcccaagcccctgaatccctcaaatctgaccctgtcccctgctgtggccaccactctctcctatttcattggagtgtctcctcctgagcctttcagcccagtccaggccagctccttaatagctgccccttcccgtgaactccctcttcctgcctcctcttccctccagtggcagaaaccccacctctgttggcccagtgtctttgaagagagtcctgagatgcccctcggagtttgggtagagcccttgcaggcatccagagaacaactggaatcaaggccctttgtgctttctggttcccaagcgcctttggggcttgaggttctcttcattagtggtggatctgaagtgtttgtttctcgagtagcctgactgctagtgtttcacccagagtttttggttatagtttggtgtttgtttgtttgtttttgagatggagtctcgccctgtcacccaggctggagtgcaatggcatgatcatgtctcactgcaacctccacctcctggattcaaatgattctcctgcctcagcctcccgagtagctgggattacaggcacctgccaccatgcccagctaatttttgtattttcagtagagacggggtttcaacatgttggccgggctggtcttaaactcctgacctcgtgatccgcccatctcagcctcccaaagtgctgggattacaggcgtgagccactgcacccggcaggtttggtgttcttaacccagcatctcacaacttctgtactgagccttctatggatctttgaaaaatgggcttctccagaaggtagggggaactttcacagccctgggagaccatgaccaaagggaaacatgactgaatgggacagaggagtaattgtgcttaggactagtttagcagaaattcattagggggctcaagacatctgtgaaaaaactgaagcaaaatcccataaaaatagaaggccttcagaaacactgcccacagactcaacaaagggatctggcctgagaagcccaaaacacttgggccaccaacttctgcttctttcttgtgagaccacatgcaggtctcttcatctctttgtggctcaatttacccacttataaaatgagggacctggactctatcttttaggatagtgaaaaagtagctagcctgggaaagaagagatatacacaactctagagattcttcagatttttccagggactactgcagagggagaggatggatggggacaaaagaaatgagaaaaaaaaaatcggtggagtttccagtaggctgacaagtgcctccatcacatcagagcattcctgcttttatattatttatgcaatgtacttcagtgtaaaattgcaattggaaaggaaagggggttccatggatttaggaaggttttaactttctaacttctagctgcaagtgagtctgaaaaagtaagaatgtagtttttatagcttttgtaatgatggtagaaacagagaagagggttgaaaataagaatattgagttagttcaacagcatccactatgattaatattttttgctctaaatttgattactttttagagcttattaatgcataactgatgtacaataaactgcacatatttaaagtacattatttggtcaattttttttttttgagatggagtctcactttgtcacccaggctggagtgcagtggcacgatctcggctcactgcaaactcctcctcccgggttcatgccattctcctgcctcagcctcccgagtagctgggactacaggcgcctgccaccatacccggctaatttttttgtatttttattagagacagggtttcaccgtattagccaggatggtgttgatctcctgacctcgtgatccacccgcctctgtgtcccagagtgctgggattacaggcgtgagccaccgtgcccggcctatttggtcaattttgacaaatgtgtacattcatgaaatcattgcagtaatctagataatgagcatgtacatcatcctcaaaagtttcttcatgccctgttttagttcatccctccctccaccaccatcgtctggcaactactgctctgctttctgtaactatagattaattggcatttttagaattatttatatgtggaattatacagtatttactctttttgtctagagatttttcacttagcataattattttgagattcagaataaggtgtgtatcaatattttattcctttgtattgctaaatagtattacattgtgttgataacacagtttgtcatatctaattacctgttgatgggcagttgggttgtttacagtttggggctgtcaaataaagctgttctgaacatttatgtacaagttgtttacaagtacttttaaaatttaactaatgacttccattttcaaaatgtttccagcagaaactgacttgggaaatgttgcatttgtgtgtctctttgtactcaagctattttttggcagtttttgttgttgttgatattttatatcctttgatgttattacacattgttgatcctacagttgcacctccccaagcattgtgaataggtttctgaaagcctttgtaggaagaatttcagttgaataatttaagacttgtataaggagttttcttgagggggactgagaggcaaaagcccttgtaaatattttatatttactaaaacaaaccactaaatataataccaaataaagatggtattaatttccttttaaacccactggcctagacaaaggctagagtcttcacccagctaggggagactggaagtccataagtgggcaagagacacaaccctaaaatattcagtttcagacctaggctaggtgcagtggctcatgcctgtaatcccagcactttgggaggaggctgagcggggaggatcacttgaggccaggaatttgagaccagtgtgggcaacatagcaagatctcatctctacaaaacaacaacaacaaaaaacttgaggccaggagtttgagaccagcctgggcaacatagcaagatcccatctcaataacagcaacaacaacaacaacaacaacaaacagacctattgctcctccatggagccagggaacatggcaacacagaggactcccatctccagtactaggccagcctatggccagcaaacagctgttgtttcaggaaaggggttcagagagaaattgcatggtgtgaaaaactgttaatgaaacaggatatgagatccatctcatgtcttccttccagtactccccaaggaaatggccatacttgtatttcactcttattttattttacatttccttaataaaattttaaaaggtttcatgaggctatatggaaacgaaggatgactcttcaggccatgaggagagtgtggcatgagattttgccgcagtatggaaaggagaagcctggaatggggaaccaagcacaaaaactttgtcctgggagttcctgcaggtgtccttgagaatgaactatggcagagaaaggcaggggcagaacccttcagagagcattgactcatcagctgctacaacctgatgagccgatcaggttcttgctgctcttgcccacccttcagactctttccctgagcctcaaagccagcttgaacaatatttcactcttctaggctgcctggggagttgggagtggtgctcagcccattttgtgggggttggagactgtttgtgcaccagggcagtccccactagaaggcaggaaagagctggagagggttggagagattcccagtaagaagcatgctgcaattttctttcacaaccaacccccatattggggtgacaattccagggaaatgggatgcattgttctctacttgctgctagcctctgggccatgaacaaagtagtaaattggccctgtgagggaggggacagaagggggaggtggtggaggatatggggaccagaagcccctggggctgactgatctgcttacaaacatcagaacttcccctccgtgaccctcccagcccccagggaatgagaactgttttgctctcctagatcagaaagaacaagatgtccttatctggtgggagagggctggtcaataccacctccaaggagagaagagaaaggacccaagagaactgcaagcccagcaggaagcatcattcttggggaaagcctagaaagaagcaggcaggctccatcccaggcccacagggtttcaggagtccggatgggcggtggattcagactccatactctcccaccagtgcttcaaagccctggtgcttgtggctggtgttaattttttacttttattgtctttatgagctttttctaaacctggcttctaaaaagctatgaaagccaaacagcttttcaggctacagcattctccaccccctttcctgactccctacttaccattcctctgacctttcttgagcacctactttactgtgggagaacagccatccctcagtatatgtgggagattagttccaggaccccttgcagacaccaaaatccacagatgctcatgtctcatgtcctttacaaaaattagtgtagtatttgcatataacctatatacatcctctcataaactttaggtcactctagattacttatgatacctaatacaatgtaaatgctatgcaaatagttgttatactatattgtttaaggagtaatgacaaaaaaagtctgtacatgtttagcacagacacagtcatccattttttttcaaacattttcgatctgctgttggttgaacccactgatgcagaacccactgataaggaggcaaaagattctgtgtagggtctgctgcaaacccatgcttcttccagggctctcagtctctgttactttcctcaccaaaaagttgcccttttgtgtatggtaaaaacaacgttgtccttccctgaattaatttaccaaccttggtctagaagcccatgtctttgtcacaatactcaatatttagtgatgtggccctagagaggttttagactttcagtcaaggttctgatatttttggtctgattctgccaacccagatcattttatggccacagaaccaaatggagctagatgctttcctggcacaattggtgagttttgttcaattcaacaaacctttcttgagcaccatgtcaccatatgcccagatagctctctgccagagagagaggtataaagccctttaagggcccgcccctcccctccatcttcctgcctttttctaccttgctgcacttcttctgcccatacaggctcagctccatctagagaaagctaagctggaaagtggtaaggggccttagatataatcttttcagaacccctcatgatatagacagagaaagcaagacccagaagagtaagaaacttgacctaggctacacagcagattagcagtagggtttggagttggggtctaaggctaagggggggcttctaaaacaaagagaatatcccaggttagtatgtgcattggggtggatgtgggaacatgtgaaaagccggtcaagaccaataacctagactttgtggccacatctaggattggtttgaaggttaccttgtaggcccctagcactcccgcccaaagtatgtctcagaaacagaaatggcacctctgggtaattcttttggagcttgaaggctgtgcacatttaattttccaaaaataaaatcctagtataggcaaagccttgtaggaacaaagccctgagggaggcagctcagaaaagacaattaagaaaaccccagagagcctttgtaactacatagtacaaaaaattctaccagtttaaaaaagatattcttgcctccttccatatattccacagactgattgttgtcaggcatgctccatgacatagaaatctgactttgtcagtccccctcccagaaaccactcatgaatcacatagtcctggtgagattagatccaaactcctggccatgccattcaagttcctgggcaactttcccaggatcatcttttcccacccaactcttacctaaaccacccacacataccttcttcattcacaccatatcattcacatttcaagcctccaaaccactgttcatgctgttccatcagcttgagatacctttctctactttttgattattagattatccttcagggctcaactcaaagatcaccctctattctgttaaacttttaaaaaaatagctttattgagacaaaatttatttgccacacaattaacccaactaaagtacacaattcaatggtttttagtaaattcacagaattgtgtaaccattaccacgatcaattttagaacattgtcatcacctggaaagaaacatgtacgctttaggcatccctaccaccaaaatctccccatcaccccctcgcagaccttggcaaatactaatccactttctgtttctataaatgtgtatgctctagacatttcatattagtggaattatataatatatggtcttttgactggcttttcttcacttagcataatgttttcaaggttcttctatatcatagcatgtattagcaacaaatttctttttatggctgaataatagccattgtatggataaactgtaccacattttgtttatgcacttacaaattcatggacatttcagttgtttctactttttggctattatgagtaatgctgctatgagaagtccagtacaagtttttaaattagatgtacatttttatttgtcttggttatatacctaacagcagaattgttggatgatatggtacaattttaaaaaaatatttaatttaatttttatgtgtacataatagttgcactatttatggggtacatgtgatattttgacataagcatacaatcttataatgatcaaatcaaggtaactgggatatccatcaccttaaacatttatcatttctttatgttaagaacattctatttccattcttctagttatttggaaatacacaattttttgtaactataggcaccctattgtgctaccaaaaactagatcttattccttctatctaactatatttttgtaaccattagccaacccttctttatcccccactccccattacccttcccagcctctggtaaccatcattctaccctttaccttcatgagaccaatcaacctttttagctcctatatatgaataagaacatgcaacatttctgtgcttggcttattacacttaatataatgactttcagttctactcacgttgttgcaagtgacaggatttcattcttttttatgcctgaataatattccattgagtatatgttatcacatttcctttatccattcacctgttgatgggtacttaggttgattccatgtcttagctattgcatatagtgctgcaacaaacatgggagtgcagatatctcttggatatactgagttttcttcttttggatatatacccagcagtgggaatgctggatcatatggtggtaacttgatgtttaatattttaaggaactgccaaaatgttttccaaaacagctaacccattttacattcctacaaacaacacatgaagatttcaatttctgtacatcctcaccaacacttattttttgtattttttttatagctattctagtggttgtgaagtggtatctccttttggtttttatttgcagttccttgacgactaaagatattaggtatcttttcatgtgttcattggccatttgtatatcttctttaaagaaatgtctattgaaactcttggcctgctttttgtttttaaagacgattttagggcagttttagatttgtagcaaagttgagcagaaagtgcagacatttcccatataccccctaccccccagcatgcacagcacctccactattaactccttcaccagaatagtacttttattataattgatgaacctacattgacacatcattattacccaaagttcataatttacattaggttcactcttggtgtacattctataagttttgtcaaatacataataacatgtgtctaccattatagtatcatacagaatagttccactgctctaaaaattccctgtgctttacctattcatctcaccatccccctggcaaccactgatccttttactgtctccatagttttgctttttccagaatatcatctgattggaatcacacagtatggagccttttcagattggtgtctttcacttaataatatgcacttaagattcctccatgtgttttcatggcctgatagccaatttcttttgagtgctgaacaatactccactgtccagatgtaccagagcttatccattcacctaccgaaggaaatcttggttgcttccaagttttggcaattatgaataaaactgctataaacaataatgtgcagggtttttttgtgtgtggacataggtttttgacccacttgggtaaataccaaggagcacaattgctggattgtaccataagagcatgtttagttttataagaaactgccagactgtcctccaaagtgggtgtaccattttgcattcccaccagcactaaatgagagttcctgttgcttcacatcatcaccagcatttggtgttgtcagtgttttggattttggttattctaataggtgtgtagtggtatctcattgtttccatctgcaattccctcatgacatatgatattgagcatcttttcatatgcacattcaccatacatatatattttctggtgaggtgttcatttagatttgcctttaaaaatatcaagttatgccaggcgcggtggctaacacctgtaatcccagcactttgggaggccgaggcgggcagatcaggagatcgagatcatcctggctaacacagtgaaaccccgtctctactaaaaatacaaaaaattagccgggtgtggtggcggctacctgtagtcccagctactagggaggctgaggtaggagaatggcgtgaacccaggaggcggagcttgcagtgagccaagatggcgccactgcactccagcctgggctacagagcgagactccgtctcaaaaaaaaaaaatcaagttatttattttctttttgttgaattttaagagttctttgtatatattattaacaattctttatcagatatgtcatttgcaagtattttctcccaatcttctcattcacttgatagtgtctttcacagagcagagattcttaattttaattaagtccagtttacaaattatatcttttatggattgtgcctttgttgttatacataaacaattaccacccaaggtcattgaaatttgcttttatattatcttctaggaattttagagttttgcattttacatttaggtctatgattagttttgtgtgaatttttgtgaagggtgtaagctctgtgttgttactgttattttaggattaggaatgaaagacagttattataatcctgggacctcatttctctgatggctctaagaacagtggtttatttttcagtttgtttagctttttatttgttgttaggacagagtgataacttccaagctctttacatgccagactggaaaacctttgcccatttgtcaatgttatttgtctttttattgttgaattattaaagttttaaatatatattctggatactcaacccttatcagataaatgatttgaaaatattttctctcattctgtgtgttatcttttcactatcttactggtgccccttgaagcacaagtttttcattgttttattgtggtgaaatatacagaacataaaatttataattttaaccattttaagtgtacatttcagtggcactaagtacatttatgttcttgtgcaactatcaccaccatccatctccagtactttttcatcttcccaaactgaaactctgtgtctattaaacattttctcttcttctcagtccttggcaaccaccattctactttctgtccctaaggatttgatgactctaggtacatcaagtaaatggaatcacacagtatttacttgtctttttgtaactggcttatttcacttagcataatgtcttccaggttcacctatgttgtagcatgtgtcagaatttccttcctttttaagggtgaataatatttcattgtatatacacacatacatacatacatgcatatacatatacattttgtttatccaatcatccatcaatggacatttgggttgttcccaccttttggctattgtgaatgatgcttctctgaactttaggggacaaatatctgtttgagtccctgatttcaattattttgggtatatacccagaaatatgtttttaatttttatgaactccaatttatctagtgtttttttgttgcttgtgcttttaaaattatttctaaaaactattgcctattctatttacttctatgctttcttctaagacttctatatttttaattcttatatgtaggtatgtacttcattttgagctaatttctatatatggtgtcatgtaggaattcagcttcattcttttgtatgtgaatatctagttgactcatcaccatttgctgaaaagactattttatctatattgaattatcttggcaaccttgctattaatcaattcacaggaaatataaaggggtttttaaatggactctcaattttgtttcattaatctgtacgttcattcttatgcaagtaccacacggtttttattactgtacctttgtagtagatgtgaaattaggaagtgtgaatctcccaactttgttgttcatttttcttctttcttctttttttttaaaaagacatttattcagcatcataatcagactattacatttagcaatcaacagcatgggtgcaaaaaaaaaaacaacctacattaaaacccttcgttggaatgctttacactttccacagaacagaagctaaaataatccgttatacaattagtcacaaatacagtcctcgagtttttttcccatacatatgagtatttgtctaaaacatgtctgctttgtagcagctaggccctgccaccactgtgctttgctaaattcacaaatctgttgtaacctgtagcttccctgccacttctctggctctccgctcctgctaaggtttgtttcctaattaaaatcttctgccactgccacagctactgctactactggaaccatcatagccaccttggttttgtggtttggcaaagaattggcctccaccaccataggggccagagcttctgactccaaagtttcatgggtccataatttgaagactgattgttgtaactgccaaaatcattgtagcttccaccacctccaaaattgcttccatcattaccaaatccattatagccatccccaccgccaccataaccaccaccaccatgactgccaccaaagccaccatgacaactgaagcttcctccacgaccaccacctccatgaccatgatcaaagtttccagaaccacttccacctctggctggatgaggcaatggccaactcttgctttgacagggctttcctaacttcacagttgtggtcattcacactatggtatttctgaatgacagtcttatccatggagtcatggttgtcaaaggttacaaaggcaaaatcccttttcttaccactgcctcagtcggtcatgatttcaattacttcaatttttccatactattcaaaataatctcttagttgatgttcttcagtgtcttctttaatgccaccaacaaatatctttttcaaagttaagtgggcacctggtctttgagaatcttctcttgagacagctctctttggttccacaactcttccatccaccttgtgtggccttgcattcatggctgcatccatctcccccacggtgtcatatgtgacaaatccaaagcccctggagggcttggtgtttggatcactcattaccacacagtctgtgagcattccccattgtttaaaatgactcaaccattttgagccattttcaggttgtttcaaagctcaacccttcaatgaagagcttcctcagctgttcgggccctttaggagatgctgacttagacacgatggcagagtgaagacagactttaatgacgcttcctcagcagtgtccatgggcagaaagctgttgttcatttttcaagattctttttgctattctagttctcttgcattttcatacacatcttaggatcagtttgtcaatttctgcaaagaaaatgcagccagggtttttatagggatattgttgaatctgtaggtaaatttacagagattgccatcttaataatattaagtgttctgatccatgaaaatggaatgtttccaattatttagatatttttaatttcctccgacaatattttgtagctttcagagtataagttttatactccttttgttaaatttattcctaagtagtatatactttttgatgcttttgtaaatggaattgttttaattttatttgaagattgtttattgctagtatatagaaatgtaattcatctttgtatattgattttctatcttgtaacattgctaaactaagttattagttctagcaggtttttttgcagattccttagtgtttttttttttttattatactttaagttttagggtacatgtgcacaacgtgcaggtttgttacatatatatatgtgtgccatgttggtgtgctgcacccattaactcgtcatttaacattaggtatatctcctaatgctatccttcccccctcctcccaccccacaacaggccctggtgtgtgatgttccccttcctgtgtccatgtgttctcattgttcaattcccacctacgagtgagaacatgccgtgtttggttttttgtccttgcgatagtttgctgagaatgatggttttcagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaccatacgtgtgcatgtgtctttatagcagcatgatttataatcctttgggtatatacccagtaatgggatggctgggtcaaatggtatttctggttctagatccctgaggaatcgccacactgacttccacaatagttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccgcttgttgatggagttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtattgcctaggttttcttctaggatttttatggctttaggtctaacatttaaatctttaatccatcttgaattaattttagtataaggtgtaaggaagggatccagtttcagctttccacatatggctaggcagttttcccagcaccatttattaaatagggaatcctttccccattgcttgtttttctcaggtttgtcaaagatcaggtagttgtagatatgtggcattatttctgaggcctctgctctgtaccattggtctatatctctgttttggtaccagtaccatgctgttttggttactgtagccctgtagtatagtttgaagtcaggtagcgtgatgcctccagctttgctcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctctttcatttcatcaagcagtggtttgtagttctccttgaagaggtccttcacatcccttgtaagttggattcctaggtattttattctctttgaagcaattgtgaatgggagttcactcctgatttggctttctgtctgttattggtgtataagaatgcttgtgatttttgtacattgattttgtatcctgagactttgctgaagttgcttatgagcttaaggagattttggtctgagacaatgggattttctagatacacaatcatgtcatctgcaaacagggacagtttgacttcctcttttcctaactgaataccctttatttttttctcctgcctgatagccctggccagaacttccaacactatgttgaatagcagtggtgagagagggcatccctgtcttgtgccagttttcaaagggaatgcttccagtttttgtccattcagtatgatattggctgtgggtttgtcataaatagctcttattattttgagatacatcccatcaatacctaatttcttgagagtttttagcatgaagggctgttgaattttgtcaaaggccttttctgcatctaatgagataatcatgtggtttttgtcattggttctgtttatatgctggattacgtttattgatttttgtatgttgaaccagccttgcatcccagggatgaagcccacttgatcatggtggataagctttttgatgtgctgctggatttggtttgccagtattttattgaggatttttgcatcgatgttcatcaaggatattggtctaaaattctctttttttgttgtgtctctgccaggctttggtatcagaatgatgctggcctcataaaatgagttcgggaggattccctctttttctattgattggaatagtttcagaaggaatggtaccagctcctccttgtacctctggtagaattcggctgtgaatccatctggtcttggacttttttttggttggtaagctattaattattgcctcattttcagagcctgttattggtctattcagatattccagttcttcctggtttagtcttgggagggtgtatgtgtcaaagaatttacccatttcttctagattttctagtttatctgtgtagaggtgtttatagtattctctgatggtagtttgtatttctgtgggatcggtggtgatatcccctttatcatttttttattgcatctatttgattcttctctcttttcttctttattagtctagctagcggtctatccattttgttgatcttttcaaaaaaccagctcctggattcattgatttttttaaggggtttttgtgtctctatctccttcagttctgctctgatcttagttatatcttgccttctgctagcttttgaatgtgtttgctcttgcttctctagttcttttaattgtgattttagggtgtcaatttgagatctttcctgctttctcttgtgggcagttagtgctataaatttccctctacacactgctttaaatgtttcccagagattctggtatgttgtatctttgttctcattggtttccaagaacatctttatttctgccttcatttcgttatgtacccagtagtcattcaggagcaggttgttcagtttccatgtagttgagtggttttgagtgagtttctcagtcctgagttctagtttgattgcactgtggtctgagaggcagtttgttatagttacaatttctgttcttttacatttgctgaggagtgctttacttcaaagtatgtggtcaattttggaataggtgtggtgtggtgctgaaaagaacgcatattctgttgatttgggttggagagttctgtagatgtctattaggtctgcttggtgcagagctgagatcagttcctggatatcctcattaactttctgtctcattgatctatctaaggttgacagtggggtgttaaagtctccccttgttattgtgtgggagtctaagtctctttgtaggtctctaaggacttgctttatgaatctgggtgctcctgtattgggtgcatatatatttaggatagttagctcttcttgttgaattgatgcctttaccattatgtaatggccttctttgtctcttttgatctttgttggtttaaagtctgttttatcagagaccaggattgcaacccctgccttttttttgttttccatttgcttggtagatcttcctccatccctttattttgagtctatgtgtgtctctgcacatgagatgggtttcctgaatacagcacactgatgactctttatccaatttgccagtctatgccttttaattgggagcatttagcccatttgcatttaaagttaatattgttatgtgtaaatctgatcctgtcattatgatgttagctggttattttgcttgttagttgatgcagtttcttcctagcctcgatggtctttacaatttggcatgtttttgcagtggctggtaccggtcgttcctttccatgttgagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggtccccaactctcctctggcttgtagagtttctgccgatagatctgctgttagtctgatgggcttctctttgtgggtaacccgacctttctctctggctgcccttaacattttttccttcatttcaactttggtgaatctgacaattatgtgtcttggagttgctcttctcgaggagtatctttgtggcgttctctgtatttcctgaatgtgaatgttggcctgccttgctagattcaggaagttctcctggataatatccggcagagtgttttccaacttggttccattctccccgtcactttcaggtacaccaatcagatgtagatttggtcttttcacatagtcccatatttcttggaggctttgttcatttctttttattcttttttctctaaacttttcttctcgcttcatttcattcatttgatcttccatcactgataccctttcttccagttgatcgaattggctactgaggcttgtgcattcatcatgtagttctcatgccatggttttcagctccatcaggtcctttaaggacttctcagcattggttattctagttagcctttcatctaatcttttttcaaggtttttaacttctttgccatgggtttgaacttcctcctttagctcggagtagtttgatcttctgaaggcttcttctctcaactcgtcaaagtcattctccctccagctttgttccattgctggtgaggaggtgcattccttcggaggaagagaggcgctctgatttttagaattttcagtttttctgctctgttttttccccatgtttgtggttttatctacctttggtctttgatgatggtgatgtacagatggggttttggtgtggatgtcctttctgtttgttagttttccttctaacagtcaggaccctcagctgcaggtgggttggagtttgccggaggtccactccagaccctgtttgcctgggtatcagcagcagaggctgcagaacaatggatattggtgaacagcaaatgttgctgcctgatcgttcctctggaagttttgtctcagaagagtacccagccgtgtgagttgtcagtctacccctactgggggttgcctcctagttaggctacttgggcatcagggacccccctgaggatgcagtctgtccattctcagatctcaagctgcatgctgggagaaccactactctcttcaaagctgtcagatagggacatttaagtctgcaggatttctgctgccttttgtttggctatgccctgcccccagaggtggagtctacagaggcaggcaggcctccttgagctgcagtgggctccacccagtttgagcttcctggccgctttgtttacctactcaagcctcagcaatgttgggcgtccctcccacagcctcactgctgccttgcagttcaatctcagactgctgtgctagcaatgaatgaggctccatgggcctaggaccctcccagccatgcacgggatataatctcctggtgtgctgtttgctaaggccattggaaaagtgcagtattagggtgttagtgacccgattttccaggtgccatccgttacccctttccttggctgggaaaggaaattccctgaccccttgcacttcttgcatgaggcaaagcctcgcccggctttggctcaggctcagtgcactgcacccactgtcctgcacccactgtctgacaatccccagtgagatgcacccagtacctcagttggaaatgcagaaatcattaatcttctacatcactcacactgggagctgtagactggagttgttcctattcatccatcttggctccaccctcaagaaaaagtcagtattttctatataaaagatcatgtcatctacaaatagaggtagttttattttttccttttccaatctggatgccttttatttccttttcttgtctaaatgtcctggctgaaacctcaagtacaatgctgaataatagatatgacagcaaacattcttgtcttgttgtttatcttacaggggaagcagtctttcagcaataagtatattagccttgggattttcatagatgaccattatcatgttgaaaaaattcccttttattcctagtttgttgaatgtttttattgtgaaagaatgttatattttatcaaatgctttctctgcatctctcgaaataatcatgtgatcttctttgtcttttattctattgagatagcgtattacattggttgattatcaaatgttaactcaattttacattcctgggataaaccccatttggtcatgatttataattttttctatatgtaactggagttaatttgctagattttgtcaatgattttatttttgcatcaattctcttaaaagatattggtctgtagtattcttttcttgtgatatctttggctgacttcacagaatgagttgggaaatatttcctcctgttctagaagattttgtgaaggattggtattaattattttctaaatattcggtaaaattcaccagtgaagacatttgagttgggggtatatttagggggagcagagcattttaattactaattctatctttttacttgttacagttaaattcagattttctgtttcttgcatagattttggtcgtttctgtctttatagaaatttttccctttcatttaagtaatttaatttaatagcatacaactgttcatagtatttctttatgttccttgtatttctgtaagattaatactgatgtctcctctttattcttaattttactgatttgcatcttctctttatttttctcatgaagtctaattaaacgtttgccagttctgtggatcttttcacaaaaccaacttatgatttcatgtgattttctcctttgttttttactctattttatttgttcctgttaagtttttattattgccttccttctgcttgctttgggtttagtctgctattctttttctagtttctttagttggaatattaggttattgatttgagatgtttttaaatttttttattgagataaaattcatagaccataaaattcaccctttaaaagtgtacaattcagtgttttaaatgtattttcaatgtcttgcaaccattaccatgatctaattccacaacatttcaaaaccaccaaaataaaccctgtaaccaatagcagtttctcccttagtgccctaggccctagctcctaatgaccaataatctactctctgtatctctgaattttcctattctggatatttcatatacaagatttttggttgacagttttttcctttcatcattttgaatatgtcattcctctatgtcttttagcttctattctttctggtagaagtcagccataaatcttattggaattcctcttatatgtgataactaattttctcttgctacttttaaagtttcccttggtttttggcttctgacattttgatgtggtgtgtctgaagtgtctctccttgtgtttatcctatttgttatttgtagagcttcttagaggtgtagattaatatatctttcttcaaattttgaaagtttttcttatttttgaatattttcttctgtttatttctcgctctcttctctttgggaatcccattgcatgtatattggtgtgcttaataatgccccacatttctctgagtctctgttcattattcatcattctgtgtcctcaatcttcttcaatttgcacaatatgtattgatctatcttcaagtttgctaactttatttcctgccacctgaagtctactgttgatctcttctatgaatttttttgttccagttattgtatttttcaacactagacattcttagtttagatctctttattgattttctatttgatggaaagaatttctcacaaattcttttagttgttttttttttcttagacagggtctctctaggtcacccagggtggagtgcagttgtacagtcttggcttgctgcagccttgacttcctgggctcaactgattctcccatctcagcctcccaagtagctgggaccacagccatctgccaccacaaacagctattttcagctaattttgtttattttttgtagagatgggcactgtgttgcccaggctggtcttaaactcctggactcaagtgatcctcttgctttggcctctgaaaagtgctgggattacagacatgagccaccctgactgactcttttagttctttaagcatagcttcctttaggtctttgaacatatttatagtagctgctttgtcctctaagttcaacatctggcctagttcaatgaagcctatttccctgcagcatacagcctctgtgtcactcctcagaggtcacagtcttgggcatgtacacagtatctaccaccagtgatactgtgattttaactgggctgtctgtctccttacctaagatcctctttgagcttctggatgatctatctctaataatatcactaccagctattagcctccacttcttaattccattagtgtttttaaacaatgccctgggaaataaatttttccacattaaaattgggtcttctcaagtcttcaaggcttgcccagaccctaaaagggttcttcttagctttttctctggttctctctgttaaacttctagctggtgaaccattctgcagctgctactagaatcatagtgcttctggtgccctcttgattgcttaccaccaagattgtcgttgttcctgacaatactatagacaaaaacttcttcactctcttttccaaataaagatagactccttggggagagccaaggagctctccattcttaaaactcatctcacctcatggacagaatctctgctctactacactagacattagaggtagggagagaagcttctttcttccagaatgacacccctgctctatgagcagggtgctgggcaggaatggtagctatggattttctcaacttgtttttttctagcattgaacatgcaccctatgagtgagctggggcagagtgatcagagatacagtattattggcccaccatgcttgaggtagagattccattttaccaatgggagctgactaggggaagggcttcccagtcctcttggcctcacttaagtggaataaaacttctgcaacatggagcttgggattagaggatgagagattccagtagactaccctcctagagtcaaactgttgccctgtactaggagctggaggaagagagagctccatgttattgactacacccaactagaatagaatttccatcatactaaactgggaggtagggatgtgttgatgaaaagagtcaaactctgtaaaatatttgaagatatttattctgagccaaatatgagtgaccacggcccatgacacagccctcagaaggtcttgagaacatgtgcccaagatggtgaaagtgcagtttagtttcattcattttagaggggcatgagctatcaatcaaatacatttaggatatacattggtttggttcagaaaggcaaaacaacttgaagttggggcttccaggctataggtaaattttttaatttcctggttgacaattggttgagtttgtttaagaacctgggatcaatagaaaggaaatgtttgggttaagataaaggattgtggagaccaaagttttattgtgcggaggaagcttttagctagcaggcttcagagagaataggttgtaaaatgtttcttatcggacttgaagtctgtgttgatgttaataacagagaggtataatgaggcatattcaactcccatttcccatcatggcctgaaacagtctctcaggttaaattttaagagtcctggctgaggaggaagtccattcagatggttggggagccttataattttacttttggtttacattttcccctttttggccaagatttggcacaggaaacattaaaagccagcaaatctttattttgtcccatagcgttgtcagggtggcaaggctgcctgcaccaggtccattctgtcccttggtggggctctttatggcccagggccttaagagtcaaaagacttaacagctgattaattgctctaggccagataggaatggatgtggacaggcatttattacctcttaaaattcttattttggccgggtgcagtggctcacgcctataatcccagcactttgggaggccgaggagagcagatcacctgaggtcgggagttcgagaccagcctgaccaacatggagaaacctcgtctctactaaaaatacaaaactatccgggcgtgggggctcatgcctgtaatcccagctactcggggggcttaggcaggagaatcacttgaacctgggaggcggaggttgcagtgagttgagatcgcaccattgcactccagcctgagcaacaagagcaaaatgccatctcaaaaaaaaaaaaaaaaaattaaggaaaaagccaacaaacaaaaaaaggcaaagttacaaaactgacttatttttaacttctatgtgttgagctacagtaagcttggttttagttacagacttttagccattcgctaaagaaaacataagcatttttctagaaaaacttaaatatatatagatatctttatatatatatatatctttgcaacttataactgggagtattatactcagaaggccttgtcacaaggtatctttattctaatgttaccaggggatctttgctcttagagctcccaagatggtggaaggctgctcccaagatggggcggccactcccaaatggcgcggccactcccaagatggcagcaagccttttgttctctgacctggggttcttggcctcatggattccaaggaatggaaccttgggccatgcggtgagtgttatagctctattagaagccatgggtcacagaagagaaccgtggaacccagcgactagtgttcagcttgattaggatgaacccgagcacttagccatgcaggaacaatggcgagcctctagcctgatcgggagcagcaatgggtgcctggctggatcaggagcacagtggacaccctgccggatccggaggggtggaagtcagaagtgggtctgggatggtggcaaacagcagtggtggacagcgagtgaaagctcagctcgagccgtaacaaacacggaccagaagcgtgtgcagttgcaagatttaatagagtgaaaacagagctcccatgcaatgggaggggacccaaagggggttgcccactcccagctcgaatgcctggggtttatatcccaatcattgtccctccccctgtgctctcagatgatagattatttgactatttctttacctcctgcttttagcctaattggtattttagtgagccctctttactacctgattggtcaggtgtgaactgcgttccaagccccttgtttaaaggtgggtgcggtcaccttccccagctaggcttaggaattcttagtgagcctaggaaatccagctagtcctgtctctcactgtcagtaaatatttttctttaattctataggaagcagaaaattatttatggttgggatggatgcaaaagtgacacataatagtttagaagacttgttttatcagctgtttaggcatccttgtatcctcttgatttggacaatctgaccttgacctaattttgtccctcaaaactggcccttaaaatttcatgtgctcatcatcactggccatcagagaaatgcaaatcaaagccacaatgagataccatctcacaccagttagaatggcgatcattaaaatgtcaggaaacaacaggtgactttggagaggatgtggagaaataggaacacttttacactgttggtgggactgtaaactagttcaaccattgtggaagacagtgtggcgattcctcaaggatctagaactagaaataccatttgacccagccaccccattactgggtatatacccaaaagattacaaatcatgctgctataaagacacatgcacatgtatgtttattgcagcactattcacaatagcaaagacttggaaccaacccaaatgtccattaatgatagactggattaagaaaacgtggcacatatacaccatggaatactacgcagccgtaaaaaaggatgagttcatgtcctttgtagggacatggatgaagctggaaaccatcattctgagcaaactatcgaaaggattataaatcatgctactacgttacataaagcttgtttaaacatcttaaattttataattctattaacctgtaggtttttatgttctggtcgcaggaactttatttatttatttattttttacccttagatcattttaccttttttggtgaaaaaggatttgggttcccagcagagagttgcattcgtgagacccattgagggacaacaaattctataaggcttctcaaacagttctatgattctgtgggaggggcacccatgtaaaaaggggtcccttaaccctcaaatttaacatgacctgggtaataggcctattcgttgggggatatcccagtcattataaagctagttccacatggctcccatatgaaacatattaactgcttcatctggggtgctctacttggtgttttatagggagagctgggtagtcccctttacagggcaaacagacttacagtggcatttatctggcccactacgctgatcattctctcagaaataaccccctgtgcatttggatcacatatacttatcagtgattgtttaatagtgagttgtgggtcctgcattaacccaaacaagctcttaatttctgcagcatttaaaattaaggattttgtccttaaagtgtttatttttacaatccactaaagatttttttaaagaagtggatgataccaatttacaaaatggaacaatccctttacattatactctccggttttaaaagttacttggttttgcccttcctccacatcaacttgttggtagccacaggtctcagagttaacttttgttgccctggcataattgttggtttttttttccatttagttttatctgtatactttttccttcattttaaagcaactcttaaatagtttagaaataaacacaattttttaagaaaaatcaacatccttgtgttttataaacttcaccaaaaacatattttatgcatttactattttagcttgtagtaaccaaaattcccagtaaaaattctcagttatgttttaacataacattactttaagattttaaattactggagagagttgagattaaatttaccaaattaattttaccaaagattaccaaagtcatgtgaattaaaaggtatctgagctagcctctaccagtctaataaatatgtactttcaaaaaaattacttgattagagctcctccatgtagtttggtagtgaaatgtcacttccatatgacacatataaagatagagatataacaggcatgcagaataaaaaagcaggtccaaaatatatttttacctgttttttaaaaaattatctcccttactttaggtaattaataaaagttataggagtcaagaaaaggtgaaggagagagctattatccaaggcctttttaaaagagaaagaattgaacctttgagatgtttatctgaagaatttttaacagacagattatataaaaatttattgcattaagaataagtcaatattttaaacaaaatcttgttttaaccaattatttagttttgtattagtgtatatatttttaataacaaagactcatctctagaaagactattataattttttcttaatcatagtcaactaaattatacaacccttttttttaaacaaaattcctttttactaacattattacgacttgcatagactattcacaacatgtttggattttctgttttgtcctaaatatctctctttcttgaacaacccagtcattttattttaggacaaaaattcaccacacaagattctttcttatataaaattactttcatttttaccttctttactgaaaaatacctctttatatcattaactttctttccatctgttattttctggttccttttaccttgttttatacataacccttaaataaacttagaattagatgaagatatttaccttttaataagaacactttaaaaaaagttttactatagttttaaaattggaaattacccagatacttaatatttattaataaccttagatcctaaattatatgacaagtttgtttacaagcatttctttcattatatttacctgattgattgatttaattgtttacctagattatatacaaaaactgtgatagtcattccttaagttacttcccggttaaccattttgatagccgtgaatttcaggtgttagtcattctttaagttacttccctgttaaccattttgatggctttgaatttcaggtgtttccttaagtaacaaacttagggttaaatataagggtattttttaccaagaactcaggatttagctgttttcattaaaccagcaatattccatcttacttatcaaaaattatacaagcaaagatcattctgcctttggctgggttttatagttttataacccttatgactaatcttgtattctggaggaataagcatgaaagcacttgatcaataaacacaaacaaaaatgctaataattcttaaaacatttctaatattattttaccaataattttaaagccagcttatttattaaagattttactcaagtgatgtgaacttcaaaaagcatttgactagtctttttttgataaaatattttatttaagcacttgtttttctttaagccaattaattagagctcttttatatatttttagtagtgaaacattgtgtacacaacacataaatacatagatgtattaggcatgccgatagaagtacatcttatagattcataagacctcattgtttcctaacttagacttttaaattcttgataacctgtttcatcaacctagacagttgtcagctaaatagccctacatttgcctattaaaggaaacaactcttaggtgaaaaatcagcaaaatttacatctcaaggtaccaagagagaaagtctggtgtgctagagggaaattaaaacagatttaatttgccaattaaacatgaaattatagaagtctattataaaggtcacacacatacacacacacacacacacacacacacacacacacacacacacacacgcaaagatcctatggcttttacttcagaactttagccatgagataaatacaaattcactggcttgcaaaaaaaaaaatagttagatccaagtagtggttgttatctcagtagaaaggtaacagcagatttaaagcaggcagaaaagaaaatagagaaaaagagaacttaggaactttagagtttgcaggttgaccttggggttctttttccttaacgtaaatgtgaaaaatgaccatactattttcattttacataaactttagcaagtagaggtgccataaaaccaatggagtgccccaaagggggtaattctccttgttttctcctcattcttagattatttgtttcccacacttaaaaaaaaaaaaaaggaggaactgagctgtggcctggggcttttgtggagtgggttgaagtgggttgcttgcaggcaggacttcacagtgtgtcaccactgagtcattgtgccctcttacttatctcagttttcctctctggaggtctaagcccctccaggagggctcaaatcgtggagtgaccagctcctatatgtgtttcctgaataagccttttttaaaactaatttttttgggggttccctgtagggccactgcacatcatggggggttaacctccaccagacactcccatgaggcccttggtcacgcaggggcacgttttgcctgggagaagcaaatgtgttttctcttcagagctaaggaaacacagtttctcatttacctataaaaacaacagtataatttatcatgcaaatgcacacagacaagccaaactgagattaattttgggagaaaatgcaatggagaggattctttaaaatgcacgtctgaactagaagtaggatctttaaacaacttcctaggagaaaaataaaatagctcagaataaatcaaggaccattaaccaacgggagggccaaggctcgggaggacttaccagttccaccagaggagaagctcgaagtcaggaaggcttcaatgggcctctgctccttagctctgagtttgggcaacttccttcatggtcctgagtcttctctgaggtcccacgttgggtgcaaaattattgtcaatgaaaagagtcaaactctgtaaaatatttgaagagacttattctgaaccaaatataagtgaccagggcccgtgacacagccctcagaaggtcttgagaacatttgtccaagatggtctgggtgcagtttggttttgtacattttagaggggcatgaaacatcaatcaaatacatttaagatatacattggtttggttcagaaaggtgaaacaacttgaagctggggcttccaggccataggtaaatttttaaatttcctggttggcaattggttgagtttgcttaaggacttgtgatcaatagaaaggaaatgtttgggctaagataaaggattgtggagaccaaagtttaattgtgcagaggaagcttttagctagcaggcttcagagagaatacattgtaaatgtttcttatcagacttaaagtctgtgttgatgttaataccagagaggtataatgaggcatgttcgactcccacttcccatcatggcctgaaacagtctctcagattaagttctaaaagagccctggctgaggaggaagtccattcagatggttggcgagccttagaattttatttttggtttacagatgggagcaggttatggcttaaataccagagactcttgctattcttaccaagatgtattagagtttcttgaataaatgttccttcatttgctgtagaaaattaggacaatttccagagactttgaataattgatatttaaatgaatttcgccagttgcagtttttccttttgggtccacagggctcctcatactcccattctggaactggaagcctctctgttaagtctgtaaacacttcctttcccccaacacagatttcttcaatctgtctaacccaaaaacactgccctgggacaggatgtccctatgtaagcaggacagtgggagaagcctggaatttaaggcccaaattgggtctagacattcttgataaatgtgcctatcctagcgacttgccatttaaaaaggctaaacacaaggtgggacataggggatcagaagggagcaagtgaggccactcccccatactccctaccctgagtcttgcccctaagagttgaatattggtggtgggagggggactcatagaagagagaggctatagctctctatagcaaagcagattagagtagctccattggccccctagggaaggagcctcagggaggctgacttgggtttcacaagaaaaagtacattctaagggtaaagtacataaagagctgcttcaggaagaagtgagctccctgtcatcaccgaggttatctaagtaaaaggtagagggccacatgtccaggaccctctatcattcatttagagttagaatcccaggacccttgggagaccattgaccctaaaattcattgatcctctgtgtttggagaaggaactctgcccagttttgtctagccaagtcaggtgattcctaggatttttgacataataagagttcagaaacaccccagggaccacgggcctttcctggggttttgcaaaggagcagaattagcattcattactcattcattactgctctaatcagcatcttaattgccagtcttactctcagtctttatactgagtacctggtgcatgttcactctccacccccaacgtccagctaagcctgggggcaaacacgagattccctagaccatctgcattccaccttctttccctcccccttttagagagctcaggaaattggttttaatccaccaagctcctgttgcttagtaacagaagcacctgctcctagcaaccaggagccacaaagatgctgcagaaagagggggctgtctgggccctgctcttgctcagctatagacagctggcctccccgatgtttttctcatccagcacagacactctgtctcagatgtctgttcttgaaaagctgatctctggggcagcttctgacctcaacccccaacctgcctgcctggagcccctctgaatcccacctcccaggccaccaggaggcagtcatgttcacaatagtgtggctctgggaagtgccctcactgaagagggacagaggtaagtaaccagctgtgttggttacttcagtctagcctggtgggtgggagtagggtgtgccacacaggctcctataaccctgggtgagagcaattcctgctcggggtggaggttggggagcgtgttgtaatccagtccatttgagcgtgaagagaggcaagagaccatataagataattccctcctagagatcaggaaactgacagtcaggacaggcttgggcccacacagccctttggtgacagccaggtctgaaggaatgccagaacgtggggctccccaacacagtcagcacccatgagactgccaggccactgtgcagtgccagaggcttctgcttcccgtccccgaaggacagcaagaacacacttctccaccacctaagaagaaccctgccctcttgccttctgggatggcccgagctcagggtgatcgccaatgcagattttttcatttgacgagctgctttcctagaattgttgaaataacaagagtttagaagtacccaggagaggtctgtccagagctctaactctgtggactggtgctaattggcatcttccttagtcacagatttctctgaccttcacaggaggtgcaggtgcgtgcattccctctctgtctctctggggcttcaagctctgaaagtagggctgtccaccaggagtaaaccacggaaagtgggggttgtgaggaccttacccccattcccatccccccagccctgggccagactctcaggcgggaacaagccttccagctgtgagcttctttcttgcttctcccctccctctcccctttcttcctcccaagaaaagagcttctggtctctgccttccattgcctggcaaccaaaccagctgccacaggctgagaggagcaacacagatgcttctcaatgaggggctgaaatgagggggtgcagttgctgtctccagtcacaagcacccatcggcaatactgctggtgctcacactttggatacaaggcttttcttacatttgccagtgttatgtgtatttgaaaagtcttccaaaggacagatatgccacaattgggtaaactgctccacgcttctctatttcatatttaaagcatgtcgttatggaaaatttcaagcctatacacaagtggaagggcgtagtgacccctcctgtacacagcatccagcttcaacaattatcagcgcctggccagtcacacgtcattggatccgtaagtatttcaatatggagctctgaaagacaagaacccctttcagcataactacagtgtcgttataacacctaaagtaattagtaatcattccataatatcgtcaaatacccagggaatgtccaaactttaaatgtctcatgtctcatcaatgttatggagggttcatgttatggtgttttttccactttttgtagtcaggatgtaaataaattaatctatgagttcctccttatgaatatcctgaaattacaaggaactaggattgtcctggaaaccatggacctgcaggctcttcctgagacccctgtgagctccactttgatttacagaaggtattgttagttcccaaattttgagatgagactgagattcaagaatgaagagctcagtgtcacccagctactgagggactgggtcaggttgttaactcatatcaggagtccaaactcctgtatgtgctataatgaccacactctgacacccctacctgctctacctccagaaaggtgagggaagcctttaggaagggggcagtaaaggcctccaccactcctgcccccaccctcatactagtccaggtcctacccaggatctgtcaaaaccagtgcaagcccaccttctgtgatctccctggcccatttctctcctcccaggtgactgcccttgggtgcatgtgcctcagtctccccctcacccagaagaaaccttgattcctaaatatctgtgccccacaccccaggtgagccttttggaagcagctccccaaaggagtgctgactgcccgagtgaggggctttctgtgtgtgtgtgtgtggcaggggagggtgcactgcaagtacagggaagtctccggggagagatcacagataccagccagggagccagccatcagcaatgccagagtgacagtgtccctcttgtcctcagcaggggaaagggagtgtccaggcaacatcctgggcctgagcatcctgaggacaggggctttggcctcacctctccctcccacaggccttttaccctctggggacaagaagttctcatctgtacagcaaagatactcgagaaaatcagccaggctgtcctgtggttgaaggaggcctctcagcttggagtaatggaaactgatctggccagagagtcccagcatcaggtcttggtctctgctcttacattatgcagctctgtgaccctgggcagggaccttcttttgtgggactcagttttcttatctatacaatgaaggggctggaccagctgctctctgggggcccattagcttccaggtttctataatctccaggaaaaggagacccatacattccttggtaaatggtttctggtcttaattacctttactgtcaggaaggtcttcctgcctttttgcttctgtctctgagccttgtttcctctggccgaggcccttgtctagataagcatgtttattgtcccagaagtgcctgggcaggcaacaggcattttcatcaccacaactcaagccaccatggtgggagagtggggtctagacccagccaagtccctgctcccgatccccaaggtgttcaggagggggcagtgttcaggccacaggcagatgagagatcatggaaccaactggctccttgctcttcaaggagcccaactgcccggtcttccagataaggaagcaggaactttccccaggaaacacagagctggagaagggaacagctggggacccctcagaagggatctttcctggtcaggggtggggatggtgaagaggagagcctaaggagcagagttagggcattaactaaaagcagtttatgaaacaaatcctcagggagctcctgggtcctccttggggaagacagaaaacacacacacacacacacacacacgcacacacacacacacacaccccacaggagaagagattacaagcatatctgactatcaggtaactgagatgggactctaacttgaccatcccacccaggggccacgagtctcccagcagcttcatgtattcaacaaatagtgactgagttactgggcatcaaacagtaaacaagggggacatggcctcagccctctctctcaggaacttgcagcctagctcagcaggggcagatgctcaagagaggattctgatccagggagctaccccaggctgaagtaagccagggaactgtgggaacccagaacaacccatctcaggtgctcaagaaccatcctgtgctgcaggctgtgtcctggtgaagatcaattagaccctctaccttgtcacaaggacagaggattatctgtatcctgggttcttgccttggtgtaccagaagaatcagatcacatctgggcttggagaatgagtgcaaggttttattgagtggaggtggctctcagcagttgggggaagccagaaggagctagaatgggagggttttcccctggagtcgggtcgctcagtggcctgggctctcctccgagtgtcccagtcaaactccacgttgttctgctggtcggggctgttcgaggcctgcaggtgtgctagtgcctgttggtgcattcttctggacgtccagctgcccctgtgttcctccactgatgcgctcctctctgtgtttagctgcctgtgtctttttctgctgatctgctcctctggacgtccagcagcttgtgtgtgtgcctgctagggtctaggggttcttataggcacaggatgggggtgtggcaggccaggggaggtcttgggaaatgcaacatttgggcagataaacaaaaatgcctgtcctcacttaggtccataggcacaggtccggggtgaagccccagccaggggccaggaccttaaccccttgtatcatttaaagggaccatgctctttccttcctagcacttccatatcactggctgtgcccatttctgggggagtcagttctggttgcttggagatggtagccttagggagcaattggtctcccctcttcaggacagacaaagaagtttgaggatgtgcatgaccttccagcactttttgtcatctcagcgagaattgggcagcttctggggcttggaggagagctgaggctacccttctttatactagaggttctcaaagttttttgtttttggttctcaaagttttggggtcggtaccccaaagctcatggttaaagcttcagtggtttttccaagcagaaattgcatattgaaactgggtgccctttcttttgctggctgtggggatgtgaagtgtgggctgtagggcctcagataatagcacaatttctatcaattgttctgtaaaatcttttcttctcttccctgctgatgcagagggccaaaatgtttccttcttcaaaccagtgcctgtgatttagctttcattgacattgataatgaacataaaggtccctgagcaaggctgccccttttgtacatccttgctgctcttctcctatgtatgggggtgggggggatgacactggaaggaagggggaacgaatgagaaaatgtcctgtggattctatatttaatgtgttcagtgacatgcagagacgtttaagtgggatttttgtaaccacctttgcaaaatgatgacagtaagggaaatctgacatagttgagtccatcttgcttctaacctccaagcagtccttggtcactcctgggtataggccaagctaactttgggaggaatttagtttatggtttaaccttaaaggaaggatgataatagtctttcccaaaactaagcagcctttgtaaaactaatgaaaggccacaagattaggattatgaggagcctgaattctgctaagatgtagggtatagttagacaataaccagccattgttctggaggtcacaagatttgtaacttcttcaattactcctgtggataacatcactattatagaacctaagattggtcttctgagatatttttcagacttttacattctgacaatcaactgaccccacccagaagtggactcaagactcatgacccaactgatcctgttaacccccctcaacccagaggcagtctcagcacatgaccatagttttccacacctctatgattggatcccaaatcagtcagcagcatgcattctctagtcccctgtccaccaaactatccttgaaaaactctaacctctgagcctttggggagactgatttgagtaataactctgtcttctgcatggctgaccttgtgttaataaagcttatttctctactgcaatagcatggtctcagtgaattggttttgtctgtgcaatgggcaggaagaacccattggttgagtacactttcaaggaaatactaaggaaatgctttattttagctgcctggtcagtcccattgttcgggtttctgggtcttcctcttctcaaggctggtttgtaaatcctgagctattgaggagctgtctgttttctcaaaagagcagatgggccctctgatccccgacatgaccccctcctccactgactcttcatccacctgggggtttttgcttttggctactggcccaggtaaggggcctgtgcctatggaatacagtgggtctccagtcctttggggctcagggttccacctcccttctctctcctaggccagaccccagtcagactttggatgaaggagaaggcacaggcatggtggcattggcaatgaatctctttggaatcaaattttagtcaggctcttctaagtcctcttcttggctgtatctggaccttgccctcatcattgctacacctgcatagccccaatttgcagtaatctggcaaagtcagtttaaagagaatcccctcattcttaatatctgattagtctgctctcagaaagaatcctgtttggtcaatctaacaagaatcctctctatccttgatgtctcttatcagttgcaccccctggctgcacccaccactactcttctccttgactaagcattcccagccccacagaattcagtattcatctcctcctcaatattcagaattgggaccagttccatactgaggttttcctctcttgcaataatttcttttttcttttctttctttctttctttttttttttttttccagatagagtttcactctgtcacccaggctggagttcagtggcccagtctcagctcactgcaacctccacctcccaggttaaagcaattattgtgcctcagccacccaagtagctgggattgcaagcatgcgccaccacatctggctcatttttgtacttttagtagagatggggttttgccatgttggccgggctagtctcaacctctgggcctcaagtgatctgcccaccttggcctcccaaagtgctgggattacaggtgtgagccaccacgccccatcatctcttgtaatagtttctgaataaaatattttttttactggtattatccaaaaaaccactaggatggctaaatagtagaaaggagaactttattagcaatattggtctgcaagctgggaagagaaagtctccagcaaagagagtgaccaaaggtactctcttcaaagaagggaaggacagattgggtcttatgcctcacaggactggtatcttacatattcagtaggtttgaggggaaagctatacatatttatgagaagagccaagtgcatgcacattggctaaacatgttgtaacatacatcccaagttcactttggggtgaggttttggcattaaaatgaggtataatttggctttttatgtcaaaactgtcttgggacacaagacagtttgtgcacattctctataaactggctaaaactggcgtaaggtctgccccacccccatcagactttggatgaaggaggaaacacgggtatggtgacatcctgtcccttatttctcagagctggtaattgaggtccagggaacacagggcatttgaccctcttccaggaaccagaaagctggaaactcctgtattactcagttgctagtaatttaaaacagtgcttattgcagagctatattctggaatagaatgtatattttaaaaaaattttccatatgttattggggtacaggtggtatttggttacctaagttctttagtggtgatttgtgagattttggtgcacccatcacccaagcagtatacactgcaccatatttatagtcttttattcctcgccccgccacactcttctctggaagtccccgaagtccattgtatcattctcatgcctttgtatccttatcgcttagctcccacatatcagtgagaacatacaacatttagttttccagatgtacaatttttgatgaatctctcagaggcaattatcaacctcaatgtaattctgagcttcccccttgcaccctgtttactttgtttcacaattggacaaaatgagttctagagaacaaaggtcatttgcacaaaattctacagcaatcgattgcagaactcaaagtaaggttcttttaataataggtatcctttataaatagaatgaccggatgttccagtttataaatattgtcccattctaattattaaaattaaaagtccttctcaaaattagcatggtacatataataaaatatgtttccccccatttatgtgccattaatttttcttcatatattaggctggtgcaaaagtaattgcagttttcgccattgagagtaatggcaaaactgcaattacttttgcacccacctatattgtttcatatagtctttacaataaccctacaatgtgacaatttctctcattttacagagtaggagattaagtttgaaaggttttagttacctgcctgaagaaatataaatggtaatataaatggtaaatggtgaagccaggcttctgattcaggttttgtggtgctagaactgggcagtcaattgccatattattctttagtgtcgaccaaactctccccagagagacctgtagtatgcccagaacagtttggcctctacttgtgccccaatggacatgctatttacctgggattggcagacagtacagagaacaaagagcctagggtaggaggagggcagagggcttacaatcctcaggcctgttgatgaaaagacttttcagaggcagctgatgacaaaagcactagccagtttcatggggaggttgtagaaggtgcaactataaccctggagcaggtagagcatggaacaaggacccagtgctgctactgctgtctctggtgggccccccctctgctccagcaaaagttaccacatggacaccattagccaaagcccagaccagctgctggcccaccgcatggaaagtgcgtctggggtattccatgcctcaggcctaagggtatggcctcagcgactctcttcaaagtgttccccaaaatcctgtctaccctccacagggacgggagggtacagaaaacatttttggagtcctgtgttcaagcactatctgggatataggtataggcttaagcattaggagatatacctaatgtaaatgatgaattaatgggtgcagcacaccaacatggcacatgtatacatattaacaaacctgcacattgtgcacatgtaccctagtacttaaagtataataataataaaaaagaatatattaatttgaacataaaaaaaaccttgtagtccttctcagctatctcctctcccctctgcagacagactcttgtctcttttgatatcttaaatctttgtgtagtagaaaaatacagtgtgttactttaggctctggtactaacagatttgtgactttgggtgatatcatttaatcttcctgggcctcagtttctccacatgtaaaatgaggaggttagtctagatgatcactgtgttgttattccaaactcttgcgtatgtgattcagtcttatctctgctaccattcagtaggtccccagaccaggctccttcctaccctccctaaaaaattcagataccagcctcatcagtggcagcttcagtcctgcctccatacccttgcggatataataaccacagtcatagtttttaacattccactaggacttgtgtgggctctccagttcctaaaggttcaagtgcatttcttgaccctgtcattcaaagatctctacactcaggagttggtggaaggcttacaacacatttattttgtgaggctctctggatatttgtaaatgaagaaatgccaaaatacagtctcaaaaattgtggtacttttgaaatacttacttttaacagctaaacattgtaacacatatcaagcaaatataatgaaatagatggcattcacaagataattacaggatagataaagtgtacactagagatcttttgtgaatgagaactccagccagatggtccctctaacctccttctcctgctcttcctgttccccacaacggaccctgacaattgacaatagtagttgatccaatccattgcctctcaaacctggcagtgccctcatattacccacatggtgcagatgcagctagtcaagcatggtccacgggctggcatttgggatcaccaaacaagctccctttacatgtgtgttagccttctgcttggactggccagatctttggattgcattactccatagctactacaacccctagcactaggccaaaatcctggcaggttcttagtgttgatttcagagctgaggaccagggtggaaatgtgtttgcaacctttcctgtactcctgttctctccccaccctcttcaggaccatcacagagcctctacaagaagacactccaagcctttaagaccctgacattaccttccttctacctctacccaaattatatgattttttcaaatccctcttgttctaaaggaccctgaccttctcttcagccacctcacacagacccaattaaaaggagatggggagtagactaggtttcttttttctgattttcttttgacccatactgctttctttgctgtcttgtgggcacatacataggtattcaagtgaaacaagcccagacttcaaagttaagaacttcaggagtggaatttctccactcttggtacagtggggagtctggagcaagctgtttgccttctttgcaccttcgttacagatcaggcatcaaggaatgaagattaacccttgaccttgctggaagatggcatgtttacctgatccctgatgttccaatctcatagtgaccacaggagcctggagcatagtaccaagtgtgtgagggcatgccatagataatgcagctgggaataagggaaataacgttagatggagggtcagaagacccaaagttaggcctacttctggtcttctggtactaacttgcttcgtatccttggagaagacattcaaactcttcagcctcaatttctttctttgcaaaatagggtacatatagcataatagctaagagcaaagaccttattgtcagacagacctggattggatgccaactctaccacttactagctgtgtgacctagtctacttaccaagtctttcttggtatgtttatttacttgagggcaagtaaatggaacactaatattatttactttatgcagttggtgtgaaaattaaatgaaatagcatagctaatatatgtaaagaatttgacacggtgtctgtcacatagtaagtgctaagtaagtgttaactattgttactactagtagtactactacttctacttctactatgaagaaaagaaatatgtgaggaaggacatttgctgccctatttatcttacacagttgctgtgaagatctaatgagataagtgctgaaaaagggttttgggagataaaagaactctacagaggtgaggtgagattgacattaaattacaaaggtgttgggaccttcccccttactgccaggtcgctcttgagtccatcgactctggcttgatcagtgctggcatgagtggctattgccttcccttcccacccacccatcttgcctcctggcatattgaattagaggaaggggttagaaactttgacctccaaccttctgctactctaccactcccacccctactacagaggcacctgtcacataagtagccagtacccaacccagacccagagttcactttgcatttgccctactgagggcctgggacatgtgctctcttcattagcagcctggagaagtgtctgtccacatctgccttccccaggactatatttaagtcatacaagccaggtctcttacattagctcacctaatcctcacagaacaatcatttagttggtacttttataagatccattttccggatgagaaaactgaggcttagagatgtgaaataagttgctcaaggtcaaatagaaagtgaggatgtagagcaatggctcacgcctgcagtcccagcattttgggaggccaaggtgggcagatgacttgagctcaggagttcgagaccagcctgggcaaaatggcagaaaccccaactctacaaaaaatacaaaaattagcggagtgtaatggcgcatctgtagacccagccacacgggaggctgaggtgagaagatcacttgagctttggaggttgaggctgcagtgaactgtaatcatgccactgcactccaacccgggtgacagagcaagatcctgtctcaaacaaacaaacaaacacacaaaaaacacaaatagcaggtacatacaccttgttcttaaatccatgtctgtctgactcagagcctgcacatttagcattatacaaacattatagaaagattaattcagcccatccctgatagtttagtggctaggaaaaaaaaattctaaaggaggaaaattcatctatcctagaaccttcctgtagtgacagaggtcccagccttatttcagagaggctaaggtgaggcttaaggaaatttcccagctgggaagcaggttgttaactagccaaccgatgtaatatcctctgtcctgaaggggcttttgatttccttcctctgctgtttcctcattttccccatctctctcagaaaacacttaacaaaaaggggcagtatcccggaaaaggcattttagattgaaaaatgagctctgtccatacttttgcagtccctctgccttcttttcccctacctcccttccttcagacaagtaattcaagggtgctagggattgtcagcctattcctgctcagaggcaggaacatggcctaagtggtctcttgagatttcctgcaggctttcatgcttcatgaagtcgtagcagcaggccccctgacggtggagccaacattagtgcttggctcagctctgaggatcaaagccatattaatcctggcagccagccttccctggattgattaccttgtcatctgccccagaccaaccatcccaggtttccttcctaatgttaaactacagtgtagggagagttgcttctggtaacagagtgataacctgtcccattggggtgcctgctggaagcagctgcccaaactggctgcctctttagctcaaaagtggccttaaagctataagcagggccctattcagtctcaagggtaggaagaggctcatcattttggtacttgtttcttgttttggctttacaaaggcactgatgcttcctgaaagctgagcttagaaaattgttcgtctgactcctgctgcttcttctctggtggtgggacagatcaatggagcagccatgtttccaaggagggtatagagatttgctaacctaataagaagcagctggtgagctctagacatcattgcccagttctaatttcacactcactccttctgaaccatgggctcagggttccttttcctaacctcacagggttctggtaaccataaggcctccaacccaccatttaaaggttgcaaggccgagatgctaaaatgacagagagccagacagggaagtagatacggcatggtgatggaggagacctgagaccttgtccctaccctgctataaaccaagtctgtaggcctcatgtcttcatctgtaaacaacagaaagatcattgatcggtctttgcttaatacctctccatgcctagtgatatggggcagggagcctgggaaggggactgtaaaaacctcgaggtaaatctaggctgggaggcactgccctagagttcaggaaggccaagtccataatgtcattgcctaattgaatactagaaaagcacccctggaggcaggtgagtttggctgagaggtaagttgggatttacttaatgtctaaagagagagagaggtcaaagtaaatggttcagtgggcagagagagaaaagcaggtctagggcagaagggagatctcagggactttcccatggagccccaggggagagactcagaaagatgagggcaatagaagggaagatatgacagaacagtcttatcagaggcttatcaggtatcacagtgcagtagaaggagcacaggattaggactccaaagatcggggtttttatcctggcttagttagcaattgacttgctgtatgtccttgagtagtttatgtcctctctgagcttcagtgttctcatctgtgatatttattatttatttatttatttatttatttatttattttttttttttgaggcagggtctcgctttgtcacccaggctggagtgcagtggtgcaatctcagctcactgcagcctcgatctcctgctcaagcgatcctcctacctcaacacccgctccccccccaaccacaagtaactgggactacaggcccgtgccaccacacctggctaatttttattttattttatttttttgtagagacggggttttgccatgttgcccaggctggtcttgaactcctgagctcaagccatctgcctgtctcagcctccaaaagtgttaggattacaggcatgagcaaccgcgcccagcctcatctgtgattttttttatttttgttttttcaaagctttattgaggaataatttacaaatagtaaaccgcatatatttcaagtgtataatttgacgcatttttacatatgtagatatgcaggaaaccaagaatgtggagaaaagggaacacttatacactgttggtggaaatgtaaattagttcagtcactgtggaaagcagtttgcagatttctcaaagaatgtaagacagaactaccattcaatccagcaaccctgctactgagtatctactcaaaggaaaataaatcattatacaaaaatgatacctgcactcatatgtttattacagcaatattcacaatagcaaagtttacaatattcacaatagcaaagtcatggaatcaacctaggtgtccatcagtagatgattggataaaggaaatgtggcatatttataccacagaatactactcaagcataaaaaagaatgaaatcatgtcttttgcagcaacatggatagaactggaggccattatcttcagtgaaataagttagcacagaaagtcaaataccaaatgacaggatttcattctttttgatggccaaatggtattcccttgtgtatatatactacattttctttatccatttatctgttgatgaacacttaggttgattcaatatcttggccgttgtgaatagtactgcaataaacatggcagtacacttaattctttgacatactgattttctttcctttggataaatatctagcagtgggattgctgggtcatatagtagttctatttttagttttttgagaaatcaccacactgttttccataatggctgtactaatttacattcctaccaacagtgtaattttatagtaagtcttgaaacgagataatataagtattctaactttattccttgtcaaaattattttctcaattctatgttcttttcctttacacttaaatttgagaatcaacttgcaaaattctatcaaaaaaacctcgctgggatgttaattagggttgcattgtatctacagaacaattggagagaattgacatctgacccatgaacaatatatatccctccatttatttgtcttctttaatttctcttagcaactttttgtaattttcaatatagaggtctgacatgttttaaatcaaatttatccataagtattacaaatttttgatgacattgcaaatggtatttttattcgatgtttaattatccattgctagtatatataaatacaatttgtttttgtatattgactttgtatattctgagatcttgcttagcttatttgttagttctagtagctttttttgtagagtcctttgatttttctaggtaaattataatgttgtctgtaaataaagacggttttacttcttcatttcctacctgtgtgtcttctatttctttttgctgtcttgtttgttcgtttttaacttttattttaggtttgggggtacatgtgaagatatgttacataggtaaacatgtgtcacgggggtttgttgtacatattattttatcacccaggtattaagcccagtacccagtaaatatcttttctgctactctccctcttcccaccctcccacgtcttcttactgtcttattgcattagctagaacctccaatggaatgttaaatagaattagtgagagcagacatcctttttgtatcctttttgtttgtttgtttgtttgtttgagacagggtctcactctgttgcccaggctggagtgcagtggtgcgatcacactcactgtagcctccacctccccaggctcaggtgatcctactgactcagcctcttgagtagctggaactccaggtgcgtgccaccaggcctagctaatttttgtattttttgtagagagtggggtctcactatgttgcccaggctggtcttgaactcctggactcaagtggtccacccgcctcggcctcccaaattgctgggattagaggtgtgacccactgcacctggcaccctattcctaaccgtagtgtggaaccattcagtctttcacaagatgatgttagctataggcttttcatggttgccctctatcaggttgtgaaagttcccttgtatttctggtttgctaagagtttttttaaaattttgaatggatactggattttgtcaaatgctttttctgcattggttgagatgattatatatacatttttaattttaagtctggtataactgcatattgcattgatcgatttttgaatgttgaactaaccttgcatttccaggataaatcacacttgatcatgatgttttttccccttttttttgagatggagtctcactctgttgcccaggctggagtgcagcggcgcaatctcggctcactgcaacctccacctcctgggttcaagcgattctccttcctcagcctcccgagtagctgggactacaggcacgtgccaccacgcccggctaatttttttgtatttttttagtagagacagaatttcaccatgttggccacgctggcttgaactcctgacctcaagtgatccacccacctcgaccacccaaagtgctgggattacaggcgtgggccaccgctcccagcctatcctttttagatattgtgggattcaatttgctaaaatgttaagagtttgaaactgtgttcaggatggatcttcatctgtcattttcttttcttgtgatgttttttatctggttttggtgtcagggtaatactggccttatagaatgagctgagaagtgtttcctccaattttttggaagagtttgtgtagaactggtattatctcttccttaaatgtttggaattcacaattgaagccaacttggtcagcccctctatgattcatatgggccctttcatttttaacatcttgcagttctaataagaccctgtcatcaatctttttatgttagatatgtgtgtctcttctctgtctccttatttcttgtctgtctttgcctttggcctgtttcccatactttccattaggtgaatgtctgacaatctgagtctgtaggtgctgggccagccttctcagagaaagatgaggaaactgtttcaagtcatagtttctcccaacactggtgtgttttagtaaaaaaaaaaaacaaaacaaaacacctgtaatctgccttagctactaaagtagataactgaccattgtccaaaaccagtgggttcaaatcagtggccataggccattaagtagagcccagttacccttgaaggactgggacaagagttaaaatgtctcattttcagacttggcatgggcactcttaagtgtaggtctctctgtttgactctgtctcagtttgactctctgtaaaattagtaactgaacccctaaatcttctaactccaaaactgaaagtaaataaacaatagctgcagagggaagcaggccaaataacctaatatggaggtaataagacaacttatattttcagtgaatatttgactttaaaacctttgaaacttgggctgggcatagtggctcatacctgtaatctcagagctttgggaggctaaggagggaggacggcttgacaccaggagtttgagaccagcctaggcaacatagcaagatcccatcgcttcaaaaacttaaaaaaaaaaaaaaaatagccgggtgtggtggtgcattggtgcgtgcctgtagtactagctaccctcaggagactgaggtgggatgatagcttaagcatgggagcttgaggctgcagtgagccatgattgtgccactgcactccagcctgggtgacagagcaagaccctgtctctaaaaagaaaacaaagttttgaaattcaaattaggtagcccacgaaaattggcatgtcttgagacaaaatgtggagagataaaaatgagattcgtggttttttttattttatttattttatttttttttgagacggagtctcgctctgtcgcccaggctggagtgcagtggcccgatctcggctcactgaaagctccgcctcccaggttcgcgccattctcctgcctcagcctcctgagtagctgggactataggcacccgccaccgtgcccggctaattttttgtatttttagaagagacgggatttcaccgtgttagctatgatggtctctatctcctgacttcgtgatcctcacgcctcggcctcccaaagtgctgggattacaggcgtgagccaccgcacccggccgcgatttgtttagatatggaatgcttggaaagtaatgtttcctagtattgctgtgccacccccagaaaaacaccatcacattataatgaagaaaaaagtaagatactgagaggacccaatgccaggacaaatatgaaagtacttttggacttttaaaataaagatttgctagaaatatgaagtagaattctagacacaatggatggatggtgagtagctaccaaagtaaatgggcttagagtgtctgagtgctggaagaaagagcttttcaacacagtgtttgtcagaaaatggaaaaaggtttgaaagaagcttctctgagcaagagtgtttcatctattcactggacagacagttatgtagcacttaactctgggccctgcacaaggccagggaaataattaataaatgacgctcagctggaggtcactcttctggtgagccgcagagataagggctcctgttatctcagtccccaaagaagaacagagtcttgcatttcttccctctggagctccccagctgacccctgaagtgccttcacctacatcctccttttaaatatgtttcaccaattctttcagtcatctcactaatgcgtgcccaccacctggctggatgtgccggcataagtcatcacagtcctaagctgcctgctacctaccacacactgtccccatgccaaaccaataccattccaactatcccatttattcaaactagatgtagacacatcaccatgttctgggaactctgaagaggtgtggtgatggggcagaagcaagtgaatatttccggcaacacagaatccaattcatggtgccattctctccacttagcactgggtatagcagttggatagcttagccttagaacctgtcctcttaatcctatttgctattctctcactgtactgtgcatcttgtcaggaagtaggggctcttgaatagagccatctctgcccctgtgtcagccaccttatctctcttcctatctacccttgacctatctttgacctttatttgactttgcaccgtcattccctcatttgagcttttgttagttccccacaataaaaggaatttatgaaagcttgtgatgtatttggagagtttggctcttggagtaccccctctctctctttcaactcagagaggttggctttcagcagccaaggagtgaggaatctggtctcacacttgaattattttctgagcagtctcctgtacttcaaagacattagcctgagtgcctgggtaaggagccaaggcactaattgagtatttgagtaaaaagactttgaggatgaggaagcttgagggccaacagatccaggatggtgctggaaaagccagagttctggtgttgtgctgcccaggtccaacagaaatctagttagatatgggtgctttgaggaggaaagtaggggtgcctgctgaatacagacatatgttcacttaggtacaggccttttggggccaagtctcactccatgataccataggagaggggtaggccttgttaccgctgagaggggaaggttaaggttgaaaataactctgggaaccactgaggaaaagtgtgaatggtataataattataccattgaattatatgaattataatagttcatcctcaaaatccaaggatctgttgaacacaaaatttattagtcaggaatcagatacttgctcagcacttatgcactgtggattgaaaataatgctttctccctgatggaatgttacaaggttccacctctgatttttccaagtctgtttagaaagataggtctgtacattgcctgttaaaatccacccaactctcccacgaatctcagctgcttcactgaaatctctttctttgtcttccccatataagagcaggggtaattatggggaatgaaagaaactcctagctttgagtccaagaattgttagaattctagaaaacctctacctactctttgcattttccaaaatgggaaactgaatataagaaaggtaaaggataaccagtaacacccaataacacctatctattatcaataaggttataattgtcaccataattgttatcatgactattatttcttcttttttaatacagtcattgcttgattatttttctcttactaaaattttttgataacctatcccactaacagtcccttaagtcacttctcttatataacgctattcttcttcagtcacaatctagctattagattacctttctctccctttatagaaaattttctctcacttggagtttctgacttctctgaaaatctttaaatagaaaattttattctggccttgaaccatgaggttcataaattttattgccctacttaaaaaaacaatgtgttccctactccactgtgagatccttgaagtcaaataccatatgtcactcatttaacatcttgaatgcctatgggatagacatgtgtctgggccagagagaatgttaaataattgttgaataaattaatataacatgtgaattacttcatttttaaaaatatacatttagtattaaaaactatattaaggcacttttctctatacttccaatgcagtacagctaaaaatgctggacattatatctaaaacaaatgtagcaagattgaaaagtggagagaagaaggcacatgggctaggaaagttgggatctaagaaaaaacgtaacagaaaacctgagttttctttttgcttcacatatcttagacctggagctgaagaagccagcaaccaagaaatgccaatggaagcagaccaaaaaaaaaaaaaagcttgatttgtctagccaaaagacgggaaaaggggcagcctagcaaaacaaaaaagctttaaacaataatccctctactccagcctaacaccatgggaaaaaatgcaccccacttgacctttgccaacaaaggcctactggggagccaagacttctacactcacccagctgtaacaaggtgctccaacctccccgcctcccatgctgaggtggtgtcagagaaaacagtaggaagccaggaatttcttcccctctcagcagtaacaaggcctacccctcccccatggtgtcagtagagaccacatagggagcctggactttcactcttgcccgggtataacctccaaccacctctcctactcctggcaaggtgccaaggtggtgtcagtgaaagccaagtaggaaactgggactttcaccatcacttactgaggtaagaccacatgggaaacagtaacaaggaacccctactcctcccaaccaggaagatataaaaagaagcctagtagggatcttgaatacccacccctgctcagcaataacaaggtacccttccttcttagagtgtcaatagaagctaagcagggaacctggatttccacccccatttggtagtaatgaagttgtccctcaatggcacagtatcagaagaggccttctaaaacacaagatttaaataagatccagagtctcatatctaaaatttccagaataccatagaaaatcacgaatcacaccaaggaccagggaaatcttgacttcaacaagaaaagactatcaactgacactaacatgaagataacacagaaattgaattatttggcaaggattttaaagcagccaacaaaaaatgctttaacaaatcattgcaatcacacttggaacaaatgaaaaaaatactaagtctcagcagataaatagaagatataaagatgaaataaatggaaaattttggagctgaaaaatatataaccaaaataaaataagcccactggatgggccccacagcagatgagagaagacagaagaaggaatcagtgaacttgaaggcagaacaataataattatccaatctggaccacagagagaaaatagattgaaaaaaatggaaagagcctcagatgcctgtgaggttataacaaaatatttaacatttctgtcatcagaggagtcccagaagaggaaaaaggcagggctgaagagatacttgaagcaataattgctgaaaacttcccaactctggtaaaaacataagtctgtagatttaagaaactgagcaaatcccaaagagaataaactcaaagaactctatgccaagacacatcatagtcaaactttcaaaagctaaacacacagacatgcacgtgcatgcacacacacacacacacacacatcttgaaaacagtaagagagaaatgacacgttaactctaggggaaaaacaattaaaatgacagaagatttctcatcagaaaccatggagggcaaagtgctgaaataaaagctctcttagctcagaattgtatatccagtgaaaatatccttcaggaatgaatgaggaaatcaatacattctcaaacgaaggaaaactaagagaatttgtccccaacagacctaccctaaaagaatagctaaaggaaattatttaaccagaaaagaaacaatagaagaaggaatcttggaacatcagaaagaaagaacagtggaaaaagtaaaattatacataaatgtgacagatattataatataattgatttagatttcttctccttttgtgtttttttttctttcttttttttggagagaggctctcactgtgtcacccaggctggagtgcagtggcacaatcatggctcactgcagcagcctcaacctcctgggctcaggtgatcctcccacctcagcctcctgagtagctgggactatgggtgtgcaccaccatgcccagctgattttttgtagagatggagttttgccacattacacatgctggtctcaaactcctagactcaagtgatctgcccacgttggcctcccaaagtgctgagattacaggcatgagccatagtgcctggtcccttttgtgttttgtaaattaggtttaacagttgaagaaaaattataataatgcctaatgtggttattaatagatgtagaggaaatatttaagataattttattataaatgagggagggtgaggagatataagggaggttaggtttctacactcctctccaactagtaacatgtcgacaccaatgatgttgtatacatatgatgtgataccattatatatatataatgtgatttctttgagtacatttttcagtggccactaaaaaaggtatacaaaggaacacactttaaagcacaataaataaagtggaattctaaaaacttttaaagtaacccataggcaggcaggataaaagaatacagagaaactaaaaacagaaaacaaacaggaaacaaaaataaaattgccctaatgtatcaatgattacatcaaatgtaaacgatctaaatatatcagttcaaagacagagattggcagagtggatagaaaaaaaaatcatgacccagctatatgctgtctataagaaactcacttcaaatatgtatttccagggaattatgctgggtaaaaaaaagtcaatttcaaaaggccacatactgtatgactccatttatataactttcttcaaatttgtgattgctaggagttatgggtcgtgggggagtgggctgagtgtgactgtaacacaaaggagatctttgtggtgatggaatagttctgtatcttgatcacaatggtggtttcaggaatctacccatgataaaatgatacagaactatatgcacatattgtgccactcctaattttctggttttgatatcatgttatagttacataaggggaaacttggtgaagagttcatgggacctctctggactatcttggctatttcctgtgaatctatagttatttcacaattaaaaatttttttttaaatgaaatagattaatttttaaaagctatatcaaacataatttaaagtttctttgactgtacaaaaaattccttataagaataatcatcagttttcattatatcatagacattcagaagggtcaaataatggtcagttctagttataaaatgtcagtaagatgatttgctaaatttaattattttttttctctttgacaatacaactgagctacttttttactctggccagaataaagatacatatatcataaatgagatcttgaactggcactttctgctttcccgccttctccccacctttaaaaataacatcagatttattgagatataattacatatggtaatattcacccttttttacatgctcagttctatgaattttgacaaaagaataccaccatcatcaagatatgtaacatataaagcttagaaaagagagactcaagatgaaacttgataacattttcattacccccaaaaagtttcttcatgtccctctgtagtcaattgtctccctcatccctcctcctgccacctactgatttgttttcctgtccccatagttttgtcttttctcgaatttcctgtaagtggaaggaataatttgagtctggcttcgtttacttagcataacgcctttgagattgttcaagtttcagtagttcattcctgtctattgctgtgttgtattccattgtattaatgtgtattcatttgtttatccattcaccagttgaagtacatttgggttgtttccagatttgcacaattatgaaaaaaaaagctagtgtaatcatctaggttcaggtttttgtgtgaacataagttttcattcatcttgagttaatatctagcagtgggttttcgggatcatggtaaatgtatgactaacttcacaggaggctgccaaactgttttccaaagtgagtactgttttgcattgccaccagcagcgtattacatttccagttcctccatatcctcccagtattaggtattatcattttgtaaaaacctttctttgctgggcaccattgctcacgcctataatcccagcactttgggagactgaggcaggtggatcatttgaggccgggagtttgagaccagcctggccatcgtggtgaaaccccatctctactagaaatacaaaaaattaggcatggtggcgtgcgcctgtaatcccagctacccgggaggctgaggcacaagagttgcttgaacccgggaggcagaggtggcagtgaaccaagattgcgcctctgcacttcagcctggagacagaatgaaactctgtctcaagaaaaaaaaaaaagaaaaagaaaagaaaaaaggctttcttggtaagggctatctcattgtggttttaatatgcgtttctcaacttattagtgatgttgagcatctttttatatgcttaattactattcatatcataaatgtatgtgcacatgtgtaattgtgtaatctctgttcaattcttttgcccatattttaagttagattgtttgctttattattgagttatgagagtcaactcactcttgtatggtggataccggtctattgtcagattttgtgtgctgcaaaatttttctgtctatggcttgccttttcattttcataactatttttgaaaagcagaagttttcaagtttgatcaagtctaatatatcaaatcttttcttttatggatcatacgatttgtgaatatctgcaaaatctttgcctaaccaaaggccaggaagatttgtctcctatatgttcttctagaagttttatagttttaagttttacattaagtctatgatccattttgcattgatttttaaacatgatgtgattattgatatttacaaagttctcttcttatacatataattttatctgattttttttttttctttagatggagtctcactctgtcacccagcctggagcgcagtggtgagatctcggctcactgcaagctccgcctcttgggttcaagcgattctcctgcctcagcctcgctagtagctggaactacaggcgcccgcccccacacccagctaattttttgtattttgagtagagacggggtttcactgtgttagccaggatggtctctatctcctgacctcgtgatctgcctgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaaaaaaaaaacaaaaaaaaaacaaaagaaagaaaaagaaaaagaaatgtttgaggcaggcacaagcagaaattttaatctccatttcacagatgagaaaactgaggattagagaaatgctgtgtgacttctcaagatctcacagctgataggagatgaaatggcaaggtaagaggtgaaattgtgataaaaagttaaggtctcctgctgtcccaggctagtacttttgaagccaggcagagagggctcagggtaaggctccaacaaagtaaagattcccaatggggagctgagcaacctatttggcactgaggtaagagacacagccagttgactagccccagactgagctcctttggcccattggggctccacaattggagagagccagaagttggcccagtgcctagctcatgtgtcactctttgatgatgatgatgaagagctggaagtgttcaaaggagagttctgaaattaatttcagagttagaaattaaagctaagaggaaaagttaaggaaacgaagattatttggcggagaaaagagaggctcaagatgaaacttgataacagccttcagacgaaataaaaaaaaaagcttgaactttccttctgagggctgagcaaagggaaacagtctggaagaatctaaataaaagggcaagttccttcctccttagtgaggattgttatagacacttaagagcctttagaaacaggataatatctgcttgagtttgaagtcaggaatttgccaaacatgggctctgatgacggatttcagcatgagggttacatgactcttgcacagtgtccttagaaatctttaggtggcctatgaacttgccttgtatcctagtacaattccagggggcttttgtctgtggccttctctactccttagtcttatcgtcttcacagggttcttctaatgctggagacaagcctgaccttagctcctgaaagcttaaccccaatgttttttgcccctgaagccagtggcttagaacctaaggctatagatctggcttagcatccctggaaaggcctgaaatattgactagtccaaatcttaccgcagtgatagaatcccctgttttatatctagtctcttcttgcaaaactctctgaacatcagggactagcaagctggcaatgcagaccaatgcaatgccccctgtgaaaggccagagaagaagagctgagataccagcagtaccaccaggcactacactaagctaaagtgtctttgcacttgttttctctgcagcatgggtcggagccctcgcgatgggtatgatcttcttctgttctcccattgtgagtatattcactgaccgtttgggctgccgaatcacagcaaccgcgggggctgccgttgctttcattggcctccataccagctccttcaccaggtaaggctaagagttggtggttatttccccaaggctgagggttggtttttttctgggctttagctagggttacttttctcactgcagaatcccctgtggccatggccctgtagggccctcaaagatcctgcaccctggattcagaatccagtgaattcatctgggtagggtccccaggacacattggtagggaatatccccagagaggacctaagagttccaaagtggtaggagtactctaagcctggtagttcgtagagctgggcccaagtccggttttggccactgaatggcaatggaacaattgatgagtaccattgttctctctgtgcctcaatttctatatctgtaacatgaggggatttgaccatatggtctttttacatctctttcaactctgctatttgattccccttcagtgtgccacacatctcacaacctcactttccatcccaagattgagcttctcgagtgagcccatgtgaacacctagcacaggattcccaaaggaatcttatgctgaaaaaagaggtcaactgagcccaaggatgtttagcatttctgactcttttccagatagctcaggctgctgacatatggatgatttgggacagataatgatttacatcatgggcatcagaaggatgattagcaatatcccttactgagatacaaacccagaacccagctacccagctaggcctgggctaaactgaaaccctagtcccactggttccactggcagaacttggcagtatcaggtgagaagcaggctctaggttcattttctgctttcttttctgccagccctgcagaagaatgtgtgtagggtaagggagaataaataccctaaccacagcctgaggaatatggaattcctaaagaactctgttgactttctgccaaagacactttggaagttatggtacctcctacttccaatctgcttgggccgatgtaggggaatgccagcctggaaacacagaaatgagaaatggccgtggtgacatgtctgggatgaggtcagagctaatttgtcagagacttgctttctgagcttagttacccagaaaagcgtcatggctctctaggcctaaggttccactcacagtagagaatgataattgtgttttgccttaactgggccctgtgaggtaagccagctttctttatgacttgagcatttccagctgcccagcctaccctacagcagagcttggatttggcctgcagtcatttcttggcttcgtcctgtccaactgggacagagaagggaaaaaccgtgtcctgcctggaaactactcagcactcccagggcagcagctccaaaccttttcagaacccctctggtggtcagcctcattcacccccagcaagctggtgcctggctccttgtggggaggagctaggcttcaaaagcagctccagtctcagcactatacagcaaaggtctgttttttaagaccgagcagagcaaagtgtaaacggattagcaacatatggattccatttcccttccaatccacatgggctcaattacaggaggggaaggagctcagatgtggtgttttcttctggcacgctactgtaggcacattggagtaggcgttctgttctctagcccctaaccttcttctctacccgctttgttctttctgtaagaggatcttcagagccaagaaactttctggatggcttcacatccagtggaaaaatggttcttctcatggctagagctccaaatcatccttcctgttgtctcaatcagggccctgagttcctccgaatgacatggaatggggcaggatgcaggcagggctggtggggctttggaaaacccaaacaatgggcatccatccctggggcccagctagaagtagatccaccacatggatctaaaccaaatcctatgtttttcccccactggccccttccctgaaggtctaacacaaggccccttggataaggcccccaagccaggccgatcccatagggtacctagaatctaatgggcacaggcccaaaggaacctgacagaagaggaaccgttggcttagctatgtgttccaagcagagacaaccctttcaaaaccaaatccttgctcacgtccagtgaataccagcagatggaaagcaatagtgatgacagctatcttagaatcatgcaccatatcttctctgcagcttaggcccagttctttagtatgaggactgggtctatctccagagaagaactgcctgaccaagaagagtattaggtaatttagtggccagataagaactattgcaaaatatattgaggcatcaaaaagaaaacaaaattctttactaggttgtgccaatattatctgggggcatatggctggccaagctgaccttcctattgcctttccccttctgaccctttatgttacagaggcttatgtccacagcagggcctatgagttttaagccaggacctgtcttacttggccaggcccacaaattctttgaggctccacttcctgtcaaggagccaggctactctagggaacaaatctataccatatccagaaacaaaggcaggactctaaaagttaaagagactccttacctaatgattcccgctgagatcgtccagggcctagtgtaaagggacttgggatatgtggaccttgggcagggtttgggagggcgtatgtctcagaagaacatcagccattctctgaaatattaatggccttagcatggagaaagacactgaagagtcccatggaaggtttcaatcttccaggattttgacttcttgcagacctttgttgctacctgggataaaagctttgccaccaccaatagtaaggtgaggctagtctctctaagacaatgactccctgtagcccctcatccagcttttacatgggctagttctggctttcctttgaacagtcctctttgatggggtgctatgagtcatgctagagtcacacagacctggattcaagtccaagttttgctgattcccagttatgttaccttgggctaattattttacctcgctgagcctctgcttccccatctgcaacacagggatcagaaggccctcttctttgtctgttctgagggtcagtggcaagtggggctgtgggttaagggcggaggaatggaagtctcaggaagctgacaggggagggcaggtagattgctggtcaggctgctgaggacagctcttggtatttctcccacagctccctaagcctgcgctacttcacctacgggattctctttggttgtggctgttccttcgcctttcagccatccctcgtcatcctgggccactactttcaacgccgcctgggtctggccaatggtgtggtgtctgctgggagtagcattttctccatgtccttccccttcctcatcagaatgctgggggataagatcaagctggcccaaaccttccaggtgctgagtaccttcatgtttgttcttatgctgctttcactcacctaccggcccctcctgcccagctcccaggacaccccaagcaagagaggtgtccgcaccctgcaccagcgctttctggctcagctcaggaagtacttcaacatgcgagtgttccgccaacgcacttaccgcatctgggccttcggaattgctgctgctgcccttggctactttgttccctatgtacacctggtgaggaataccagagtgggcccaccccacctggccccaagaagctaccctcaacctgcctagattccagagggtgggggtgggagacattgaaagggcagagctgggacctttgggaaaagaaacaaaatattggttggagagatccagagagggaaaaagagagaggttgagggaagaccttagtggaaaatgggggcaattccacagggggaagcccatggaccatggcttctcccacagtaaaaatttagatagattttgaagagatacgcattgccaggatgcaggagactggcccgggtgacccaagacaggattctgtggaatgctggtctttgtggtcaaatgattttgtttaggaagtaacatatactggatctctctagctttataatgtgtagtaatctcttaaagggactaaaaaaaattgtaggaaagaaacccattcagctttgtttaactcaccatccaccaaacttatgcaactacagaactgttggttgtagtccagctgttatcctccacaggcttcatgtttcctaaaacacactttggaagagttgcctggaagttgctggattcttctcccctggtgatttgatgttgccctaggctgtcagtttggggtaagggaatggggagattgtagagaaacccttggattttctcaatcatttaggctattttctgtcttgctggggcttagaaggggcgtggaggtacccaccctccttagctgttgctcagaagtccagaatccagacagccaagggataagcagccagagagcttgtcatggaggtagggctacaggagagggggtttctgtcctgctccaggaaagtaagcagtaggggattctggatatgcctacagttaaccagtcagctcctctttctcctcctgtttctggggatccttgtgctatgcttttcagatgaagtatgtggaggaggagttctcagaaatcaaggagacctgggtgctcttggtgtgtattggggctacctcaggccttgggcgtcttgtgtcaggccacatcagtgactccatccctggacttaagaagatctacttgcaggtgagtgtgaccacttgtccactgtggggagaaacagcctgccacaaatgcaaggttatccacagcctttgggatagaatggtagcttgttgtgtcgcatgggaaagtcaatcaaattctctgagcctccatttcacctgcttttaaacaaagaaaatcatccttgttctgcctcttttaccaagattgagtgaggattctgtgagagcagtgtatatggaacctattagaacacgtgtaaaggaagattttattaataatggctctccatgctccaagactattttctgtgtgaactaggctctggtctggtctgaatacaggccactgttcaggctgtcagtctttatctacctggcagcagtattgcctttcttacctgacttatgatcctgcaggtgggtttatgaagtggtacccaagtgcagagccctgtgaaggggcaaagatagcccccaaaatcaagtagtcacaagtaatccatcaggaaggtgattgagttctgactcatttatctcctgggaaagccctaaaagcacatgcaaggggccctagctacacttacagtggtgatttctctgtctctgatagccccaagtgccctcctaagtaccctcaaatatcttggatggaaatatgattaacttttccttaacttttttggtgttagattacaagagttggtaaatctgctttgtcagaggcagggttgcttttaaggtccatccaatccaacctcattacagtggtggagaaacagagggaaaggctcacacagacagtagtagcagagctgaactcctatgcaacacacttctcatattctaccttgccctaagtgatggcagagccaagtctcagagatgataagtgacttgaccaaggtcaaaccaagagataatcttgtgattgagataaaccaattgagattttgaattcctgtgcaaatatcagcaagtgctttatctgggtggctatttgcataggaatatgtgtggctttcccagcctcacccacatgacacccctgtgagtcttccctgccagtattagcagctccaagatgccaaagagttctggaaatcagggtaatctggcattgggccagggctttatcttgagaagaggcagcagcccctgcctagtcgtataactcatgtgattcttactacagtccctaggagaaaggtagagtctgagcagcttttgctttctgttatacagtgggagtccaagggacagggaggcattagccagttagaggccaagataggcttaggacccagtgcctctgctgaccacccacccactgctcctgccccttttccttactcttacttcaccgagttttacttagaataatataaaataatcttagaacattatagctgaaacatatcttcatcaactagtagttgaacttcctcattttacaaattgagtgtcttgggccaagagcacaagacaatggatgaacttctttctcttgagtttgttaagatactccatcacaggaatttgcccccctttctccctgcatgtaatgcaggagtacaggcctaggggaggaaacgagtgtacacaccttcaggttctgaagagctatccactagactctgtggctcttaatgttggtaaagacaagcacatatctctggcttcaagcccctggacagtctgctggaaaggaaatagcgacaggctgcaggacagcctcactttgtgccaattcttgaggcctgtttctcacgtccaagagggattttaaatttctgaatcttgaggcctgtttctcacgtccaagagagattttaaatttctgaaccttggcaaagcctcatggaggatgtttaacagacagctagatacaataggtaatacttagacctgattaaaatcagttaatagggtcctttgtgttatataatggtattaacttttaatttccataatgggctttgttgataggtgtgtctggttttatcccatagttgtgtgtgaatctcttagaggagaagctcaggtaccggggttcttattcctagcttctgcctagctacctcaaaactgcctgggcaaagttcaaagtctcccaacaaaaagatgtcctcagatggcattatcctctccaaaaatcaactgatcaacctaaaaaactcactgccagcaacaacatagaaaatctttagggcaccaaataaccttgacccccactccttccatgtgttcttggctaagttggcttgcttgtgtgaactactggaaaatccttgggcctattaaggccttgatagagagatcagatcttagccctgaccctgggatgacctggctctgacctggctctactggctgcagggggttggcagcagcgggatgggggcagggttcctttctctgcctgaagcccaggtcttcagtctagctggccaacacaggttgcaaatgaagaccagctgtgtttgcagcagcccttttctctgtggagaaggaaaaaaaaaacaacctctggaaaggcagtttcttcattttggagtcattttgcttagcccagagaaagcccagtggctagtcagtgttcctgggttggcttcattctccctagacatacaccttcccagtggcttggttcccctggaaggctcctctgttgccttctcagggtgtccagccaagcccagaggcccccagagccatgtgtctgagatgtctgagataggcagtgcagtccatgtcctaaagcataggaacctgggtgaatgtcccaatggtttcctttatgccaaggtattttataaaatcagcccccacaaaaatgggctctggctccttccccatttcaagaagctgtgccttccacttacaaccccatctgatcatcatgcaagccatcctcatgtcctcccttccctctttccatattttacttggatctgagaacaccggtatggcctgatcccagaccctgatccctggggaagccaaatacaggctcagaaagcagaaacaacaattccttttatcttagggtctagtgcaagacaaacttcttgaggccaggggccaagtatcccccaactttctttttttaatcccaacagaatcacagttaagtaggggctttcttggactttgaatccctcagtgcaagactttgaaagggcctaaccattcagcccaactgctctctctgttgacaccttccccctcccaccaccccattttatagatggtagaaatgaagacttgagaaaggagatgtgatgctatgtggtcttggctggccagcacaacctgacctcaggcccttgtttctccaggtcctttccttcctgctcctgggcctgatgtccatgatgattcccctgtgccgggacttcgggggccttatcgtcgtctgtcttttcctgggcctttgcgatggcttcttcatcaccatcatggcccccattgcatttgagctggtgggcccaatgcaggcctcacaggccattggctacctcctgggcatgatggccctgccaatgattgctgggccccccattgcaggtgaggctgatattccagggagggcatgaatcagggagtcctgttttccctgggtactggcactcctgagcatctctccttgaggccccttttcctcttatcgtctatttaagcagctttgtcagagtgcgtgaaaccccttatcactactggtggaagagattaaacacagtacacacgcatggatccattctgcgggatggattttccatggtggtatatctgtttcaataggattttatttcagacagcagggatccttccagcggggtggagagaaaaatgagtttggctttctgacagttccactgatctagtatcctctcactctctccacaggcaagtgattatttgcaaggtagttgggtaggaagagaagagaaagcaggctctggttttattaaaacctagggacatcctcctcctcctctgctggcttctgaactgagcctgtagaagatatttgattaaagtaataccccagaattaagccagtgaggctcaccttcagcaggaaaagtgttgacttgccatctttcagcactcctggttttctccctccattttcccagaagggcactgttggtatcccagggaacgaggaacagaaaaccaatgacaagagaactccaatttcttttcttttctcttttttttttttttttttgagacagagtcttgctctgtcaccaggctggagtgcagtggtgcaatcttggctatctcagctcattgcaacctctgcctgctgggttcaaacgattctcctgcctcagtctcccgagtagctgggagtacaggtgcgtgccaccacacccagctaattttttgtatttttagtagagacggggtttcactgtgttagtcaggatggtctcgatctcctgacttcgtgatccacctgcctcagcctcccaaagtgctgggattacaggcgtgagccaccacacccggcaactccatttcttttctgtaggatttattgtaaacattgattcacgcattagcttctcctaggctggtcaaatgagttaattcaacaaatattcttcgaacacaaattatgtgcaaggtgatatgagggcactgtgtgacagtggcaaaagctttcactcaggcttctgggcaacagccacactacccattgggggaagggggcctctactcaccccctgatccaaacagtgccccagaatccacatttctttccaatttgcttaactcctgagtaagcaaaaggccaagggcctttttgccttttctgaatactgtttctgggctctgaggtactacgaggtaccacatattagcttctggaagtgagtagggaaggccttgcatcccatgtcaaacatatccttggtttggcagcttggagaaacccagaggggacaaccatatatgtaactgaaaggaacacgtatagcctcttgctaggacaaatggaacttcagagaagggtcacttcagagaaaaggaaaataaaaactcatctgaaatgtaccacaggaaccatttgtgggggcagggggcgggggtaggaggctgggaaatatcactgtggaccaagacaacacttggccatcttctgtggatttcttttaaactaggtttcctcctaactccgtaactaggtgtgactagatcttagattgatgaaagtcataaatggagaaactttaagagaagcttcattagcttctttcataatgagcattcgctcaagggcctgcagccccaatgcgttgaagttgagggagctcctgagttaaggcaatacacgccaagattatctggataggcactgtgatggcccctagaacgggctgagagtacctttggacagtagggcaaagctgagcttgacttgtctctcttgactgtttcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcattaactaaattctccccagaatgcttttaaattttccagggcctttctcctcccaggatctgggaaagcttgggaaccacccctggcctttggaacctctccatatactttctaagctctgggggaggaggaggatgggacctcctggacccagcttgttagtcacccactataatcaactgccaaaggtgctactgtgtccccaggagcctaatagggtaggcccaaatctctgtttgctgaggaggtcattgccatccatatttgggagccactgggtggaggggcagggaggcaaaatgagacaagtagccttggttagtcttagagttgctgatgactgtggcttcccaagaactgggtacaagcagtgcccttattgtatggttggttaacagtctgctcccctcttcccttccttctttttttcctctactgacttctctccatactctttcccctctatttctttgtatgactgtcatagacacatgggtgcttgaagaaaggagggacccggaacttgggccaatcagcctcaccttgtcccagtccactcctaacactagcatcagtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcaggtagaggaggactgatgacacgagctgccatggcgggaggaggggcagtagttattgatatggtgagccccatctctcagttttcatgacaggtctatatttctacctgggccaggccaggaaagagactatttaagaaaaaaaaaatcaattcctagcctggatcccaaaaaggtacaggcagcagttgcacatagggttggaaaatttcttttgggaaggggaagccatcccagcctttaccacccaatgtgtctcccatgctgggcatcctaggccactttgcttagagggcattaaaggtgccatgaaaggtagactctgaaccactttgatccctctgaagtaggtgactgatgcctccttatgcccaggctctggcaacagtcttactgaagaacattcccagtgcccctggctaggggcagagggcactgccaggctgtgttcagttagcacagctcacctcattaggagctcagcctctctcctcactctgcctctttgtgtctctttttctcctctctgagcctttgtctattgtgttcctgtcacccaccctttcatcatctttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaatttggtttgggtatgtatgttgcctacaaggaagaaatagtcttaacctgattaatagcagaaagtttgacttcagagctgaagtctcctttcaaatcaaatttctgccaggttctatgctctctgtgagagcagacattagaaaaagagctatataggggtttggagttggttgactatttgagattggatttttaaacaagctctgaagtggaaaagtggttacttcacaaaatgagaatgtggttacttgctgagttggaatggaggccccaccaaggccacagccttgctacaaatgtgccatattgaaaactggcattaataataatccaattcagctctccttccctctcccttatgttattgatggggaacctaaagggacttatatggctggctgacacagcctggcagtgacagagcctggaattaaggatgatgcaggagacagacctataagaatgacaaagctgagagtaaccttagagtctcccttgtccatcctgtgcattgaatttaagtggagagactgaggcctagaggtaggaagagactgcagtaggttcacacagttcatcagtgacagagcaagatgagacttgaactcatgtcattgacttccagtacagtttacacccctggttttacagatgaagaaactggccctaggagggataaatgacttgcccacttcattcaacaactgtgtaccaaacccatttccataagtgtgtcagcaggaccagctctgagcaaaaatgaaagtttagcaaagtttaacttttagcataccccatgtcttcatgattactctcacccgcaactgacacatacttttggtattctgtctcccagtcactccagaccatgcaatcttggcttggagacctggtttcacctactgtccctccacccccagcaactcaagaggtacaaaaaaaatccatctccaaatggccacatactgggcagggcaggggcaaagagaagtgactggtttccggttggaagaaggtggtttaccacccagctcttggctattgtttctcctcagactcagtgtagacaccctcaggctggcttcctcatctcctcccactgaggctaattactctgtcccattgcagggccccaggctctcccacctaaggtctgccccgctcccctagccccttccccagcagccccaagggtccagtctgtgtttgatcacccaggattattagatttcaaagctgtggaatcccataatttttacgagcatatgctctcctctagggtcttttcacgtctgaaaaggcggccagcagctccctgccacttctccacagtagcagtgcaggccagctgacaaggattacaaatccctagtgtctcatagctggcgcctagatagtgtgggtgacgggtagaataagagcccttgaagcaagttcagaaattctaataagctgaaatgcagcagagactgcagaggcacaaggaaagggattagatacccaaatcctgcaggggttcaggaggctatgcttcaaagcccctttgattcctgcctttcagctctctctagcggtcaccaagcgcaaagttctatgcctggttttcaagtcatttaagcagtcttttctagagacctgctgcgtgtcagacactctgctagaatccgggaacttcaggaatgaaaggaacataagtagaaaaaaaccagaagaacacaaagagtttgtactacctaacttccaagatacccttttcttctctgggcgccagtacccagagagtaccgaccttagcgccaaaattcggtcctctctgaggcagatcaggagccaccacgcccccagtgaaatggaggcggcaggaatcccacccccaacccctcttcctctccccacgactatcctcccgggggcgagagtcgcccggaagaactacccgcgcctcggcattggtttcctgctgagccccagccggataaaattagtcgattgctcacactaa

SEQ ID NO: 13414 - DNA, 11947 bp, Human
ttaatgtttctatctgaccacccccaggctgctaggggaaccctacctgccaagacatccaggccctctgcctggaggctgcatactgggcagtgctgggaacgactggttgataggtgtgccgggaagctgggcgattctggcagtgcaggacacttccggagtgtgaggaaaattgcgtcattggaacaaagtgattcctcacagagaggcacaaagtccgcatcaccacagaatcaaagatgtctcattcagcgctggagctataacgttctctgatgggttttgatggttaatctcatcaagaattaagcttgttaagggtggagctaacccccctctccctccctctagtccggggaacacggtgcccggtgggcgctcaaggactatgtaaagataaagttgataggggcgtaccacccccacatcccttcacataggaagaagactcacttctgcttacggctagcgtttgctctgtttctgtggaagtcgtgcctgctccaggaagagctggatcatccattcattcatttatgcatgcattcattaaacaggtattcactgactgtgcctcagacctggttttgggtaccaaggaagtttttcaaaacctcacagggctttgtagctataaagatatgtaaggatccttgggttatctgaagcccagagaagggagataacttgtccaagagcacacagcaagttgggggcagcgctgggccagtgctctgagctcctccaaccccgcccccacccacccaaggctagatctagatctacccactcctctccttaactcttcatcggctgtactcccaccctaaggagtcgaaatccccaccctagggagagacatatcctgtctggattgtccaaaagggaatgaaaggtaaaaatgaaaaaaaaaaaaaaaagtgtccccaattcaagtgcagtgcctccctggtgcgggcattccagcgtggcctggagtgagtggcagtccacctccagaggcgtcccctgggcgctcctagggactcgaatttcccacgcggctttttgctttatgtattcactgtttagacgttttcggtcaaagcattttgggacttccgtaactctcagagcgcgccagggagccgcccttaaagatacctagttactgatgagttccatccggtaaagcagagggtagtgggcggcttggagactcaggatccgggtcccctcacgctcctggctgagtccctggcttcacaggggaaactacctccgcaggccaggacccatctagttacaggatacctcgatgttacaaagacgaggcttccagcgcgggggcgtggaggcggctgccagccctgcccgcagcgtgctggcgacccccgggacgccccttccctcccgcgcctctgctccctagctggtgggagcagagcggcaccgggatcacttccaggtcccttgcaccggaggaatgggcggcagcagggtccggagtcggcccggcggggcccacgtggccagcacatcggtcctccgctcgcgatttcccttttccgctctcgggcacgaggtactgaacgccaggtggaagcacagctgtgcagctacaggctctgccgttcagctgccgcgggccggggccggggcctgcggcgtcgtgcgcgtgcgcggaccagttccaggcgggcgagaccgccgcagggcggggcggggcgaggcggccgcagggcggggagggcggggagaggcggccgcagggcggggagggcggggcgcgaagccgggggcgggggccacgcgtggggcaggcggtgctcggctcggctgacgtcggcccgccggcgccccaccagctccgcgcgggcccgggttggccaccgccgggcccccgcccctcccccggcggtgtcccggccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgaggtgagggactccccggccgcggaggaagggagggagcgagggcgggagccggggcgggctgcgggccccgggccccgggcacgtgtgcggcgcgcctcgccggcctgcggagacacgtggtcgccgagcgggccacgaccttgaggcgccgcttcctcccggcccggggttctcccgcggctggataagggtgatccgggcgcctcgttctgcccccgtcttcacagctcggggctggaggggcctaggggagacccacccggagaccctgcggccccgcgccggcctctttcccaacccttcggcggccgcgcgctggccggggagccgttggggaggccctggcggccgcgcagcaggtgcaggggcgcagagcctgggctcgccttggtacagacgagcgggccccggccttggcgccttcagtttccttccagtttttattttcgctgtgtctacagagcagatgacaccaatttggaaacccgcgagagtgggtagagctaagatagtcttgctgtagtagctgtgatattagatgctcggccatgacttagaggtgtttatttaaggactgtgaatgactcggtgatttcggaaaagcttggcttagatgaacggacatacacaggggagacagccctaaggtttgcagaaaaggctgattgtgctgtttgcgaagtcgaaataattggtgaaagtgtagaaggcagaacctctcaggaatgtctggggaggacaaagaatgtgttggctgactttgtttaaacataaaattgggcagactttaattgatttgtgaaatttttttcaaagtttgtttgaattagcccctatctcttctaacattatcctcttgtgctaattgattgaccattttaaataacttagctgttacagaaagaccgaaaggtgttcttcagtaaaatatattcaagtaagttacttaagtaacgccttaaaagatacagaaaagcaaaaaagtattggcgtattaaaaagaaatcaaaactttccaagtttaggcctgaacattgccttaaaaatatttaataaggcctcaaatgacccagtccgagactgcatgagcctatttattattaaattgtaaatattcttcatataaacaaaaatatataaccatgtctgtaacaaaaatggttttgctagcgttgttactctcttcccttctccgaggggtgatttaggcaacttcggaggttgacaatgccaagcagtcacaatagatagagctttaaagcaaattctatgcatgggtttggatttatgacaggcccgtcaccctgggcctgtcatagtaccccatgccagagcaaactgtgtccccgaaccattgcctggcctctgtgcccgtaggctgctggcactgaagtgggttgcacagtggaaaagaagaaagctctacctggcagaaatttttaaaggttaaaataaataattttaagaaagctggttcacaaggtgccacatttgatgaaagcaaaatacagtggcttttattgttactagagtgatgttcttgcttgtttttcttttttggtgaagttagccccaaattattctcatagctaagcaaatacgagagtgactgtaaggacagttggcattcccggaattgctaaacttggtaggcaacgctggtttaagaatactgagttctagccgggcgtggtggctcacgcctgtaatcccaacactttgggaggctgaggcaggcggatcacctgaggtcgggagttggagaccagcctgactaacatggagaaacgccatctccactaaaaatataaaattagccaggccccgggtgtggtggcacatgccggtaatcccagctactcgggagactgaggcaggagaatcgcttgaacccaggaggcggaggttgaggtgagccgagatcatgccattgcactccagcctgggcaacaagagtaaaactctgtctcaaaaaaaaaaaaaaaaaatactgaattctgatcaggtaacagcaactgtaatacaatgtgataagttgacttgaagattacagtttttaagaagtatatacccagctaatacatgaaaattaactcgtaaaatctcaaatgctccagacatttccatgatgcctgttggtcagtaaaaatcattctaagacttagtggaagtaggaaatgtttgtatggctgtgtataaaggctataatgtaatcccagcactttggaagaccgaggcgggtggatcacctggggtcaggagtttgagacccacctggacaacgtggtgaaatcctgtctctactaaaaacacaaaaattagccgggcatggtggcaggcgcctgtaatcccagctgctggggaggctgaggcaggagaatcgcttgaacccgggaggcagaggttgcagtgagccaagattgcaccgctgcactccagcctgggtgacagcgtgagactctgtctcaaaaaaaataaaaaagtctataatgctattttaagtttctaaggaactgaaactgctctgaaataaatcagaccattataagacttttttccatatcagtgagctaagtgcagataagcttctgaaacttgcatgctagatttttttggtacaaatatttgaaatgcttagtgtgctgccttggaaaaacctggtattttttgttgtgtccttatactgccaaggtttatggaatcatgtaccttatgcctagtaataattaggatgaccaggccagtgagtggttcatatccggggcatgattagctctgcgtgtgctcagccagtgccccatcttcaactcgatgtgttcctaaggtagacagcaaattccctattttatttctcagattgtcactgctgttccaagggcacacgcagagggatttggaattcctggagagttgcctttgtgagaagctggaaatatttctttcaattccatctcttagttttccatgtaagtattcagtttacatttatgttgcaggttaatcttaagaattgtattgctaaggcttctaagtgaatttctccactctatttgcattttgttgcatttcagaggaacatcaagaaatcatgaacaactttggtaatgaagagtttgactgccacttcctcgatgaaggttttactgccaaggacattctggaccagaaaattaatgaagtttcttcttctgtaagtatatgaggcccatgctggcagtgcagctgagagtgccaggcaagtggaaaactttggcaaggtctaaggaagagcaatgaggcttacatgtcttgttatggaatgtagaaattaattcactggtggtaaattaatagtgataatggtgatactcatatcagtggctagactcaaaagagcaggattcattgtgactgatgggaatgaaggtcgctggctattggtgtggtgtgtggtgaggctgctagtgagtcacctgtgaccactcttgtttcaggatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaaggtaagcgatagcagcaggcctcaaaagcgttgtataaaatgggcctggtattccccacgaggcagatacaagttgtgttttttgggcaataaatgctcactaaaggcaaatggggcgggggggtacatgacaacttcccatgcttttctgtttattccacgtgttaagccacatatggatagcatgacaccactcttctttttcagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagtgagttattcccccatctgagggcaagatcgggagcataagatatgtggattcttatcaaacaaacttaaatttctgattattatatttctatactttagtagaaagtagttgaaacccccattgagtcatgaagcctgggactcaaactacagaatatatcagcgacagtatttagaacaggattgtttttattttaattgtggctataagtgaacatctatcatgagacatttgctgcactttccttgcttgtaggttggttttgcggattgccactgatgattccaaagcagtctgtcgtctcagtgtgaaattcggtgccacgctcagaaccagcaggctccttttggaacgggcgaaagagctaaatatcgatgttgttggtgtcaggtgagattttggtgggatagctagaggtcaagacattgaacagtttgagttttacaggctttctcctagtgtttgctattattttaagaaatactaagacacagtgtctcgtctctttattttaccccagcttccatgtaggaagcggctgtaccgatcctgagaccttcgtgcaggcaatctctgatgcccgctgtgtttttgacatgggggtgagtatacgtgaccctgttagggaagggcgggacacaactgacaataactagtcttaattctagagttaactttttatggcagttggttctgtattacatgggtttcagcctatctgctgcatacatttttgttattagctgtggatctggctgacttattttcttgattctaggctgaggttggtttcagcatgtatctgcttgatattggcggtggctttcctggatctgaggatgtgaaacttaaatttgaagaggtaatttagaacaaaactgtaatactcagtagccgttctaataaattcctttttggaatatttcaaaatttaagtgtcttaactaataccacaatgggctgaagtgtcttggtgtgatattttgagtgatttctttgtgctgtctgacattacacttgataccatttggttttctaaagtgtgaatcagctttcccagaagtcttggataattggttacattggaaatcatggctcacacctgtaatccagcacttggggaggccaaggtggtaggatcacttgagcccaggagtttgagaccagcctgggcaacacagtgagaccccatctctacaaaaaaaattttaaaattagcctggtgtggtggcgggcacctgtaatcccagctacttggaaggctgaggtgggaggatcacttgagcccaggaggttgaggctgcagtgagccatgatcatgccactgcactcagcctgggctacagagtgagaccctgtctcaaaaaaaaaaaagaaaaagcatgttgctgtgggcttcctagagaatatgctgactgtagcacatcatcaccccaaatgtgctttgctagacctatgcttcctctccttaaaatacttgaaatgtttagtcacttaggaagttaagccattatattggtgcttgaatttataaaatatatccacatggtttgttaaaatcatgacgtaggcagaataggatttttatcctgttggcatgtatttgttaaaatgttttgacatcttgatgccttcctaggtagtagttagttgcgtactgttctttgataaaaatcatacccataacatcctaaaggagatagggtgcctggaggggaatgaaaacgagccacctgggatatgtagcctggttttcagggagatgttgatgtttttttgcttttgttactttaatgataaacctgtctgttgatgcctggtctcatgatgtcatgtcacaaggccctgtgatgttactcccccatgtgaatttcccacaatgaaggctgctctttcttttctgtttcactctcttagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatggtatgtataaaggacgaatcacttcatgtataactgaaagctgatgcaaaaagtcattaagattgttgatctgcctttctagacgaagatgagtcgagtgagcagacctttatgtattatgtgaatgatggcgtctatggatcatttaattgcatactctatgaccacgcacatgtaaagccccttctgcaaaaggtaatttctgagcatactgtataaaacaattaagaggactggtcacaacacgtgtaattaagtagtacttcctctctccgtctctttatatagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggtaagtaagccatgcatgttgatggtgctgccaagaataggcaccttcttggatgtgtgcttcttgtctagacgaataagaaattgtcttgcctaagattaaatatatatggatatttttcctaagaaaagttttagaaaagactgatgagtgtatttctatgtaattggaatatatttaagttcatgccatgtgtcttgtggtttccttattaccaaaacggtgactgaagaaacgcttgctttagaaatacattgaattggccaggtgtgctggctcacacctgaaatcacaacacattgggaggccaaggcagaaggatcacttgagcccaggagttcgagcctgggcaacatagtgagaccctgtctctacaaaaaattaaaaaattagttggccatggtagtgggcgcctgtagtcccagctgcttggctaaggtgagaggtttgcttgagcctgggaggttgaggctgcggtgagctatgatagcaccattgtattccagcctgagtaacagagaaagaccctgtctcagaaaaaaaaaaaatacattgaattgtttcctgatgggaagtaaatactctcatgcccagttaggagtgagtcagggtttttaatatgccactttttctttctcaggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggcattgggacgtttttatggtgtgttcattccagacagttcacgaatcccgtatagctcgctctgattctcagagaacaatgagtgggtccacccacacacaggtaggaggacaggtgagacggaagccccatcctcccatgtggacggtgcacatctgctcagcccaccccacatgtccagagttggctgcaaactccttgtccagagcctctggtggtgggacctacttaagtctgacggacctgtcctgtccaggccagtgcccagggaaggtgtgggaggccctttgagcctggcctgcagagaccatccgtgtcccctcccaccttcatgcctgtgagaagttaggaatgtatacggtaccacatttggcagtcagcttattttaataaattcagcaacagcaagtccctaccatgttgtgtatcttcaccatcttgtctgaccatgaccactggccttgtgtgttcttttactcaacgtgtacccccgctctcccccaaagtgtggcaggctctcatgctccttaacccccattgtggcaatgtcttacgggtaacgctggagctgcaggaggagggaaggacacgtcagagccaccaggcagtgggagcatcttggagtccccaccagcctcatgagggggacaggaagagagcaaatgtgtagggaggaaggctgtggctcctcccggggtgggaaggtcaagccgatgctgtcacccatttaccaaagctgaagagagtgacttcctttctcaaaagcatcaccttcccctgaaccctgagtccagagaagccaggagccctcatgtggctgccgagttagctcagggcttggcttatcaccaactctggtctccctgggccagggttgccaaaacatgaaagattttttcaggagccagaggttggttctgactggagggggagggcgggaaggagtgctgtagtccacagccctaccttccgggagcctgagaagtaggatgctggtgtgtttgggtaactctgagctccccaacaagggcagttccctgggatccgggacccactatgttaagagagttggcactgagtatgtactgtgtgccaagaaatttgagctagacaccaagcctagaatcttggtaaattaggtcttccatcttaaaaaggaagaaattcccgagatcgcttagtggcagtggtgagcttggactgaaaaggggggtattccactcaaaatcaactaaggctttggaaacaatgctctttcagccagttagggaaaatgtaatccaagaacggtcagtagtgccagtggggacagaaacagccgcaggtaatcccgtgctacacgtgagtggcccctgaaacctcgcttctgaccacagcttggcgtagccacttacaggccccaacaaagccagacttgggtctgtgaaatgatgtggccaggcttgatcaagtgatcttccttggcccttgtacatgggagcaggcaggcgaatttggcaggagagaccagagaacgaggacagccagacggtagccggggctgtgtcgacaccaggcaccgtcctccaggaggcttaagtcctgctttgcatttgggtatctccacgtcatttttaaagatggtgctgtctggtcgtgcacagatactgggcatttctagactcgtgacttgaagtgaatacagctccaccaagaccacttgtgaatttcttcctggcgtgctggcccccgggagaggggattcaggggaattgaactattgggcaaaggtaaaggcagccagagtgcattagaatcacttagggtgcttcttaaaaatactcattattgccccctgaccactttccccagactctggggatggagtagtgttggagcaactggagaaccatctggaagacataaaagtatccccaactcctgctccaaaatacattccagatagatgaaagttttaaatataacagattagaccataaacctactggaaacaaagtcaaaa

SEQ ID NO: 13415 - DNA, 36437 bp, Human
  misc_feature (1)...(36437): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcccccgccaccataagtggaacaaacttccttccaaaaaaatttacagcagtcacaaactgctgtttatgatcattttagatataaaattccataactcaagttagcattgacattttataagtgctgtcaagtcactctagggaatgaaaatgagcatctcactatgtgctctgaagtggggacatatttctctgcttgttatggacggtgagagatggctaaattgaagcagagaaatatttcagtgatgcagagcaaaggtgacttcctgttttgtttcaggttttgtttccttctcctctcaatgaaggctgtgttttctgacattcggcaatccttttgctcagtgatttcccattgagagggcatagtgtgaaggcctctgcaggtcattccatttacaatataagctgaaagggtagagtggggcgggggtggggggaagagggagctcattagtggaagaagcagaccaggaggggatctgttttccattttctcctccagattgaactcatctggatggaaaggttttgattgttgttataatcatcattattacctgcgtgatgtcgttttcctacactttttttttaagtgtcgggcagaattgttgctgagaataacaaataatatctgccatgttatccgtgagcaaaatcagaaaaaaaaagtccaagtgtattagagctgttagtttccacgttaacccttaaggagcaaagctcaagagttctaattccactaggtggggggggcgggaatagaaggaaaaaaccccttttccttgcttctggtggcctatttgtagtcatgaacagcatttctttgtttctctctctctttttttttttttttgaaaggcaatcctccccccacctcctcccccgcagttattgaaaatggagacctctgtagtcactagctctgggttgatatggctccaccgttgctcgcaggggtctgtgttttccgctacttggacaaagtgacattgcttaagcctttccccccaccaggtctgactttctgcagagccagtgattgcagaggaaaagctgtagtttgcttaaaggaaatacctccaggaaggagggtctcgggtgggttcccaagtggggaactagggggacttttccgtagggaattggggtgggctcttcagtgaggggctaggggctcgtttctggggccaaagacgggttccctagtgtgagggcgcgctcgactcggcgctgtcttggggtctcgcactcgcacggcttcgcaccccactgcctgcgactcccaggccttctcttccccgggcgcccactccattctcgggaagagcagccggcactggagggcagagactgccccaggggcggagctccctctcaggcgggaggtaggaaagtgcagagccgcccgggcagaggcacagacgtccctgcggggctcctcctgagcgtccctcctgccagccagggtcgcagccgcagcggcggccgcagctcttagcccacacaggacttgtaaactcttactgcacccttctctccattaggagcttttcctccctccttccccccaacccctctgtcctcctcactttggggaatttaatgctttctttagcatctttttgtgtgcgtgatctaggggaggagacaccccagagctccaactagctctcagctgaattctacttttgtttttatgtcttcctcgcctcctctcgtgtccctcttatctgactgatctgcgaagtctgatgcttctgccagagggagaggaataaatagatgttgctgcttccgaaggcttagacgttgggaaagagcagcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctggtgagttttgacacggcccacccttcccttaccctacagcctcctcaattcttggagtccttgttactagcctttactctctaatttttttctcttcggatcacttaatctctcccataactgctcctctatcaaagacccttcttcttctttcttcttttttcaaaaacaaaaacaaaaaaaccctcaccttatcaccttccaaactgatgcactctggcactgtgttccaataggcgatctttctaaaacaatccatgcattccaaacccatcacacttctactccacaggaatccttcacttcaactccttacatgtgcaagtagccacattttgtaaagtgatgctctttttcttttaaaatgtgtttataatcattgggttttctttgctgattctcaggcaatctcagtcatcaggtttctgtatctttagtgtcttagatgcttgttaagattgtgtggaggaaacagaaaactgaagccccattttcttctaattaaaaatgccaagataatttcaataaccttactctaaccgacagatgttaggggtatgtgtttgctcaagatccagtttgagcaattaccttcaccttaaatttccccctcctttcaatgagataaattgttcttccattccagaatgaaacaattgtgaaacattgctatgcactgttaattagcttctgtggcttgccatagagctggcagactgaaattactgagctcttttcacatgcccacatgccttcaagtcattttataagtggcatacagatgaaaggagttatatttaaggcgtgttatcatacactcacgtaatgttattttaaatctcaccccttattccactctcatgttttgaaaaaaaaattgtctttaataccttatttcatgctccttttccgtgtgtgcaccaaccacagtcatttcagtctttccctaccataaaactttattgcagctctaaatttaatggagtcaatcacaagttgttttctcactagtgtttagtctaattatgacatttgtaactttaagaccccaactaaacctacttcattatggtccatttaattctaactcagtattacttctaccaactaacccaacctcaaattttacccttcatatattttataaagaaggcaattttttttcatgagtggtcctctttcataccacatcccccaccccccaacaactctgttcttagatgtgttgacttggttgcctccatctgtttatttcttgggcatcaactttccttcctctttcaacttgcacagtctaggcgcatgtccccagtccatttccaggtagtaattcttagttatcgggaaattgatttggaaaaattaccttctgtgcacgttgactcatttaacaaagtgagagaaggagaagtaattgtaaaaatagctgaaggaaaaaaaataaacagaagaatttcaagaactttttaatggtgacctcacttagtttatcactttttgaatatacctattgtcttcttgattttaatcaagaaccaaaagctagttgtgcaaaatcatcacagaaatgtatttgctattaatctttgctaaaagagcatgcttaaggcttcgtactcactaaagtcacagactgcagagtctggaagtgctcagtgcagttgccgctctggtttgccaggcacttagaatcagttaaatgcaggtgctcctctcaggccaagggctaggaatgaggtggcagtggttcaggctgaaatgcattcctccccgtaaagcacaaaacttgctcttaaacctcccttagaggtggacctagagtgagtgaggtttggcaaggttaatggctctcaaaaagccatagtcaatatggataggaagcagtttcattaagtgtccctgagttaccaatcactgtggaacaaacatggaaacagttgcctcattgaagcactcaaataggacatgcatggaaacaatttgtcagttcatgggacctgatttctaagcttctttaaaatgccagagtatttgctttactggcagcatccttgctagaaaaataggtggtagttggaatcatagttagtgatggcatccctgctcccttccataagcttcagtgtgaaccagaggctatgatggcaaggggagctcaaaggtggggggaggtggaaattgggaatgaagtgtgtagattgtagcctgaagggtctcctggcttccagggccagcttgttgaaaattacattccctatgctgggtcaaactgtcagacacctggaattacttaggaactaccacatgtggccagtgtaatttaccatgcaatatccaatatactctttggttcagtgggaagtgatagttcacaaagcaaggtttttttcttattcaactgggtataaacagaatccctgtgtcttttgactagtatctgtcccactagatataaaaatgaggtctccctgaataaaataggacaatctttcacattcttctgatgccaagaggattttcaaatcctacccattcatggggatctgttctctcatagtatatcatgactccacaaacaagcttaggaccttttacaaagcagtcttactgaaatggagtaatgcttgaaactactttttgctttcaaaatactaagggtaatcatatttttgaaaagaacgggttccatcctgaccattattattcatcttacacattttatatttgcataactttgtgtgactacatgtacaactgattatctgaaaactcagctcaattgagtcattcagcaagttagtgatgacattcagtcaaatctttaatattgtgtggtgagtaaagaggataggcttggagtggggcagaccaggtgtgaatgactctgccccgacatcaactattgttataggaaaattatatgacctctgtaattcaaagttttcttatctgtaaaattaggacaaaactatctacatcccaagggcatggtaaagatgaaattaaagctggtgcagtggctcactcctgtaatctcagcactttggaaggccgaggcgggtggatcacttgaggtcaggagttggagaccagcttggccaacatggtgaaaccctgtctctactaaaaatacaaaaattagcctgggatggtggtgcgtgcctgtcgtcccagctactccaggaaactgaggcaagggactcacttgaactccggaggtggaggttgcagtgacctgagatggcgccactgcactccagactgagcgacagagccagactgtgtttcaaaaaaaaaaaagaaaagaaaagaaaagaaattaaacagcatataaagcattgctttagtacttagtaagcactgaaaaaagtgctgctgctgttttactattatcactgttaaaacaaattgactaacattttctattttgtttttgaaatggttatgttggtaaatgcagatgcagcctagaacttttattagttcatctctggggaaaaacaaaacaaaaaagctttacactgggacctaactggaaaaacaaatcttatttcttctaaatatataaagttagtatttccttttacacaaattgacctagacctcaggctcaagagcagatccccttgggagcgacagaaaaaagaatgagtctggtggaggagttaattacaaataattcatctcagaaacccaggaatcaagcagttaagaaaatttatggtatgatatttcacagctatttccacaacacctacagtttgccgtgccaagggctttataatcattcctcagtcagtgctggcttctggggcagtgttaacttttctccccagctcttgctcaacacgtttctgcaggccttctctctcctggcatgagccgtgccaactttcatatgcaggagctgccatttaatcgtttctccactctcagagaaacaggcagtcttttctttagccctgttctacaaatatttgaggggccaagtaccaagaaggaagaattatttagtgtgatatgaggaggaaaatggaaaggagaaatggaaattttagattagaattaaagggaaaacatgcttctgaagatccttcattgtgtaaaatactgaaaggcactctggatgggttagggaagagtatctcagtgttatgttagtagtatttaactttatttagagcaacccccattatcaggagtaatgtaatcttatgtagtctccaaatcttaataatttactttttatctcattcccactaaaccttcaaatagttgttgctacaaattgcaaaactgactaggttatatttagctcttctagttctacttggtgtctagaatgaggagaccaacagccaacaaatagagatagttttgaataattaagaattggctacatctcctcaatttagagaaaaccacagttttagagttacaggcccttagttggaattctagatttgccattaattttgtacactgaactagtcgcttgacattgacattcattagggattgtgaagaacaaaagaaatagtaatatgaagttactgataaacggtaaagcacaatataaatgtttaacaacaacgtcattggggagaggacgtgtcatcctcaggacaggaaccattagcaacacaataaaagcaaccaacacttatgttctaggtgctgtcctgagtgcattttgcacattcattattattcccattttggagaaaaggaagccaaggcatatagagaagctaagttactgtccaagttagcagagctagtaagaaaaagagaattcgaagcagagcctgttctacactacactttgtcccttaagaaatgtaattcctaactttctagagaatctgttattctttgcctagcagattgcagttaaaggaacaaaggttttctcattgtattttgaagtacacttatctatggcttaagagaataaaaggtggcttctagacaatggattcaaagagataagagattctgacttcactgcaattttgagatagtagagattatacattccagattctcatgtccctagtctctcggtctcagcatgccccagcgtgaactcatcatttccccatagtcatgcacttgtttctttctagtattttctatattgttgaaaggtaccaccataccttagtagtccaggcctgggaggcagtctttttttttttttttttttgagacagtctcgctctgtcactcagactggagtgcagtggcgtgatctctgctcactgcaacctctgcctccaaggttcaagcaattctcctgtctcagcctcctgagtagctgggactacaggtgcatgccaccacgcccagctaatttttgtatttctgttagagatgggttttcgccatgttggccaggctggtctcgaactcctgacctcagatgatctgcctgccttggcctcgcagtgctgagattacaggtgtgagtcaccatacctggctgtgggaagcagtcttgattctacctttttcctcattcccctcactcaataggtatcacatgctgtttggtctactctgactcaaattcccttctctccctctctaatgctactttcttagtttggaccttaccatttctcaccaggattatggccataggatgataatggtctctcttatctccagtatttcccctccatattccaatagacattttttctgaaatgcaaatcttttgcttaaaatccttactaataatatatattttcatttagggtaatttgttgttagaattcctaagtttaactttctgacaataattttttgatcaattattagaaaatttttgttttctgtcttacagttctaacaattgacttctaagcatttgtaaaagcgtagaaacattttcctttgaataagaatggaagaagtaaaacactctccttggcttagctattttgaagtgattccctttcaccaagcaaagttttatttttcactcttatttctacctttgaacaataaacatttcaaatatgggccaatataatttcttcctttatgaagacattatttttgtatgtagtttatcacatgattattcagaaatagaaaaaccactggcacgttactgtaatacttgggtacatttatcatgaataaatgtttgaatataatgaaagtattagtaattaatagtttatgcccaagttgagccaaatgttttagaattagtgtttgttacttgcttatctgtttgtttgctgactgctatcttttcttggatattgctttttaaatacttgctgatgattactaaacctgggaaagtaattcattaattgtaattgtgggtgttatagtcctaaaatagtattaaccccttgtttaatttattcctgataggacctataaacaaaaaggacaaaggaagaatactattttctcctagaataaatagaggcattaaattagtttagcataaagtgttactacaaatgtaaaactcttatataaagtactaaattggagtgtcaataaggatatattgctaggtacagcatctctcagcacggtgttccgctggtgcactgttattcattagaggctgctttcttaattagaacacagaaaacctttatcattactattttctgggattatggcatcctaaaaagaatcaatagcaatttctaattattgtcacatctattaattgcactggcttgaatagtccctgaatagtaggtttcttttctgttgaagaattatttagcctgcagttaaaggacatgagaatgatttctgagtgttcgtttaggaactaaggatttaaatatataccagttcagtgtgatatgtccatttattgaagatgcgtttggttttttttttgtcatcaagtcataagtgttggatgagtgcctaatatttgcataggctttatcatgataggatgcttatcatttacaaattttgtgaaattcaaataaattattaaattctaaaattttatgcacagttgagtattcagaagagtatttccttataaccacatgaaaaaataagtctcatccatactcaacccatgaatgataagaatgccgacctcatgacgttaataaaaatctacttccttcagacaattggattcttacccaaatcaaacttgtgactgagttagatttttatctttaggaattcttgaaatagatatgttatagttcttttttctgtcacctcctttcagattttcctatggattctagtaacggaaactgtagaggggcaagcagtggtgagtatatcattatcttcctggttttcatttgtggtcagattagtcattgatgtaatttagatacttaagtcattcatggggaagcttgtgccctacattttacaagtaaactttttaaaattccctcatttatattaattttatttttaaaattagcacgtagtaaaattggacttttatttggacatatagtttggtacagatgaattttaatattatgtagagatttatgtaaccaccaccacatcaggatacagaacaattccatcacctcccaaaactccttcaagctgtatccctttataattacaagttttccctatcttcatccactggcaatcactcatcttttctttatcactatagttttctctatttgaggttcgattgtccatatagacagactgacagtacgcctttgagacttaaccaattgctgcatatatcaatggtgcattcctttttattacagaatattttattacttggatgtatgaccatttgttcacccattcactccttcaaggaagtttgggttgtctccagtttggagcaatcgcgaatagagctactataaacattccagtacaggtttttgtgggaatgtaagtttttatttctctaggctaaatatgtaggaataggatcactgggttatatggtaagtatatgtttagctttgtaaaaaagtgccaaactgtttccaagatggctgttcaattttgtgctagtaatgtataagagttccagttgttctatatctttgcgagcccttggtattatcaatatattttattgttagccattttaataggtatgtgataatagctcatcatggttttaaattgcatttccctaatggctaatgatgctgaatacattttcatgtgtttatttgctatccacatatatgctttttggtaaaatgttcaataattttgcccattttaagttgggttgttttcttaatgagttctgagggttctttacatattctggatacaaaaaacatcttttggttttattcattttctctattgtttcactgttttcaattttattgattatttccttctgcttgcttgctttagaggtttattttgctttttcttttgtttcttagagtagaagcttatattgtgttttgagactttttttttttttttgagatggagtcttgctctgttgcccaggctggagtgccgtgatgcaatctcagctcaccacaacctccacttcctgggttcaagcaattctgcctcagcctcccaactagctaggattacaggtgtgcaccaccacacccagctaatttttgtattattagtagagacaagatttcaccatgttggccagctggtctctaacacttgatctcaggtgatccacccaccttggccttacagagtgctgggattacacacgtgagccaccatgtccggccaagacctttcttctaatataatgtaatgctataaatacccatctaagaatgactttagttgcatctcacaaattttgatagtttcatttttcttcagttcaaaatattttatatttttccttgatatttcctttgacttgtgcatcatttgggattatgctgtttaatttgctgctttttgaggattttcctattatctttgctatttttcaaattctactgttgaagaatatactttgtgtgatttcagttcttttagatttattaaggtttattctctgatccaggatataatctgtcttggtgaatgttccatgtacacttagaaaaaagagtattttgctgttgggtggaatgttctttaaatgtcaattcaatttagttgattaatactgttatttagttcttttatattcttgctgattttctgtctactagatctattgattaccgagagaagggtgattaggtctccaaatattgtggatttttctatttcttttttcagtctgtcagttttgcttcatgtattttgaagttctgtttggtacatacttgtttaatattttttatgtcttattggtgaattgatgttttcattatgtagcgtccttttatccttggtaattttctctgctctaaattatattttttctgatattgctatagctaattcagctgtcatttgattagtgtttgcagggcaaaactttttctatcctacttttaacatacttaagtcattgtgttttaaatacatttcttgtagacatcatatagttgggtctttttaaaaaaatccatactgttgatctttgtcttttgattggtatgttttgaccatttgcagctaatgtagttattcatatttgtatttagatctactgttttattttctgtttgtgccctctcctttttattcacattctcttctttcttttggattgtatctctctctctctctcacacacacacacacgtatgtgagatatatatatatcctcatgagataattttatattttttcttttaacaattacatatcttttaaacaacttgaggagaatagtagcctactgtatttttacagatgttttaatttctattattcttccttcttttccaacattccatacttccttctggtattctttctcttctgttcttcagacagaagttctgtctgaagaactttcttaagtattttttgtacttgttttaaagcagttctgctggcaaaaacttcttttttcctttacctgaaaatattctcatttcaccttcattcctaaaggatattttcactgcatacagaattctaggtttgcagtacatttagcacataaaaaatattccacttccttctggcttcaatgtttctcatgggaaattggcagtcttgcaaataattgtttccctgtaagtaatacatcagttttctttggttgcatttgatttttttttcctgtgtctttagtttttagtgctttaattattacatgtctgggcattgattcctttgagtttaccctgtttagggttatctgagcttcttgaatctataaatttataatgttagccaaatttgagaagtgcttaggaattatttcttcaaatacttgctttttacacaatagtctcttctatgatgatatgaatgttagatcttctgatattgttccacaggccccagagaggctctgttaattttttctcctaatcttttttctctcttgtttagattaggtaatttctattggcctagcgacaagttcattgactctttcgttggtcttgttcaatctcctactctctgaaacacatccagatagtttttatttgttagtatatttttcaaagttaaaagttccatttgattcttcattatattttgtatttctttggtaagactttctatctttccatttatttcaagggtattcacccttaatttgtgaggcattttaatcatagctaccgtaaagtcatctgtgtcacctaattgtcttgtcccactcaagtcaacatttttttctctacatcttcatgtgtagagtaattttgggttgaatcctggacattttgaatatcatgcaataaagctttgggtcttgtttacttaaagttatatggaaaatgctgattttctttttttaattttagcaacagttaacctagttaggattaggctgcaaattctgactggtcttctgtgggttgtgattttaatgtcagttccatttccaaagccttcgaagtaccttccatatctatcccacatgtataccactcagtggccagtatgaggtcagagcaatactttatcctacagtgcagtttttgaaatctgtgatacactgttttatgtcagagtcacacatgcccaggggtgacttcagtagttcataaacaactttacaaaatcctttcccaggctcctttatctctctgatctcccttgcacttttcagttccttggaattcccccgttttggtcctttggctagaaagctttatcctactctgtgatttgcttcttgtgactgctccttcctatggggccaagtggtgggaggacagagaaagagagagagagacaaagtaatggggatttgccccagtcttttggaactacaagtcctccaatcagagggtaagattctctccttcatcaaagttttgggctcctgagggtctcccttgttgcagccgttgctgttaccacagtcccaggatgcctggaggaatggaatgcaagaggctgatatgttagagatcctttccacttcttgagttagaactggagtgtactctgtctgcaaaatgcttgcctctacgatacaggctgtgttgacaccagactggtggataccagagggaaaaaatgatgagcccactatagttttatggtattattttctccccccagtcttcctgttatgcttgtattacgttttagagttcttatgttgctgcttcatgcactctgttcaggtttcagatctgctttcagtgggagaaacaagatggaatctacttattccatcttaccataaaataaaccattaaagtataacatgcatgcagaaaagtgcacaaatcataaatgtgcattttcacaaagtaaccactctctgcaaccaagatatgtaacattaccagcactccagaagcctccaagtcactacccccacccttctcttcaaaggtaactactcccaggaattctagtaccataaattcattttgcctgatcttgaactttatataaatggaattctacagtatgtatttttgtatatgcatgtgacttcctatgcttttcattaggctgtgtatagcagtagtttttcactttaattgctatattgtattctatcattgaatgtggtacactttattcattctaatgttcatggatatttgggttgttttcagtttttgttacaatgactaatgctgcatttatttctacaatatgatagctgcgatgagtaccatatattccatttcactttcctctagtattttgcactgattttggtgagtatgtcctgccttataaggtgtcttatctgtggaaatgaaacatttattttattaagttgtaaataagtttgaaatatcaactttcattacattgggacagttttctctgttgacttccactgaatcttatcatggtgatatgtttgatctgagggaatgtctaccaaaggtgtcccaacaaatatttatcccattaaatacataagtaaattaaaattattttagaattgttttgttactttatataattgataatgtttttcaatatcatgaaatcagttggaaatcattgctgtccagtaatgttgctatttgaagggtcactccttctattatgttttctcaacccgaactgaaaagctcatttgtataaaactgcaattggtgggtcaaaatttctggccaaggacatgtatatgttaccaatttgttccaaagttatggttagagtaatatagcacttcaatgtatgaaagaaagaaaacacatcaacaacactatcaacaatatacaaaaaacagttcaacatgtaaaactacctagaacgaatgtggtgttctcagagtcagtgtttactgttcgtcttttaaaaatgttttccagttctctggcataatgagagtgatgaaaacaaataggcaaaaccaaagctcattctgtttgtgaaaaaaacactaacatgttcacatgttctgaaaaggaaatataatttgttcacactcaaaaatttatgctttggagaaatgtaacagctgaggttgatcatgataaaacaggaaatgaggaaggcatgaaaacactgtaacccacataaggacctctttccaaagtgtcaagctgtttctgtctggaatttggaaaagaaattctttcactctagttaatatattctttgcctcaaagcttaactattttttctttttctttttttgagataatgactctgaacagcatccaactgtacgttttactgttgcaaattcactattgtaataaggaatagatgctctttatttccatagcgtgtaatatggaggaaaacaatttttgttctatttcacctagtcacttgatctatcaaatcagcacacagaaaattaaagcagatattcaagtggtccaatgcaaagggttttttttaattaaaataattccaaaaagtaattcttccaattttctgctttgtgagggtgaccaatttatgaactttcacatttgaaaaacacaaatgtctccagagcggagatagagttggtaaattctgacactaaatatataaatgtgaccaaattatttcttggggcctgtttcctaatataaaatcagattgtattgatctgagttcccttctgatttatcttaaattagggaacattagtgtaagtcagatgctctcccagagttttcactaacctgttcttggcgctgttccaaaggtgctccagagaagctcctctgggtagctgcctggtggccactgagcaactggagattcctgatgactgcagctgccaggcctgcccagccactcccacttttgctgacatgatttatgcttagcttgggtagtatagacccattccctctctttctttctattacacttctttcctcccttctggcttactaccaattttgggaagaagttcagtttttttctttggtacaaatgtttactgactgtagagccaacttccacaccttattggagaaaaaaggatagacaaatagtatttttgtgattttacagtagcttaaaactataggattttttttccccattactttgcaacaactgatacttttgaccagttctctttcctaagcatttctctccttgagctattacccaaattgtcctagttcttctctgcttgtccctcagctatagacagtcactgaggctctgtgcttggcttctgttcctctctcctcatagggattcctcctgttggagttcatcaagctacataggctgaattatcatttttatgactctagttgtgattactctctaggaccacatttccctcctgtaacacttctacctgggtactctttgagtacttcaaaaataatgtatttaattactgaagttgttttttttttgttttttgttttgttttgtttttttgagatggagtctcactctgttgctcaggctggagtgcaatagcacgatctcagctcactgcaacctccatgtcctgggttcaagcaattctcctgtcttagcctcctgagtagctgtgattacaggcacccgccaccacgcctggctaatttttgtatttttaatagagaaggggtttcaccatgttggccaggctggtctctaactcctgatctcaggtgatccaaccacctcagcctcccagagtgctgggattacaggcgtgagccaccgtgcccagccctgaagtaattgtttaattaaaactttctcttttgtaactttctcatttaagtatgtgacaccattgcttttctaagtccctagtactgaaactttatttggttttagtccaccgatctcaccattcattagaaatgtaatgatttgtcctgccaaaaagcttctgcacatcaaaggaaacaatcaacaaagtgaaaagacaatccatagaatgagggaaaatatttgcaaagtatctggcaagagcttaataaccagaatatataagcaactctgacaattcaatagcaaaaacaaaacaaaaaacaacaaataatctaaaaatgggcaaaagatctgagcagacatttctcaaaagaagacttacaaatggccaacaggtatacgaaaaaattttcaacatcactaatcagataaatgcaaatcaaaaccacagtgagatatctcaccccagtttgaatggcttttatcaaaaagatggaacaatagacggtagcgaggatgtggaaaaaggggaactctagtatactgttggtgggaatgtaaattagtatagccactaaggaaaacaatagggagttcttcaaaaaactaaaaatagaactaccatatgatccagcaattttattactgggtatatatccaaaagaaagggaattaatacattgaagaatatctgtattccaatgtttactgcagtgctattcacaatagccaaaatgtagaatcaacctaagtgctgattagtggatgaatggataaagagaatgtagtatatatgcacaatgacatattgttcagctattaaaaaaagtgaaatcctgtcatttgaaggaaaatggaactggaggtcattatgttaaatgaaataagccaagcccagaaagaccaatatcacacgttctccttcatatatgggagctaaaaacagaaaaaagtgaatctcatggagctggagagtagatttgtggttatcagaggctgggaatggtagcgtggaggagggaatgaagagaggatgattaatgaggacaaatatacagttagttaggaggaagacctagtgtttgatagatcagtatggagactatagttaacaataatctacttgtacatttcaatatgtacaataattcacatgttcacagcataaagaggaatgtttaatgtggtggatattacccttaacttgatatttacacattatatgaatgtatgaaaatatcaatgtactctgaaaatatgtccatctattatgtattaataaaaaatataagggacacttactcgtatcaggcacaatatgtgccaatgacatggaatgaaagagcaaataggtgactggcactccctttcctttcacctcttttcaatacttggcattgagtggacacatggtgttctagaggctgtgaagcccccttttctttttgttaattgacttccttagagtctatctcaaaacaacacttcagaagtcatgagggaaaacaagcataattgtattgactctttctatattttggatattctgaataactcttggatgcagaaaacttgtgaaaggcagtttatttgaaattttccaaagacaaaaaggaataaactgaatttccttttcttattaatatagcgttagttctgtcagtcttaagcaatttcttttacaaagtgcaaattactgtgaattgagtcctttattacaatatttgaggtttgtttttacagctaagttgagcaaatgttacttttactttgtaaagccttgttatatcgcctaggttcaccagtcaacttcatcacattttccatatactggtgtaatccaaaataaaatttaatatgatattctttgccctgtgtataggtgtaggaaataaatattgttttacataggtaatgaatggttactaagtcaagacacacttccttttataaaaaaatgaaagaaatgtcttattttttgttaataggactttattaaggtataatttatttacagtaaaatactacaaatcttaagtgtatgctgcatttaaattttgacaaatgtatatatttatgtaaccatcatccagatcaagataaagaacatttatttatttatttatttatttattttgagacggagtcttgctctgtcgcccaggctggagtgcagtggcgcgatctcagctcactgcaagctccaccccccgggttcacaccattctcctgcctcagcctcccgagtagctgggactacaggcacctgccaccacgcccggctaatttgttgtatttttagtagagacgggtttcaccgtgttagccaggatggtctcgatctcctgacctcgtgatccacccgcctcggcctcccaaagtgctgggattacagacgtgagccaccgcaccccggcctaaagaacatttctttaaattgtctggtgtcttatcacccattctgccctgaggcaagcacagttctgattttcattgccatagatgggtgtcgttattcagcttcacgtaaatggaagcatactgtacacacttgggactggctgctttggcataccatggcatttttgagactttgagttctgtgcatcattttattttatttctaattgtgtaaaagtacacccttgtatgagcataataccaatatgacttctatatggttcctagtttaatatagttgatttctgaatctgcaggagttgtgctgttgttgttgttgttgttcgttttcttccctttcatcattgacaccaggactctagggttcgggtgttttgtttgtttgttaatgccctaggaacaataagaccctgtcggttttccattaagtgtccatttgatgacttgcaattttgggaagagggaatgtgttccatggggtggaatctagggatgttttactatcgccttgtttctagaaggatagtggaattgacctcctgaatggccaagtggtatattgcccatcttctgttttaaggactatctgaacaagttccaccatggcatccattcctgctgctgttttgatagctgtgatgataaggtagatgatccatctagtgcactgatttcttcactttactaacctgcttgtctattctaccccagccactcacttccatgagcagttctgggcctttcagtggtgctagcagtggtgccagcattgtaatattaattctaagaatcccattctttgcctgctgcctcttttcattccagatgatttgttgcagtatcatcactgctgtttttgtttttttttttaccatgttgagattacctatccatcagctactgcttactatctgctaagcctctggccttcttgtctatgtgagatatcatggtctactgcaatactgatacccttgaagataccctcaatttctttgctttctcttcctcttccatactcatctggcaaatcccaactccagttatttgagaaaattactcaactgaggtgactggtttcactttaaattcaagatagaaaattcaaatagacaatcaagattgccaagcattcttacccactataaggtttgcctttctatttgatgaaataactgctttatactttctttgcttacatgcccacatcctgcttttcgtagcccctcattccccatagctgatgacttcacttcattcttcaatgagaaggtaaaagccattggaaagaacaccctcattattccaccaaccaatttataaacttgtcaatatcagtacctttctctccttttccttcttgtgtagtggataaagtcttctagctttcaaagtcctattctctcttttgctcagggtccagtcatcacgttgccagttgaatttagtggacccttttctctctgaactcattttagctctgagggtcatttgacacagaggactaccctgcttttattttggaagacgctttttcaattccacactctcctgtatttccttccacatcactggatgctgcttctcagtctcctttatggacttcatattctctgtcttatatataaagatgtagttcctgcctagagaactacaactcacccaaagctttaaatatcattttctcacggtatattggaggccagactagtttaggtcattaagttatatgttcttattacacatatacattgtgttttaatttcatgtcatgtatcacatgtgacaaattattttgtgtgtactttctttgttcaatgtctttatcctcttctggattgtctgtagtgcccatcatgtgtcctacatgcctatcacagagcctggaatgtagcagatgcccaatatttgcagaatgaatgaattcatatgtaagtgactgaaagagttcaacaaatgttagttctctttccctttctcatctcatatttacagaagaatggatacaccagagttatggagtcagaagatactactatcagttctacagaagaaagacaaattcatggtgtgatggatgttaccagatgttaaaaattatggaactgttaaaaattttggaactgctcatagatacctcgtacaggcagttggaaatatagatctagagctcagtaaaaaagtcatagttaaggacctggatcttcaaattataaaattttattttttatatcttttaaaatgtgttgtgttttgctcctatgtgttttaaaatggaggaaaagaggacaattgggattcaggggtcaaatgccaggatatgagacttacagtgcatctggtaaaaattaaaatgatttaaactctgatctgattagaaaaggtcagtcttgaaaaagttataaaggagattgtaacacaaatacaattgtattttcttctctccttccccatagtttttgacaataaatcctaagcacagatctgaggctttttttcctagaaaaaacagaaaaatatccactcaaacatagtagtcctccaaagtcatggtacatgaaaggttatgagagtttggggatctgatgaagttaattatagtcttacacctctggataagacccaaaagcattcaatttcaaacaaaggtcagggatagttagaaagttttatcacacttaagcttgaactcaaacaatgttgcattaaatagtgacggtccagtgagtgtcatatttcatagctgtatcagggacttagacttctttagatcttctaagatcatatcaaaaatactagtatccttttgtttttaaaaaataaatgagcatatttgtatgagcaaaactgaataaagaaggctaagattcttgtctcctctgaactattttgatctttataagaagctactctgaggcagcaaggctgttcactgctcgggcactgcgtgtatcatggggcatttcccctgagctgcagactaacttctgcgaagtactgggcatgttaactttgcaaactcagatttctttctactagggtgataaactcatgtttctatgaaataaacagtctccaggttcattagcagatatgtaggagatcattagtattaggagagtcactagaaaaatcaagcaagaggagtggaaggaatgtgaggaagaactaagctgaaaatagttttctgtcctttccatggctgctggtaaatgtagcactgcactctgtcccacaattgaaggtattgtattaatttcaggctttgaggtaaatgaattgctaatgttaaaactgcccatgtttgaagatctctttgtcactacttagcctattttgtcaaaaccaactcctttaacttttaaagtatttttttttccttacataaagcaccaaggcagatgctaattcatttataagcttttcttctcaacagtgaaatacagaaaaatcaatatctaatggtttttgtgcaaagctcagtaaataatagatttcattttccattctaaaaaacttgtgccattaggaagttgggagaggaagattactagcaattaaacaagaaatgatggtaatgctacaggccccccaaaaagagtatcaagaaatcaactataggtaataaaaataaactgttacatctgatttagggtagcaggcacaaaaaaggtgacagctaatgcatgcaacatacctctctctgattcttcacaatttcacagttcttgggcttgtggggatgtgtacgttgatgtgtgtaaacataattcagatgaggattatgtttcagatctattgatctaagatacccttttcatgaataacctaagatatgaatttttgggttgagtaagcataaatgagaggaggttctttcatatttgagctttgtggatataaactcagcttctccttattactgttattttatcgagctacttgaactatacagataatttgcttatggcaagagctagggattgggacatattgtcccatataaatatttaaaatatatatttagtatggcattgtcaccttggagaccagcagaaataagaagtatattgcagatgagcaaaatttagtcccgagaatatttgcttagctcattagctgttaggtaatagtctagctatgtatatgtagttgtatgcatagctttgtaaatgcctacttgaaatattactaaatcattttgtaatataatttaaaaaaatccctgcctggaaagttttatggaatccatttgtttatgctccaagcaaagatatgtaagtaacaacatcaaattagactcaattcagtgacagttgctatagtttttgccaaaattttttatttgagcacatgcaaatttctgaagaattacaaatgtgtaatttatttacatgacttatttttgatagatatttatttttaagtagaaaaatcacaagtctatatatggatgaggataatttataaacctaataccataaaatttacgtcttcagaaatattctcatctcaagaatatctctttaaaaatacatgtaacattttaatacagaataaaatacagaacgccaaaagctaggtaactttttgttctcttttaaatgataatacaatcattttgctaataaagttatttttggaatagtttttgtcaaaatagcaacaagcactaatgttactcattgtttattggctgagatcttcacagaaattgtgtgctaaaaattatcaggagaacaagggaaggagctgtgtgtggtattgaggaattctcatttctgtcatgggcaagagcaacagttgctgctgctacctatccccagtagagatacttatttctctggcaggaagggtgatactcttttcgggactgctatgttaaagtgtattattgacaagttcaactggaaataaaatttattttcattagaaaatacaagtggtcaacaaaagcttctgccttttattgttccccatgttaacataaaacaacttttttttttttttgagacggggtcttactctatcacccagtctggagtgcagtggcttgagcttggctcactgcagctttgacttccagggctcaagtgatcctcccaactcagtctcctgaatagctgaaactacaggcacacgccaccacaccagctgatttttgcattttttgtagagacggggttttgccacattgcccagactggtcttgaactcctgggctaaagcaattttttttcccccaccatgttggcctcccaaagtgagtgctgggattacaggcgtgagcgcttgtgcccagccataaaatgccttttaagtgaaactttttttgttgatgtcctttctctaatttatgtgttcttatttcctttctgtgtcaaaagagaagcacataccatttaatttttactaaagctttctcaggggcattatttaaagaaatctttacatataattaaatattttaaggtaattgtgtattattttctacttttatattgacattaattcctgacaatttgccatgcttatgatgtatatttcttagctaagtaatattagctttgtagctcttctataaaaggtataataatctactcttcaaggtgtcaaatgaatctaccctatagatgaaacattttgagataattagaattgttattattatgatggccaaaaccacaactccttttgtaccaacctaatatatacataaaatatgcattctggtcactactcaccaaatattgttaaaaaatgaaatttctcttttcaaaatacctgcataatttcctccaacaagcacaaaaataccattgagttgaatggtagctattttacctatagaaggggctcactgcccctcttaagaacttcaccaagttcactgggttgtaataacacttgcttatctctttgagttgctttcagatctaggagctaatagtaggaggagtactgtgtcatctgttaaaagtaaaaaaacattaggtgatagtccacagggcaaaccagctacctgagcataggcagaaaattgcctcccagttggtattcataatattaatacttccataagcataaagcatacctctttcaggattaaggggtcatgctcttctcatgcatgggggtgaacagcatttcctcaggatttgggtggtttgttgagaatggaaactcgttctcatgagcatactgacattgaataagaggacatgtagatagaataaacatgaatgtagttccaggagaaaaaattcagacacacagaattgacaagagccttctcaccaccaaattgagatctagtctgagcaaaaaatgtgagtctgagcaaaacaaaagaaagctaatattggaaatgtgcttataactaaaatgtgtttttcagaacgctgtaaatgtaagcctattagagctacacagaagacctatttccggaacaattacaactatggtaaggaaaatttcatggttgatgtataaactgctgtgttaagagaggtgtgtggatgcacctatgaggatgtgcacatgtaaacgagtggagccatttaagaataaggcttaaaaacagaaggactatttttaggagcatagtccctctgccccgaccaattaaaatgtctcacacgggcaaaatgcttaacacttggttgatgttgaagcacatcaagcagtattgtcatcctagagccatgcacttaagtacacagagataagtatcaagatacatgggactcttccctgcctggaggctgaaggaggatttgagctcaagttgggttgcataggccatcagttgtgcttcactgagtgaacagcagagcactttgatgcataaggaactgttaaaagactcaaacttgacttcttcagtcagtctatcccatgaaaaacactgacagatttggaaagtaacacttgtagaagttgctggtattcagcgaaggaaatgtgttgttatctagcttgacttaaaatccgacattctaataaactaaatattaattgaagagccaccaatccaaatgtagctgacaaacttaactgaaggattaaaaagcctgccatttttgcatcagggactgtgctaagtgatttccatacattatctttaattttctcagctgccccatgagatatattaccatcttgattttatcaatgattatcgaacctaagtagtcccttctttgattgttcacaatgtactttggatgctggtgtatattttagagtcataaattcatttatacagtcattatatttagaaagggcaattaacagagctttcccgttgacacataagggactgatatttactgtattccatatgcattttgattttttctaatatctatggtattaataaaaggtatgttactatctctgcataagactattgatgttgagtcaatgagtaaacatggagattaaacagacttttacagtgaaccttattaaaataagagttttattattacatttatgtacactattttaaagtatataggatatatacagcagatttatttcttctatacttttgggaattgaaaggagagaaatgaataagactgtaaaagttagcttcaatatctttcaaaatgcagtgtattaaaaaatataaagttgaaaattttgggtttagttaaatctctttaaaacaaatccaccttgtttcccaaatttttcttcaatggaattaatttctatgttttgcctgctactcctcttaagaggattgtagcttttcttagtcaatgatggatgctctttctaagtttgtaagcttatgtttatgtaagaagtcaaatgcctggctgcttatctaagaacccgcttctttacagattgatgtgaagaagcctagggaaaagggagcccttaatttctaggagattagcttgttaagattgaaaaatgctttctgaacttttatatactgtaacactaagaataaaaacatatcaattttatatcagggaaatgtaattatttatatttaatttatgtatcctattatcaagttttattttatctagcttctgtagtgcttcaatggttgttgctgttatttttgttaaaaattgaatgacaagtcatggaaagtgaaggtcttagagaaagtagctgaatgaatatcataataaaatgggatatggattataattaatggaaaggagcagataatttcttttttgtagccaagtaatagctaagttgatcatagtttcaggattgccatttgtctgggatttcttacagtttctttggggaagggaggcactcaaatggttaaatagaaggaagaactctgaaaaggaagtatattttacttccaaaatatttttatcttctatatctgcatgtcaaggtgggagcagttggaaattcagacaaaacctctacttcatttagattaattctgggaaaaactccttaagtgttaaccaaattacttgagtgaaaaagtaggtcttgtagaaagatatttattttggagtgggtacatgtgctaaacatttctaatgaaaatagtagacactgggtaaataaatcattagtttgagaacatttgcacagttcactaatctctaatagttgatggatgctatgaagcacgttcacttaagccaggacacacaaaaatgcctgctagctggggttgtgaatttctcatctgattctgccaaatggcatttcaaaaagggcaatcttatcttttgttaaatacagaatagggagaacatgaatagaaagaggctccacttgccagtcaaaccaagcgaggacagttgggtagttacagtttgtttgctacacgttctcatacttgaggcaactaattctcggaagactgaaatgtgaagcttttagaattccttagtaactaatttctgtcatgtgtgttgtactggtagaataagtttttgtgacgaaattggaacattaatggggggaatggttgattagctggttttatatttttcaaggattactttcttctaatcctttatagtccaaaatctctaaaatatgtgggaaagtactcagattaaagtggtttgcaattatgtgcctaagaagtttttgaaatgttgactcatttggataaacggtgttttcctctatataatgtccatggatagtgaactggagcaatgagggtactgggagaaatgccactggctttttactgatatttttacttctttcttggtgttttaaaacttctctttttaaaagctcatttactagaagcaggaatctgaacaacttgactcttttaaaggggagagatacagaaaagaagcagatctgtactttctagattctgagtcacatactttaactttgcaactgaaggcaatttgttgttacattgataagtaaagcaagtcttgtgagataaattgggtgccaatatatccattgagagaggtagaataatgccattgacacgtgagaatatattccatagcacgtgagggaaaggaatgttggagtgtctgacttcaaagcagatggaggaaataagatctagtggtgaccatttttattcaagaagtaaatatagcccacttagaggagaatataaaagataatctgtactgaacacaaaggaaaaaaggacctaatatccgaacaaagaagaaaatgtagcccacctaaaggagaatataaaagataatctgtactgaccacaaagaaagaaaggagctaatatctgaacagtgagccaagatgaggaaggtgaaaagattgcagaaccagtttgggaacactactgagcaggacaattttataacattacagaggcccactacttgagaaaacctgttaatggacctgataaaacagtgtcgacaaggaataaagcatatttaagtattaggtcttttcatatagtaaaattaacatagtttaaattcctcttggcagcaattggaactgcacatgcatatatacacatccaaaatggaattttagagaaaaattgtatcagattgttgactcaatctttgattctctaaatggatttctcaaaagcacatgcacacacatgcataaatacatgcaaatatatacacagccacaaattggaaagagagcagggctgagcattaggtcaggtgtgttgttttatgtcacacactacagtctaaggcaaaaatatctggctgacttttctgttccattcgttgaatatcaagtggataagaattaactaaagagaagcctactttggctttttttgaatggggtagctattatgtgtcatattattatcagcttttcttgtcttttatcccagtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccaggtaattcactctttaaggatacagaataactactttgcttatcctactctcattaaatttgtctctagagatgctaccctcgcatttttacattgggatctgtctaccttcttggggattacagataagttttagttgggtttcttgatttcatatatggaatgggtgtatgcgtgtagtttataggtttacatttttcttgggagaggggccataacttcatttgtttcttaaaggggtctgtgacttacaaatggttaataattactgttctaaatcttagctgtcctattcaagaataaacatataagtctttcttgttcaagtactgtttccttgtacttttcagtaacaggttttaatttttcaaaaatgtttgcttctttcaaaaatacagattactcttggtggaaggctctatagctgagaagtggaaggatcgactcggtaaaaaagttaaggtaagcctgtattttatgtttgaagtaatacacagaaaacaaaacaaaagtagaaaaccagccatctgtcattgaaatgaaatagctgccttcaaccatatgagaaatattaaaatttagtatgcatatatttatatactccaagagctgaatttgtctttaatgtctattttatttaaggaatgagttccctgtatgtgtatcaaagatctaactacagttgccctaatgtctcttcacaaggagtctagctgtagtccagtcctggtagggtggtttcatgttgtcaggctccttctagcttatcactctaccatttttaaaggcatcgctttcatactcatgttcacctggaggtcacaagatggctgctctgcctctagtatcacatgtacatttcaggcaggaaaaagaggaggtaaaagggatttccaagagcctcatcaagcagtttttacttagctgcaaaacaggctagaaaatgtagtctttttaaacctggggatattgcttctttgaacaaactgcagtttgtgagaaggggagaataaatgatgggaaggaaaataaacaatgatgtccgatgaataaacagcaattcctatgtacaaagtgtagctacattcatctgtatagaagagatctgaataaattaggtccttagagcagtaatgtagccttatttttaagccaaataactcttagattgtggaattgatacattttttaaaatcacatagtacagtactgtattatagaaggttttgtttcttcttactgcactaagcaaatctgttttaaagaaaagaatggggtgggggaatgcatggggggacaaaaaaatctcaaaggatgtgtgggtgggtggggggagtgggaactgtaccaaacataatacatcctcttccttctgcaagtttgaaggcttgggaaacatttacatggtaagttaaacacccctgggcggtttatcttatacatctggcacttgacacggcagacacgtttgggtttaagtgacctacaaaaatgtagagggcattattttgtaaggagaaactaccctccagtaagttcttctcccctttagtagatttgtcaaaagggagatgcatttcaagttcagacttgcgggcattctctctgcatctctcttcaattagtttggtgtttattaaagaaaaaagtggctcttgttcagtatgttggaatctcttactgtctttaatttggttttctgcttgctaatgcagaactggaatttgtcctaaattcctgtaccagttggaaaagctttcaatatccctgctgcgaagcatgtaacaaggcttactgctcctcttttggtaccaaaacaatatcattgtgttgttgacaggacacatggcttgtttgtcctgtttcccattgctttctgcaatatttcccattgttttccgcaggggacttgcagagttattattgtaaagtcatttatattctcagtctggatttaaatattctaaaggaaagaaaccaataatttgaacaattttaaattcatatgcagatattgagggctaaagagtttgggtagaaaatctcctttggccagaattattgagattcctattttagttttccagtcaatttgaagatgtgtaaaaagagttttatggaggatgttattttttcaatcagatttgctcttagctgagttttgctctcagtggatgaatcaataattttataagaaacattattatgtttttttcatgcaaatggttgtttacctaagtctcttatagcagacgattcaagatgtttggacttccttgggaagttgagaatcagactgtttttaaaatatgaagacaagattgtggagtaaagaatactgaaatgaagaattaccttcagtaacagaaaaacaataacacatttactatgtgctaagcactttatatttttattaatcttcagatgtatctacttataagtagattctattatcagttccaacatatacatgatgaaaatgaggtctagtaagttcaagaaacttcacacagtaagtggtggagttagaatttgaacttgggccatctgacccaaggatctgatggtgcttgctctttaaagtgtggtccctggatcagcaacataggtatcacctgggagcttgttagtaatgaaaatcttcggccctgtctcagacctgctaaatgagaatttgcaattttaacaaattccccatatgatatccgtgtttgaagtttgggaagtacagctgtagttcgtattccctacctatcctcatgtaatataacttccatttaacttaaattacatgaaaatattattgacattgttaatatgaaatattactaaacttgattgtgtttattaaaaacattgctaatacctgctttgtaacacttagaacgagggcaggaccttgtctgttttattcattgtacttagtggatattacttagaaaaatatttttgagacccccccatccctcaaaaaaatttccatttttttttcactgctcaaatcacatagactttaaaaggctatgttcttatgtgtattaagagaggatgttgaaaaatagccttcccttcaaattctgtgtgtaaatcttccatttgttgagtatctgtgaagcactagcctcctgtatgttacctcaggaaatacccagagatatagggagatatttctgtcatcatttatagacatggacattttaagtttaaggtttgataagaaagcattactaaatacattatagatgttgcgcttgttaaagtcagagaataatgttcatattgcatcagttttcttgttaccctgggaaatagattgatacttttggaaaagtagcaaaatgcttcagagatctgaacttgcagtctgacccagttgttagaatcatggaaataatgaccctggtgatatgtgcttgtgactattttctattttaaatttcacagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggtgaaagtctttttttttctcttcttttaaaataaatcagaattgccgtattgaccaggaaaagattatgtatgcacgtgcaccagggttagtttttaaaagtacatggctccataaaaatgctgtagattacagagtgataaaatatgcaggtttttttgtttttgttttttctgttgtgtgtgtgtctgtatttgtgtacatgtgtgtccttgcactcacacccaaggtggattaaaatacaggcctgcaaactggcctgcactttatcatttggatttgtgctgcttaatgctcagcgaaaaatgtctagtaaaatgaattatggttgtcaggagagaggttatttcgacttttgaaccaattgcacatttctcattacccaagctgtggtgagatcccaggggctgtggtgaacaaatgatgcttttatagatggtccctagcttacaatgattcaatttacaatgcttcaatttaacaatttgttgacttacaatgggtttatcaggatgtaacccaatgcatttcaacttacgatattttcagtttcgaatgggtttatccagatgtaaccccatcgtaaatggcggagcatctgtacttccttcctctggcagagttccttagagcctgtgccaattacttgaaagtttcattctctgccatttacatgtgtgctattagtagaaccaaatttctaagctgtggcgtgctgaaaataaaatgcttatgaagcaaaaatcgtgctatgtttccttctacaaggataatcaagcaaggatgaaattcattcctgaacaaaagtttcctaaaatggtaaataatcatctatctaaatgttctattttaaaagtgtgagctgggtgtggtgagtgcacctgtaatccccactacttgggaggctgaggaaggaagacggctagagcccatgaggttgaagctgcagtaagctatgattgcggccactgtactccagcgtaggcgatagagcatgaccctgtctctgtaacaacaacaaaagtgtgaaagttcattctacaaattggagtcactcatatcatacccaactaaaatggagtcgggaggccatggggaaaggcacccaggtccctgttccaggaaccatttttgcagttcaacagaaaaatcacgaagacctaactctaaccttaagataaagttacctagctgctgccactcaccaatcagaacttgctagatcctacaagacgcgcctggctccagtgaactttcattcaaaaccatttagatcaccttcctctcttccccaataaaaccccagcctttctctttgttctttgaacacaactagaggctacactggtttgtgtgcccagaattacaattccaattcttatattcccaaataaaccctttacttggagatttatctccctatatttaaaggtgacagagtaagggaacattcctgccttctgattgactctccaaagccaacaatttccccagccccagaagaaaacattcccacctttgcctataggactgcat

SEQ ID NO: 13416 - DNA, 25404 bp, Human
cataggaactcttcttctctttggatgtgcacaatagacacatgcccagaccctgatctttaacagatattggtcaattcctcctcaccctttggcatcaggcaaatgtgtaaaaacctaacgtctccctttgacttcaaggcctcatgtacggttgcacaagacatctgtagagtggcgtccctagcattgtgtagtgcccaacctgaacaggtgtacctggcagccctgcatggcctccaccctcacgtgcttccatattgcattgtgtaccatctggccatctgtggtcttgtacagaccatcaggtccctgagaacaggaacatgaattatatagttttttttatttatttatttttattttttttgcctcccatggtgcctggtactcagttagtgatcaataattctcccctagcaactctgttcccttctgattagccccagggagaggaagcagcctcctctgagactcaaccctaccctgtgggaacgctcagtccaggcatcacatccagtgcccagtcctctgcctgccctccctttgataccagcccaactcaagcaccaggaaatcattagcagagactctcaaaggaaaagaggcttcaagttcatgtcacccagggccacagtatacggccccgcaggctgcccaccgcgcaagcccagggagcagccttttcatggatatgatgcaatatgtatggatcctgccatccaacccttatccaagcaggattccagaggcctcaaggccattcttggagagctctcattttcaggtggttccttgcaccaagccaaaatctgtccccacctccacccaacagtggttcacaccctggtccctattctgccctctggagtcctacatacaaagcctaatcacctgtttcagaccccacccaggcctcctaggttccaaccaagccaagaagcaattgtgtttctgaaggagacccctcctcccttgtcccacctctgcagtggggatagatggaaagagcaaggcctaggataacctcacacactaggtggccccgcccctggcatgcccacctctctctgcttctgctccacgccccaagcctggctcccagcctgaaacacacaggcccagtgcaaaagtaaagcaatcaggaagtcaggaagaaaagactgcattcctgcttccttctcagcaagttttgcaagcaatgggcctcctcgggcacaaagcaatctccacagccagggttctctcaggttgcttttcggggaaagagcctccaagcttcctgagagcccacccaccatcccagctggttattccctctgatggtaagcattccaggtagtgtggagcagccaccaccagtattcctccctgggactcatacagtcccagtttggggataaaacaaacatttccccagaacaggcagggaggatactggcatcctctcagctcccaggaaaagggtcatggacacatcccctcctggaggccagtgacattgcctgtcccacacccccttggactatgctacctgtatctaggaaccaaaggcaacacccagctcctttcactctcatgggttctggggacaaatgataacccactggacatggggagggcaccttcccccaaccaagaaactaaggaatcaagagcggagctgggaaaaggagctgcagggaaggagatgggctggacctagattcaggtgggccctgggcaggtccccagtaactgaatgaatgcccatgaggcacactcagtggagggcaaaggggagaaataagcccagaagcagcaaagtgacaagggaggagtacaagtagcacccaggaatccagcagaggtcagggagcttgggagagctagggcaggcagataaggttctgggctgttcctctttggggcgacagccagagaaatagctcagatagttgcataacccttctatttgcccagagcttttgtccagaaactctctgtcctgagaggtgattaaagaaggcatccagcaagaactgcacaagaaacggagtcagccggagaacaaggagtggtcttccactgcctcacaggaggatggaggcccacaacgcgtctgccccattcaacttcaccctgccacccaactttggcaagcgccccacagacctggcactgagcgtcatcctggtgttcatgttgttcttcatcatgctctcgctgggctgcaccatggagttcagcaagatcaaggctcacttatggaagcctaaagggctggccatcgccctggtggcacagtatggcatcatgcccctcacggcctttgtgctgggcaaggtcttccggctgaagaacattgaggcactggccatcttggtctgtggctgctcacctggagggaacctgtccaatgtcttcagtctggccatgaagggggacatgaacctcaggtaggcctgggggtgaggagggaacagcctgggacaggagctacattagatatgtcacaattgaggggaagagctgggctaaagccaggaaaaggagtgaatgcaggctgggtggaggctagggcaggggaagtctggcatttattgccaagagcttatgctgggatgggggcaggagttggggtacgtctggtttaggcaccaagccaaagggaccatactggtccaggaagctcgtggtgatctccttgcttccagaggtgtctcaaggattgtcttaaaggagcactgattaaagccaaaggaacctctggagaactgcatccacctacaacagtggacaagttgcctgctttgagcccagagatttaaaaggtagtgtgattcgttccaaacatcatcagggagatcaaggtgacttggaaccaaatgagcacctcaaattcctgcaaagcgggcaagaatttccaaaaggtcctcccaattacctggtcatctaagatgttttctctttaaagtccctcattccccatcagatgcaatgacatttccatgcaaaggcacaaccagggagatcctagagtttcccagcacccactccagataggccagccccatctcagccaccctgataaggggaagacagcagcaccccctaaccccctgcccaaagcattataagcagaaatcagcaagggctcgctcctggagacgcagcacacaggggctggttgatgctcatccttccaaactggggagactctagtcttgaacatctgccagaggagctacttcagacctgctccagctccagcagcctgtgctgaagctaaagaaaactcactagcagaagctcttgctttcagtgaaacctcagtctcaagccagtcccccctggtttagtcctccgtggagacgctattcaatgccaggtatagcagcagaacccagaaagtccatctgcttgtgtctgtcagcaccctactcctagccaaactttcctaggaaaactaacccagtcaagaagcccctcctagtgatgcaaaatgacactgggacagattttttaaatgaaaaaagtgagaatggctgggcacggtggctcacacctataatcccagcactttgggaggccaaggcaggaagatcacttgagaccaggagtttaagaccaacctgggcaacatagcaaaaccctgtgtctacaaatatatacatatatatttaattagccaggcatagtggcacatgcctgtagtcccagctacttgggaggctgagatgagaggatctttgagcctacgagttcaaggctacagtgagtcatgatcacaccactgcactccagcctgggcaacagagtgagaccctgtctctctctcaaaaaaaaaaaaaaaaaggaaataaaaaagtgagagtgaatgagagttggggtttaacaggatctgccatctgagaagctctgggctctttttccatatgattcagccctcactttagtagtcaatgggaagagaggcacaaagagggcatttggcttgtgccatcacccacggaaaggtatttcaatgttcaactacctcactgtgagaaaatgctttcctctgtctaatccacatcctctctgctacaaagcaagcccttggtcttggatctggcttctggacaaggctcatggcagcctgtgtgtcccaagaatcctagagtatatctgaattttggtgtatgagggatgcagaagtcaggggcctgcgaaggggtactctgagggctttgtgtttctgtggaagaagcagagcaggggacgtggaaggcaactgtgcttttaagtgtgagtggccagatgtcccagccccatcgccagtggccactattgaggcctctgccacaatgcctacattgctgtggctctaggccccacccaggcagagcctctggtgactcaagaacatgacccctcatgctctcctgctcaacctccttgtccagacccctgatgactgtcatttttacctagacccccacaagagataagctctgctgggacagccaccttctgccataaaactccttcccaacaaacaaccctcccatgcacattaaaccatgtctcagatcccactgtcggaatgggaatctggtcatctaccttcatgtgctgccagacttcaaatcccattccaatttgggacaacttgttacatgcattataataatgacaacgattataagaaacagccaggcacagtgctaaacaccttacctggataagtatatgtgatcctcctacagcaccctgggggacagcatgtaacaagtagcatttagaggtaaggaaactgaatcttagagaggtcaatacattggctccaggtctgggtggctccggaacctgtgcttttactgaaatatcttccaggtcagcatttccacaaacaaaatggccagacagcctcaaaggcatgggcagacacccgtgtctcagcagcaagtattgtgtgggagccagagcttcccacttttcaaaagaaggtaaaatatccattttatgtgaaatcagcaactcattccatttttttaaatgtgcaaaccaaacaatacatgtcaaagggccagctgtagcccaaaggccccagtttgagataagcacaatactctacatcccatttagaactggaaggaattgtaagacacagatcccattttacacatgaagaggctgaggtcagagacttgccagaggtttcccagagtttgtgggaaactgtgtctccctccactcactctgcctcataggtggagtcagtctggggacagcctgccatcccaggaggccaggccaccaagcagacccctcaatgcagccagggacggcagctccctcctcaaggaaggccactagacaagtttcaaaaaatgtaggtgacaaacaggcaagagaaaacgccctcacagttgaagtgagtatggcttgtcaggcacagagaagagagtgctatgccagcaggaactggcctcttttgaccatccttgctgccccaagttcatctgctccccctgccaccatcggactcacagcagagcccagagccaatggccatggggacaatgggcttggacacaacccaagcacttccacaggtctcccagccatgatgtaggaagctcaaccaggacaagatggaagccactggggtcccagaagttttccacttcatagagactgtgttgaggcccctcacagctccctcagcttctgcctccaatctgtgcattgacggacactcgaacgagtcccttaaatggggtacacagatgtccaaaagcaaggtctatgctgtgctcttggaacttaagcaggagggaaaaataaaaaaaacaaatgtgcccctttccccctgaaaggcaaccaggcctacaatctcaggaatctagagtctgaaaaagtccttgcccgtccctgtcccttggggtaaaccaaggatcacaacagtcacggatgccagcaggctaggagatggatgtccctgacctgaccccaggacctgtgcaagtggaggaagtacctggggatcagggaacatggctcctgcatacccaagctgacaaggcacaccaagtccaaactccaaaactcctgacacacaagccaaagtaagcatgattcctctgctctaggtcaccagaacaaacacacaagttgtgtttggcttttccctaagagaagatcaacagtagcattgaaaccccctgtattcctattcccaatctcattaccctccaccacttgccaaagggagcatccctgggaatttggtgttcagcatttccaccgacccttttcaactattatatacgtatatattcataaacaagatagactgcgggatttacgtcttttaattttgtacgaacagtattatactgtccacatcacctaacagcttgcttttttttttttttttgagaaataggcatgtaaagaaaatagctacctcatgtatctgaactgctgtgcagtttgcttgcatttatccattctcctgttgtcagattcatgtggattttacgtctcgcttctgtgaacagacttgtgtgtgtccctctgcccacatgagggcatatgcaattgaagcaggactgctgggtcgtgggagtcacacatctttaagaggtctccaaggtcattgttcacttcacacgttccctagcagtgtctgaagatccctgtttctctgtgccttcatctatatttggaattgtcagactttttaattttttccaaatgaaaacagtgaagcagatcgcagtagttttaaatttgatttcatgggaggcctaccacatttccacgtgtgcgttggccattcatgtgtcctcttctggaaacattgggtcctttgcctgtttttctatgggattgtggtttgggtgggttttgaaaattaatttctaaagttattgttttatatatgttgcaacagtctattcacagtttggagctggtctttacactttgataataatgtctgatagattgcttatgttaatttagtcaaatttgccaatatttttcctttgtggtttatgttttttaggggtttctttaagaaatcttttactatctacaagcctgtccaacatggcaaaaccccgtctctactaaaaaatacaaaaaaattagctgggcatggtgatgtgcacctgtaatcccagctactcaggaggctgaggcatgagaatcacttgaacccaggaggcagaggttgcagtgagccaaaatcatgccactgcactccagcctgggcgacagagcaacaccctgtctcaaaaaaaaaaaaaaaatttactgtctacaaagttacaaagatattaccctgtattttctttgaaaagttttaaatgtttgattttcacatggagagctccaatcaatgtagaacttatttttatgtatggcatgaactaattttatcttttccatacaaatagaagattccaagccacgttgagtgaatttttctccaggtatttgtaatgacatctctctcataaatgcagggcttgtgtctggatctctcttctcttctacgggtctatgtggctacccttgtaccagttccacactttcttaattacaattttataagttttgttatctgaaagttaagtccccctactttgttcttgaaaatcatgggccgggcacagtggctcacgcctgtaatcccagcactttgggaggtcaaggctggccgatcacgaggtcaggagatcgaaaccatcctggctaacacggtgaaaccccgtctctcctaaaaatacaaaaaattagctgggcgtggtggcgggcgcctgtagtcccagctacttgagaggctgaggcaggagaatggcgtgaacccgggaggcagagcttgcagtgagccaagatcacaccactgcactccaacctgggtgacagagcgagactctgtctcaaaaaaaaaaaaaatcatgttagctattcttagccttttactctttcacttgagtttcagtatcacctttcaagtctacaaaaaaaattataagtctggaagttttattaaatgtgcattacatttatatataaattgagagactatctttataatattgaatcttcccatctataaatatgatatagcttttcttttacttaggccttttttaatacctttctataaaggtttgtaatttctttcataaagatcttacatgtcctttagatgtataagtattttctagttttgtgaatatcataaatggtgtcttttaaaatatatatatatttgtttctagtatatcagacccaattgattgactgactgatgctaatgtatttagaacctcatacattttcttacttaccagttataatggaaaattacttagatttcttctgtggacaatcctatcattggcaaaacaagaaagtttcatttcttcttttcccatccctatactttttctatttcttgttttgctgtgcttactagggcctatatatagtataatttataaaacaggtaataataatgactatctttgctttattcctcttgttaaagaaaatccctctatttaccattaagtttaacgtttaatatactttttctaatagatttcctttcaagttaaggaattttcattccgttgctagtgtactaaatttttattatgtaagaacattaaattttgttgacttttctatagctacaaaattgtaccatttctttaataatatagtaatatgtattaatagattatctaatgttaaatcattcttactcatcttgttcattgtattttttaaaacacttatttgctaatattttattatttttgtttctatgttcataaataagagtggtccccaattttcttttctcgtaatatcattctccagctttcgttccaagatcatattaactttatacaataaattagggcatgtttcccctttttatattatctggacagatttgcataatattgcaacaatctgcactttgcatgtttagtagaacactaccgtaagacagtataaatcatgtagggttctagaagataggttttgaactgcttattaaatgtcttaaatgattctaagttgaatcaggttttcggcttcatattgacttggttttgtaggttatatttcccatgaaattgtccatttaagttaaaaatgaaagtatgaaaatgtccttaatgactttttaaaatcttcattttctctgtagttatgttccctttttcacactaacctcatcaatttgtgccatctctcttttccctggtctgccttgccagaggtgcctatttaattggcctttaaaaaaaaaaagaaaaaaaaaaaaccctatttttggttttactgattctaacaatttacaaaacttaaaaaatttcttccttttctttttattgggtttttctcattctaacctcttaaggtgcttaactcattaatttttaatcttctttttcaatataaatatgttaggctataaattgccctttaataattgctttatttgctccctgcatggtttttaattactatttattgagatataattcacataccataaaatccattctttaaattgtacgatgccttggtttttagcataattccaagcctgtgaacctatcaccattatctaatttcagaacattttcaataccccaaaaaggaactccatcccatttagcaggagtccccatttctctctcctgctccaacccttgacaaccactaatctttctgtctctatggatttcacataaatggaagcattcaatatgtgaccttttgtatctatacttctttcacttagcatattttcaaggttcattcatgtgatagcatgtcacaatacttcatttgtttttgtaattgaataatatcccattgtatggatataatacattttgctcatccattcattcagctgatggacacatgggttgtttctacttgttccctagtatgaataatgtctatggaagctcacaggcaagtttttgtgtgaacatgctttctgttcccttgggatatatacctaagagtagaattgctgggttatatggtgactctgtgtttaaattttctagaaactgccaaactattttccaaagcaccattttacttcccaccaccagtgtatgaggattcctaattttccatataccctccaacacttgttattgtccagctttttaattatagccatgctagtagatataaagtggtatctcaaagtggttttgatttgcattttcctaataagtaatgatgttgagcatcttttcatgtgctcattagccatttgtatatcttctttgggaaaatatctcattcaaatccttggcccattttttacttgttttttattattgcattataagagttcttcatatattggccgggcgcggtggctcacgcctgtaatcccagcactttgggaggcccaggcgggtggatcacgaggtcaggagatcgagactatcctggctaacacggtgaaaccccatctctactaaaaatacaaaaaaaattagccgggcgtggtggcaggcgcctgtagtcccagctactcgggaggctgagacagaagaatagcgtgaacccaggaggcggagcttgcagtgagccgagactgcgccactgcactccagcctgggcgacagagcaagactccatctcaaaaaaaaaaaaaaagagttcttcatatatattctgaatattagacccttatcagatatatgacttgcaaatatttcctcccattctcttgttggcttttcactttcttgatggtgtcctttgaatcacaagtttttaatattaatgaagtctgacttgcctttttctttggctgttcgtgctttagatgtctaagaaaccattgcctaatccaaagtcccctctccatgttttttaaatatgtattttattatttttatattctaaatactgtttccaccatgatttcatatttgatgatataattagaaagttcccctcccctcatcccatgatccttttattggttgctcagtttcaatgctcctcccatcccaggtctaatacctcaattctggtcccttccttgggcattaaagcctccacagtgccaagactaacaccccactcccctccagaacccctctatgaagcttcagcttgagttcccccactactttgcatttgtttcttgtccgtgggcacctttttttttagtggagtggcgctaacatagctcactgtaacctcaaccttctgggctcaagccatcctcctgcctcagcctcccaagtagctgggactcctggtgcacaccaccacacctggctaatttttgtgtgtggtttttggtttgtttgttcatttgtttgtgtgtagagacaggggtcttactttgttgcccaggctggtctcaaactcctggcttcaagcaatcctccctcctcggcctccctaaatgctggaattataggcatgagccactatgccacacttaaattgagtgttaatttcttacaagctcaagtgtgtatttaagtgttcacgggggtgggggagttcctattacctagttcacaattttctttgagggactcttctcacctctaacagctcttatccttatgacatgcctacctattgttcttgatggctacgctctggaacctttgatataggctgctcttcatgcatatttaagccatattccatctttatagaaataatgaaagaagtgtagatggagggtagggctgtggggaggaggagggacacactgagtgtggttttcctaagatcttgccaagccctcacctcccaaccatcttcccactggaataaaagtcagagccatatattgttaatgtaaatgtccataaatctaaggagatgccctatcagcttccttctcagttgacctttctggagggcctctccctagacagggtcctgggactaacatatataagattccaaatggaaaaggaaattggacaagtaggatacatattagagctggaaggacatattattcaggctctgagtgtcataatttattttaaataatatcaagaggaaccagaaagtaaagaacatgagaacaccagagttggggactggaatactatccaagatgcaaagcaaatctgaccaggttatcttgtcacttactcaacatgggtatctattactgccttctctactaccccaccattatggcccttcaattattctgtttcttactgcttcactatttcttttacagtccttttaatcatggtatctgtttattgatttttctagtagggtttttgacttctgcctgagcatcactcccatgccacccatccccaaagaccaagtgtcctgtcactgtgtctcacactcagactccccacgaggtaaaatgtgctgatatagctaattgttattgtctccgttggacaaagtcactacaagaagccattccctaggctctaaaccagacatttagtaactgtgggtcaggtgccattccatggtccaatgggctaatgaccagagtaatggaatcacacagttggctttctacaaaatgggcttggcatgggggaggtgctcaatgcgaaaagggttccattacagagaaggagatcagaatggctccttccacaatgaagcacacagggattgaagcagttgaaccaccctaagttcaaatgctgccttggccacttactaccttgtgcgactttgagcaggacacaactcttctagtccccagcttccttgtcagcgaaaagaagatagtatgcttactgcctaatgttatggggaaaaggaactgaagccacatatgtcaagcacttagcacagtggcacttagcaggcactcaacaaaatagtctgtatttatgggctctctctctctcccctcttcccatgtctcccaccagcattgtgatgaccacctgctccaccttctgtgcccttggcatgatgcctctcctcctgtacatctactccagggggatctatgatggggacctgaaggacaaggtgccctataaaggcatcgtgatatcactggtcctggttctcattccttgcaccatagggatcgtcctcaaatccaaacggccacaatacatgcgctatgtcatcaaggtaagaacctgggaggcttgacaaattagggcaaaagagtaaaaacaccatatacaactataagatataatcattatattaataataaacatacatatgctcctactagatgctaagttttatgctatgcactctaaggattcactgtcaccagagtttgatatttgcagaaagtgaagtaacacatgaggctggcgtggtggctcacgcttataatcccaacactttgggaagttgaggcgggtggatcacttgaggtcagaagtttgagaccagcctgaccaacatgacgaaaccccgtctccattaaaaatacaaaaaaaaaaaaaaaaattagccgggcatggtagcgagtgcctgcaatcccagctactcaggaggctgaggcagcagaatcgcttgaaccagggagggcaggggttgcagtgagccgagatcgcgccactgcactcccgcctgggccacagagcaagactccatctctaaaacgaaaaaaaaaaaaaaaagaaaagaaagaaaatgaagtaacacacgagagaaacaagatccaattccagtgtacacgcaagtatttgcagaaggcaaggagatgggaacagtgagggctggagtggtcaaagagccttattaaaaaggaagggcttgaggcatttaggtaaacctggggagaagcctgaatagagttcagcaggcactaagggcaaatttggctgatgtggcaagaagctagaggagacaggtagtgtacccattcccagcatttcaagagagggatggggtgggaagtggagtgaattaaggccacaaaggttttgagaagcactgtggtcacagacagggcatcatgccactgctttgtgtgcagaactcctagagtgcagctatggtctctccaccaatattttcaaccttggagtttggtccctgccagcctcccccttggctcactattcatcccccagggccaggaggtcatcctggtcctcaggaaggacttgacctcctgacctcctgtaccatctctgcccctggatcaatgcctctggcctggtctgcaaggcgtgctgctgagaaccccaaagtttggcagcagctttgggcctggaacaaagaagtcaagagtccagttttcaggggggttttattttcacactaccattgtctcaagagtagtttttgcccttgtcctgtcccagtgccatggccacagctccccttcccgcctgctggaggacatggaggaatcatccctcctcctttctgtggccagtcaccccacctcagccctggattgcaatcattctctctacccttgtactcaagagacctccttttattgattatgcccctggcccagcagcctcccctctctctcatttctaaaatatctctgtattggttcttcacaatcagctttgatacgaactcacatatcttctatcttcaaaaaacaaaacaaaaagtgtctctcactgggattttttgtggaatccacctcccattccacctaatatctccctttgctctccttcctagccaggttttaggagtagtccccctcactcctctctctctctgtcaatcgcttcctctcaaacaccttccatttcccccatgccaccgccagagctctctcatgagtgaccaggccctcagcaattcgtttccattatttgaatccctctcttctctccttggtctcccatccacccagcatcttgatgaccacctgctccactttctttgccaaatccaatggacatttctcaatccttccttgaccttctagcagcattggacataattgaccactgcctcctcaaaagccttctctgtcagctttagtgactctaagctctgctgctttcctcctacctctcatgaccttcagactcccttatgagttcctctggtcaaaggcacttctctgcattcagaccaagctttctgcctttctcaccagacctctcccagcacaggatctggtccctctcaggtctgcaattaccatctgcaaaccgagacttccagaacagcatcatcagatgtcaactctatcctcactccagaatccatttattatctaccaggtctttctatctgaatatacctcagacatttaaaactcaatatatgttaaagtcatctcctccccatgtggttatctcagtcggtggcactgtgtgtgtgcccagttgccccaaccagaaactggaagtcattctcaatgttcccttctccctcaccactcacacccatctaatcaatgactgtcgattccaccttctgttgctggaatccattcattcctctctatccttacctctcactagacaactcaaatggccttctcatccaacctcctcacccagttctaacctgagggtgaagatgtgaagtacaaactctatcatgtcactccactgcttaaagcctctcattgactccttccccctaggatagtttaaactccttaatgtggcacttcttgatttggtttcaactgacctcaccagtctcagctcttttctctttgcacgtgcccttctcttcacctggaacactcttcttcccaattctcaccccactcaccatctttcactggatcactcccactcatcctttaagtctcaacacaaatagcgcctcccccaggaagccttccttaacctcctaagcctgagtaagatgcttgtcctattcactcccataacacccaacactccagctaacccctgtagcaattattacactgcattaagaacatctgttcatttttattccccactcatttatcaagaagcaagaccataaggctgtcttaattaacactgaatccacagcacctatcacagtgcccccatagctaatgcctgagaataaataaaggaatgaagggcaagtcctgtctgctgctcttccacacaccagcagaaaaacaacatacacagagaaacatgtttgtgtgcatcatttcatttttttaagatagtttgtggggtgcataagattgcttttttaaaaaatcctatacacccataaacgatcttaaagaaatgcatataaaatataaagaatattaaaatgtgaagtgaccactgctatcatttaatgctactctgccctcctccattttataggtgggaaaactgggaaacagaataccaagtcatagtgctaatgacaactgatgtgagaacatgtctcttttctacctcagagtagctttaaaagtgtttctctgaggttgcaaaaagcagaatctcagaccctttttttttttttttttcgagacggagtctcactctgtcgcccaggttggagtgcagtggcgcgagctcggctcactgcaagctccacctcccgagttcacaccattctcctgcctcagcctcctgagtagctgggactacaggcgcccgccaccatacccggataattttttgtattttttagtaaagacggggtttcaccgtgttagccaggatggtcccgatctcccgaccttgtgatctccccgccttggcctcccgaagtgctgggattacaggcgtgagccaccacaccttgccgagaatctcagatcttaaagctggagaagcctttaagatgaagttcagtctcctgccttattcccaatttgcagatagagtaaccgaggcccggaaaagttacttggcagagccaggattatttcaaccagtctgttcctgttgtgttgcacattcactactcaatgccacagacgaaatgaagtcaaaatgaagccagagaacattaaaagggctaagaaataccttggctggaaaaacagagactagtaataagggactacataaaaggtaatctaaaaaacccaggcatgccctggacccattttgcccctggctaaacctccagggttaaaccaccacaaagtcaacagctacactgatcttcctatattccaaaactggaatcactcctgtgaggatgcagagactaacatgtgggtcaagctgcaaaagctaaggtttccttgcttctatggctcttcgaggactatgctcatccttcgtcaccctgtcccataaataatatagtgagtgccaaactggaaaacgaacaaatgattgtcctagcctcttacgcacacataaccctccttggaccttgcaaatcaaaataacccaactttcaataactagctctggcagcaggtatctgctcacaccgggttcaaccagttgcattcgctggtggaaggtcacatttagatataccaagatacaatttcaggcatgctcattttaaaaggcaattcaagtaatttttaacttacccatgcaagggtttatccaaaggctatgtggctaaaagggtgatgaatctgagaatgacatggtccaggagccactttcaccataagccatccaccactctttaataaggatcccaccatttcattgactcaacactctactcatgcatttcccacacctgctgctactgctgaactgacccctaactctcctttgtcttacaacttctgccaacttgtggctattgctcccagacctctgttctgacacttgtccctgctattgcttccctctctgtaatcctgcaaacttcctaaatgagagaatctgattatttctaccactcaccagcctgtgcgggccacctttgtgggtagactgtggacatgtcatctcatgtgtaagccaatggattggctgcccatgaatgagcactcatcccagttgtgagcagggcaatgaagtcaggtggtacaaaatgtggtagcctatggagaagcaactacccggggccacttgtctcagcaggagacaggggttgtagacaggataaatttccagagatggcagcagtgagagtgacaggaacctctagaatgttaattcctcccctttgagtaataacaggagttacagtttagtgagcggttcttatatgccaggtcctatgccgtcaacctcactcaggttgagtgactccccagagcttacacacctggagactagcagagccagctttcccaccaggatcatatcaaattatgtgctcataaccacaactgtgcagtccccaagagtcagagaacatgagtgagagaataagagtgaatgcctatacagaagaagagggcttctggattcgtggacaattcctgtaactcaatgtctcctacattatccactccactcttgatagagattaaaaattatttgactgttgggtaaaggacaaattcgaaagacagaaatctaaaaggggaaatcaactaaaaatgcaaaggtaaactgagaagttcattagctaataagtcttttaataaaacttgaagcacatggttattcaagagatgtgtgaaagtccttcctatgctgggataggaccactaattggtataggtgatgttttatatgatcatatcagttgcaacaagtattaaaaacagaaacacaaagctgtgcagctgaaatttgagcaatataaatgttaaaatgtcgttaggacattatgaatgtacttaatgccactgaactgtacactcaaaagtgattaaaatggcaaactttgctatacatattttacttttttaaaatgttactaggaaatataaaatgcaacacatgtgaatgaaccaaaaaatgaaccaacacatgtaactattacaaaataacatggtaagtttgagaaaagttaagtatttctttactcaggagataaaagggacagtcttaaatttacacatacctgtttatcattttggaggacgcaattctctaaaatgcacactggaaagtacaaagtgcatggagtgcacatgcactttgaaaggttgcatcctatgttgcacaatgaaaaaccctataatttcattcagagtagacctgcatagtttccaatgatgttgttatcacccaagatatttctgaaagttcttttgggaacttccttcatattcaatttgcaggtcactcaagaaagtaggtttgtccccttattattagacatcattttgggtttaaaaccgtatttccgggcttgatcatccaccttgtttaccagctttgtttcaaatgactcttggcaatttccagaattgatcctaaaatggataaaatccctatctgtaatcaaggtatttgagacaaatatgtatgacaagttctcatgagtttcaaagtatgtggaacaatgacagtattgtaggaatgtgtatataagttccaaaaatacttgacttttaaataatatccattttgcaggagtcctgaatagcctcacgtaacacttcactgaaagtctgctatccagagatgtgtcaaaagcagtaactgtgcttggctgagtttgtaataatcaaagtgttaatcagctgtccccaagcttcctagctactgatacgaaatctaaaaagatgggctgggtgcagtggctcacacctgtaatcccagcactttggaaggccaaggcaggaggaccgctaagagtccaggagtaagaccagcctgggcaacatagtaagaccctgtctctaatgttaataattttaaaaaaatttaaagaaaggaatccaaaaagaagataaaggtctttcatattcctttccacttccagtgttttattgcaatgtttcccacctccaatttctacctgtgcttccccacctctgttcctctctatccccaactcttctaattgccttttcttgtcttcattcccagggagggatgatcatcattctcttgtgcagtgtggccgtcacagttctctctgccatcaatgtggggaagagcatcatgtttgccatgacaccactcttgattgccacctcctccctgatgccttttattggctttctgctgggttatgttctctctgctctcttctgcctcaatggacggtaggtattttttttttttttaagaaagggtctcactctgttgcccaggctggaggggagtagcacattctcagctcactgcagcctcaacctccagggtttaactgatcctcctgcctcagccccccaagtaactgggactataggcacaagccaccatgaccagctgatttaacttttctggagacagggttttaccatgttgcccaggctagttttgaactaatgagctcaagtgatccacctgcctcagccttccaaagtgctaggattacaggtgtgagccactgcatgcctggagataggtattattttaggtcccactgtcccatgggcttcattcttgtcctagtctttcaggaaacgaataagaagctaggaacctgaaatctgggcaagacactttcctggcaatatgttcagatgcactaactggacaagagactttagacttgaaaaaaattgaatgaaggtattgaacgggttaaaaatccagacaccaaaggtatccaaacaccagcagcaatagcaaagtacccctgtccagggtctagattccatctgctgcgaaactctttggtagcagcactgggacaaagttgctccctccagttccctctgagtgtatgtggggttttcttcaccggcacaggtgcagacgcactgtcagcatggagactggatgccaaaatgtccaactctgttccaccatcctcaatgtggcctttccacctgaagtcattggaccacttttcttctttcccctcctctacatgattttccagcttggagaagggcttctcctcattgccatattttggtgctatgagaaattcaagactcccaagggtgagtactgaaattatccccacttcaagttctgctccaatattagacctgagcctgccaacaagcaagtttctagcagggactttttggatagggctttaactcttatcaagtcactaagaaccaggtagccccaagaagcacccaagaagcattaaagatccaagactacttccatcaactgcactccatttcttccttctagctgggagaatgaaattgcagatgcagtttacctcataaaactgaagcaatttgggctgctttgtctcagtggggagacatcataggacaaaactgccttggacaactgaggttattagttgtgtgaaaggcctctattcgcaagagttggggaagtttccatttctcaggactaggttctcatttcctggaaccagatcagagccacagcaccactggcacctccgtatgaggaaaaacatatgaaagcaatgcaccctaatataacccagaataaagaaaaaaaaaaaagattcctcaactctagttacgcagtaaaggaaacttaagcatacggttgttaaacagtaactacctccacaataaacttaatatgatttatactttactctgatcactatggggttaacatagcatctcttctctaaaatgctcagagtattacctttcaaaataaaattgaacctcaagacagaccagagaacagagtgccttcctcaaagtgcactttaacaccaatttaaaaaaaaaaaaaaaaaaaaaaaaaaaacaggacattcaaacccactttataacacatttcattataactctcaacattagtatattcttcctaagtacctacccaaatccttcaactgtcccttcatgtccatgaattgaagtccccttcaaaacctttctagaccctagggactgtgatttacaccctaggagaaatacacaactttccctattggaatttgttacattatactagcaagcaaatgccgattctctctccctttgcaattagctaagatgtaattaggttgccaagcagccaacacgaaacaagtacaggctgaccatacactagaaccattttagaagctttggttcaaagctacagtagagttgtgagaaagaatctactctgatgcttatctgagaggaacgcaagagatttgctgccctcttacaaaaagtgcacagaagtttctagaccaaccaaattcccagatttgaggttttagtaccagaaagacctgaagtgacctcaaaggacaatactctatggatctttagctctcaagacttgaaaagaactttcctcacagtgtatctcagaagaccccagtggaaacactaaatcaaagcaacgtatttctttggacctaatggccccaagaagctattctcaggggggaggaatctgtcaagtttttatacttttcattcctgcacctgatgggagaacaactctgtatagagaactctcccatctgtatagaaaggtgcaggaatcaaagctatcttcaaatttgcatcaccgcctacaccacggacaagaagaggtagatcaattgggggttggagggaagaactggaaactctcttggttagactttctcgaagatctttcctgcctgcctcctcattccctgaatgcaacacagaccttgcatacataaactcatctcctgttgttttactgtataacgaagttagaagtgaagtgatgatgaagacacaatagtctaattcattaggacttttactactagtactaccattagggagactgaggggaaagtgagtttaaagagtaaaccatgggagagacgacagagatggaaaatatatacttagcacactctagggctgagttggtatttttgtactttccagattaaacaagcttcattgttcactcctcttgttctctctctacacctgtaaccctttttaactttacagataaaacaaaaatgatctacacagctgccacaactgaagaaacaattccaggagctctgggaaatggcacctacaaaggggaggactgctccccttgcacagcctagcccttcccctggtggcctggattctggtcccaaagcaattctgaaagccagtgtggtaaactagagagagcagcaaaaacaccagtcttgcctgagtctttctccagcatttccagtacatctatcagaatcatcaagtcttggccgggaacacagacagggtgtctacccaagaagcctcacctatccccaacttagaatttgctacttattttaaagacttgttcagtgactgtaaactctatgaaaccagaaaccgaatctgcctcttgctgggatctctaaaagtgtctgataagcatcttaaagtcactcaattcctgaactaatcaatatatatgtttaacccattactcaaatacccaaatcccattccaagttttgtgacccaaaagagaaataaatgctcacaagtgctgtagaattaaacttcagaagttctaacctaaaaagttcagatcctattccttcccttttgacattattgggatgatgctcccgaaaagtcaaatttgacatcaagtatgcaaaagtgaacacagtaagatgcaatcaggcaaaacaaactcaaaaaatagctaatgaaatgaaaaaactgggcgaatgcatcatgttagtagaggaggaaaacttttgacaaggaaaaaccaggaaacaaacacatacattaacacaatgttacctcactaataatctcttttttaagttcagtaggtatttggttttaacacaaggcgcccccaaaactgggtacagcaaactactgccaaaatgagtcgtttcccaattcaaagaaaaatgttcaaatacctagaattcacaaatttcaaattgtctctaataaaatttaaacattttgcatatcatatgtaaataaggatcaagtaaatgattaacaactaatattaacaattacaaaaagtcaatcatgcttattagttacttgggatttttatcattttgtatggtcaggtacaaatgaaaccaagacaatatagttttcgggtatcagtttggcaaatgtgcaggactaacaagtactcccaacaccaaaacgagaaacacagatttgggttactaacatcctcttaaaaacgcagatttttgacaaggctaccacctatcatttttacttattatatccatatatacctacctgttcaaattgttttctctattatctaaccaacatcatctgctaggagacttggttacatacaagttatgtaagaacacatttgtttagcttttgaggaagacagggttggcctcaaaccattcttagaaaggaataaagatggccggatgcagtagttcacacctgtaatcccagcactttgggaggccgagtcgggcagatcatgaggtcaagtgattgagaccatcctggccaaaatggtgaaaccccatctctactaaaaatacaaaaattagccaggcatggtggcacacacctgtagtcccagctactcgggaggctgaggcaggagaatcacttgaaccccagaagcagaggttgcagtgagccgagatagcaccaccgcgctccatccaacctagcaacagagcaagaccctgtctaaaaaaaaaaaaaaaaagcaaggaataaagatgaaactaatataaacatagaaaacaaaggttaaaccatgccctacaaaggcaggtcctaaacctttccttaggattacatccacactcctcatggtatctgaagcctggttttgagagtccctttttgagacataattgttatctccctgccatttttttcaaaagaaggaatttatcgtactccctaacacctctaagattaaaagtagcttaattcttggctgggcacagtggctcacacctgtaatcccaacactttgggaggccaaggcaggcagatagattatttggagtcaggagttcaagaccagcttggccaacatggtcaaacctcatctctaataaaaatacaaaaatcagccagacatggtggtgggatattccagctcctgggaggctaagacattaggatcacttgagcctgggaagtggaggttccagtgagtcaagacaccaccactgcactccagcctgggtgaccaagcaagactctatcccaagaaaaaaaaagaagactggcagagtggctcacgcctgtaaaccaagcactttgagaggttgaggtgggtgtatcacttgaggtcaggagttcgagaccagactggctaacaggttaaaaccccgtctgtactaaaaatacaaaaaaaaaaaaaaaatagctgggcatggggatgggcacctgtaatcccagctacctgggaggctgaggcaagagaatcgcttgaacccaggaggcagaggctgcagtgagccaagatcgcccaaactgggcaacagcaagactccatctcaaaaaaaaaaaaaagtttgtctgattgtctaggggtagagggg

SEQ ID NO: 13417 - DNA, 8824 bp, Human; identical to SEQ ID NO: 12644

SEQ ID NO: 13418 - DNA, 236474 bp, Human
  misc_feature (1)...(236474): n = A,T,C or G
tggtgtcccaaagtgctgggattacagatgtgagccaccacacccggtttctattcttatttttaatacttaattgttaacacgtatatttaaacttataatgtcctatatgcaatttctcaatatcaataatcttttgaggaatataagactcagcacattttcatcttgtaaccctcctgcaactcccatttcttatgacttgggttttctctacttctctatctcttcctctgttgaaaacttttcatattatggaaaaaattaaacatatataaaagtaacattagtataatgcatccttgtgtatgcatcacccagttcaataatgacccatcatgatcaatttctttttcatctgtaatcctcccctttctctccccaccttggcatactgaattattttaaattattttatccataaagatgttaatgtatcctcaaagataaggattctataagcaaagaaaaacaagaccattatcacaccaaatatttttcattccctaatatcagtaacaataattcccttatgtcatcagaaagtgagtatatccatttccctgattgccttacagttttttaaactgttggtttttttccacttagaatccaaacaaggtccacatgttaaatttagttgatatgggttgataggtgcagcaaaccaccatggcacatgtatacctgtgtaacaaacctgaatgttctgcacgtgtatcccagaatttaaagtaaaattaaaaaaatttagttgatatgtttcttaaattcctttgaaaatatacgtttctcgtcctattttctccccacttgcagtcctctcttgtagtctatttgttgaagataccatattctttgccttgtagttttctacattctgggtatttggttggggtgggggggggtgtgtttgctgatcgcatccctgtggtgtcatttaatatgttcctctgtcacttgtattttctgtaaatctgtatttgcatcaagagacttgaaccaatcatatttgattatttgacaagtgtacttcataggtagtgaagtgagctttcctctgtaggcaagtggtatctttttgtgaccttagcaaccatagatgaatgtcacctagactcattgtgtcactagggatggccttgaggtttcctgttctattttcatttactaagcatgcactttagaaaggctctgagctgctccctgaagcatggcacccgtcctccagaaacccgcagtctagaggttgtaaaagaagatttgaacaccaagactgtaaaagatgatttgaacaacaacaacaacaacaaagcagttttattttgtatacattctttcattgtacctcccccagagggatataacctccaaataggggagccataccatagatgcattaaattcacaccaattcaaatgtgtgtatatatgtatttgcttgcagactactaaagtgacaatgtaaacgttgctgcctatttttcccactcttctattagattgacgttgcttttggtgagatggggcatgagtccaccatcctgtcccctctgtttccacatgaccctcatcgtatgaacacctctcttaagtgtgattctaggatttaaagatacatatttcttatgcattatgcacctaaacacaagccaactacttcatctggcacctgatccaagaaacaacattctgttccaaaatcaatagaagacaaggcactttaagggatcttcaagggagtgtaattttgagcatatggaatctttctaaccctagctaactttagaagtttaactcctatgcaagatgaagcatctatgttcccaagagtttgacttcagcaaaggacaagctgcagaagctgacattattgtttattttggcataaaggctttacttgttggtgaagttcaagtttaatgatctcttcctccctttctctctcttcctcctctccgctttccttcttcccttcctcccaccctgattttctcttttgcagtttgctgctttgtggtgcacaagcggtgccatgaatttgtcacattctcctgccctggcgctgacaagggtccagcctccgatgtaagtaatgggcatcgattgcttttctctgtccacagtcaatgctgccttgtgattaaatgtgagtgagcattcttagacgagtaagtgtggacgatctcactctaaggcatgtggtggtccctatagcttttgagacagttttccttttagtggaaaacaaaattttggagggagtgtggctggataggaagtcagctagtttgtctactatgattttgctaatgtcttcactttgagagctggagcacggagggtgagaggcagggccctacttggtagtgtggctgcaaaaaggtagtttcggtggtactttgcagtgcacgttatggcactttgttagggtgttctttcttttgttattgttattattatttttattatttttcagatggagtcttgctctatcgcccaggctggagtgcagtggagcaatctcagctcactgcaagctccgcctcctgggttcatgccattctcctgcctcagcctcccgaggagctgggactacaggcacctgccactatgcctggctaattttttgttttgtatttttggtagagacggggtttcaccgtgttagacaggatggtctcgatctcctgacctcgtgatccgccgcctcggcctcccaaagtgctgggattacaggtgtgagtcactgtgcccggcctattattattattatttaagagtgttgcccaggctggtctcaaattcctgggctcaagcaatcctcctgccttggcctcccaaagtgttgggattccaggcgtgagccagtgcaccctgcttgttagggtgttcctaatatcagggcccaggaatgaggaggaaatgaatttatcctgctaccatgaatctcaaagtatgactactgctagtgggacaagagatgcttgtaggtaaaatgtgcaaaaaatttttgttttaatcattataaatgtattttaatgtggattgggaaaaatgtatctagtagtggttttgcatttgtgataaggatatagaatttcctacctaagtaaagatttttaggttaaacaaaagataaactgatttgaggacaatattaagtgaatgacagtatgggtgatataaggatatggcaaaagttttggtacaaatgtgtttaaagtttagggtacattgttgattggcctacccagcagccattcacagccttcatccttctggcagaggctacctctcatgatggaagctaaaaatgcctaatacttgcttttcccggctctcttgtagctgctgaatgaggatgtgacccaatcctgctaatgggaactgaggggaagacctgggaaagagtctaggaaagatttttcctttctgataagagagagacatcccttcccttgtcctcttgggcatttttgtacaaggatataatgcttggagttgtggcagcccttttgggtcaatgagggacacattgccgacatcctgagcatggcagagtggaaaacttaaaagaaccgtgggtccatgatgatgctgatgagctgttgataccactcacagtccttttatccccaagctggatagatgggagaagaagctttttttttggccaggcacggtggctcacgcctgtaatcccagcactttgggaggctgaggcgggcagatcacaaggtcaggagatcgaaaccatcctggctaacatggtgaaaccccgtctctactaaaaatacaaaaaattagccaggcatggtggtgggcgcctgtagtcctagctccttgggaggctgaggcaggagaatggcgtgaacctgggaggcagagcttgcagtaagcggagatcgcaccactgcactccagcctgggcgacagagtgagactctgtctcgaaaaaaaagaaaaaaaagaagctttttttttttttttctttttttttttaagcaaagtcttactctttgaagccttctcttttatttttgtttttttctcttttgagacagaatcttgctctgttgcccaggccagagtgtggtggcatgatcatgtctcactcactgcagcttaacctccctggctctagcaacccccccacctcagccgcccacgtagctgggcctacaagtgcatgccaccacacctggctaattttttatttgcttgtaaagataggttttccctatgttgcccaggctggtctcgaattcctgggctgaagccctcctcctaccttgacctcccaaagtgctagaattacaggcatgagtcactgtacctgaccctgggggcattcttttacatgcagctgaaactgtcctagctgagaaggctttccaccatgcacagtctttcattgcccaataatgaactgcgttcagcataccccaatgcagccatcacccctagttctcttactttgtttctgctttgaatccccttcttgaaatttctcccattggctttgtctccattactggttctgttacccacttagacttgacagctgacagcttgcccaaagtgagtagtgactatcttctgtcattggatttctttagctcctgctggtcttctgcaaatggtcatctgccaatttgctgcaaactggggtgggagtttgtggggagggcatatctgttgccatagcaacacaaagatgctggagcatatgttggatattctttgcttggaaaatgtggtaattgaggttaagaactccaagaaacatggaacaaccaaagtccttggaaatctgtttgcaaagacaaagtttgagactgtttgtcatgttctctcagatcctatgccctagcccttgtagtgcaatttcttctctcctccctagcaaaataggcaggggagtttggggagactgccctactcagtatgcagctctgagtgttcatgcagactgaaacttgatactcaacttgcagccaagaagatggtgcttcccatattctatctatctgctgaatgtttctgttgcctaagacagaaactcagctcaaactgacttatatgaaaaggaaaattttgggtccttgaaatagaaaaggcctaagggttgacttggcttcaagcacagtgaatcaaagttctaaataatgtcctcaagaacctgtttctccccttcttggcttagcctttgtctgtgttgattttattttcaggaaggcttgtctcctatgcgagcatggtggctgcaacacctttaatcttatatcttatcagtgctgcagtgcagtaacaagagctaaagtctcattagaccatgaatcacatattgccagaagaatgggttatgctgattggccaggcctgggtatatgctgctgtggtgtgaatgttttgtttctccaaacttatatcctgaaatcctaacacccaaggtatggtgttagaaggtgggccccttgggaggtgatcagttcatgggggaagagccctcataaatgagatagtgcccctataaaaaagaccccagagatatccgtcaccccttctaccatgtgaggttgcaatgagaagacagttgtgtatgagaaagtgagctctcactggagaccgaatcttccagtgccttgatcttgtactttctagcctccagaactgtgaggaataagtttatcatttaaaaatcactcaggttttggtattttgttacagcagccagaagggactaggacagaaaattttggtactaacagtgtatagaggaacaaaattttaaggatgggttttctgaattggtttcggggatttggtaattggctgccaaatctgattagatttaagaatgctaattaccctatttctagtagtaaagagagcctggatagtccatggcatgatctgtttatagagatacacaaatcatctgcattggatactcctaatcaaccatttataagaagcaaggagccaagtgattcgatatatgatacccaaacacttttggaaaactaaggcatataatgacttgctcctaatgtctctggacaaagtggagaaagaaaaagatgagctcagggatttgaattcccagctcaaagagtttcataaatgatctaagagcttctaggtgtgccctgaaggagagccttctagcctgtagttgcagggctgaaatttctgaaaattaaatgcacaacctcatcctgcaattggctgaattacaatgcaaattggactccccaccacacagggtgtctgctctaaaagcaagggcaagggcattgatcagaaaagaatgggatcccataaggtgggaagactctgatgaagaccctaatgaagctggggacattgagcccctaaattctgacaagtcttttttttaccagtggaagtggcctccttacctcaagcaaaagtgtcatccccactcagggtggcattggcctttccatcttgtctaagggaactaaccctgcattgccctaagaaacagtaatggctttccctgaggcagttgccatgccaggcaatgctgattcttgtcagcaccgaatcccaccaccccttcaagtcctagcaggctcctaaaggtgagatgcactgtgtgacccacggggaggtatgctataccccaaaagaactatttgagttttctaatttatacaagcagaaccatagggaatatgcatgggaatgatattaagggggtaggataatggtggaagtaacatgaagttgaatcaggctgaatttattgatagaagttcactaagcagagattctgaatgtaatgttccagcttaaggagttaggaagggctctaacagtttagctggttggctgaaacatggattaaaagatggcctatcatgagtgagttggagatgcctgacctcccctggtttaatgtagaggaaaggattcaaaagcttagggagattagaatgccagagtggatttgtcatttaatacccgctcacccatgctgggaaggtcagacatacctttaagaaaggtatgtctctgtcaatactttgagaaatatatttgtgaggggagccccagcatcctttaagagctctgtgatccctcttctctatagaccaaaccttactatgggaaccacagccacttaattggaaaacttaaatgcaatgggaataattgggtcctggagtatcaggggccatttggtggcactcaactgttaaaggcaaggtaggtgcggttaccttaatggatcgcagagttacaacaacaatcggaatagcctgactcatgcagacctatggcactgcctaatcatggtgttgctagaagtgaaataggtgggaagcctactaaattcttacttgatctgtatagcagaaaaattctaggtgaagtgaacagaagtctaacttgaatcataaaaatagagaatcatagcccctcagtccattcccagacttgagccagtttatagacccagaaccctttgaatgaaagggaggtaaaatttccttgagaaagcgattatactgctaaaagtttatcctgttaatctttctcccagccttgcccaaagggacctactgctttttatcaggataactgtgcactagagaaaaggaaatgatgagaccttttggggactactgaacactagttctgaactgacactgattctaggagacctaaaatgtcacttgtccctccagtcagaataggggcttatggtggtcaggtgatcaatggaattttagctcaggtctgtcttacagtggatccagtgagtccccaaacacatcctgcagttatttccccagttccagaatggataattagaatagacatacttagcagttggcagaatccccatactggttctttgacctgtagagtgaggcccactatgatgggtgaagccaagaggaagccattagaactgccccagcctaggaaaacagccaaccaagagcaatactacatccttagagggacagcagagatcagtgccatcatcaatgacttgaaagatgcagaggtagtgattcccaccatatcccttattcagctctcttatttggcttctgcagaagacagatgaatctagaagaatgtcagtggataatcataagcttaaccaagtgatcactccaagtgtagctgctgtatcaaatgtggtttcattggttgagcaaattaattcatcctctggtagctagtatgtagctattgatttatcaaatgcctttttctccatctctgtccataagacccaccagagcagttttattgcagctggtaaggctagcaatacaccttcactgtcctacttcaggggtatatcaactcttcagtcgtatgtcataatttagtttgcagggatcttgatcattttttccttccacaagctatgacaatggtcctttacattgatgacattatgctgatttgtcctagtgaatgagaagtagcaactactctagacattggtaagacatttgtgtgttagaggatgggaaataaatccaactaaaatttagggaccttcttcctcagtgaaatttctaggggtcagtggtgtgtggcatgttaagataccccttttaacgtgaaggataagttgttgcatctggacccttctacatccgagaaagagacagatggcctactgggcctacttggattttggaggcaacacattcctcatttgagtgtgttatgctggcctacttaccaaggggccccaagagcttctggttttcagtagggcccagaacagtagaaggctctgcaacaggtccagactgctgtgcaagctgctttgccacttgggccatatgacccagcaaatccaatggtggttggttagtggcagagagggatactgtgtggggcctttggcaagcctttataggtgaattgaagcacaagtatttaagattttggaatatggtcctgccataatccacagatagctagtttcctattaagagacagctcttggcctgctaccgggccttcgtggaaactgacgatttgaccatgggccactaaattgccgtatgacccgaattgctcttcattaactgggtcttatctaaaccaccgagccataaagtgggcatgcacagcagcacttcatcatcaaatggaagtggtatgtatgtgatcaagcctgggcaggctctaaaggcacaagtacgatacatgaagaaatggcctggatgcctgtgctccccactcttgctaccctgccttctctctcccaacttgcacctttgggctcatgaggagttagttccctatgatcagttgacaaaggaagagcagactaggacccagtttacagatgtttctgtacggtgtgcagacaccacccagaagtggacaactacagcactgtagtcactttaggacatccctgagggacaatagtgaagggaaatcttctcggtgggcagaactttgagcagtgcacctggttgtgcactttgcttgggaggagaagtggccatacatgtgactatatcctgattcatgggctgtagccaattatttgactggctgggcagggacttggaaggaatatgattgaaaaaattggtgacaaaaaagtgtggggatgaggtgtgtggatagacatctctgagtgggcaataaacatgaaaatatttgtgtcctaggtgagtgcttaccaaagggtgacctcagcagaggaggattttaataattgacttgatagaatgacccgttctttggataccaggcagcctctttccccagacaccctgtcatcacacaatgggctcatgaacaaagtggccgtggtggcagggatggaggttatgcatgggctcagcagcatagacttccactcatcaaggctgacctggctatggccaccgctgagtgctcaatctgccagcagcagagaccaacactgagttcctgatatggcaccatgcctaggggttatcagccagctacctggcggcaggttgattacattggaccccttccattatggaagaggcagcattttatccttatggaaatagacatgctggatacagatttgccttccctgcctgcagtgcttctactgaaactgccattcatggacttagagcatgctttattcactgttatgaaattccacacagcattgtgtctgatcaaagaaatcacttcaaagccaaagaggtgggcagtgaactcacactcatggaattcactggtcttaccatgttccccatcattctgaagcagctggcttgatagaatggtggaatggccttttgaagagtcagttatgttgccagctaggtagcaataccttgcatgcctgggcaagattctccagaaggctatatatgctctgaatcagcatctagtatatggtgctttttctctgatagccagaaatttatggatctgggaatcaaggaagtggaatgggagtggtaccactcattattacccctagtaattttaccaccagcaaaattttgctttcttttcccatgactttatgctctcccagcatggaggtctcagttccagagggaggaatacttccagcaggagacagaacaatgattctattgatagttaacactgccacccagccactttggggttcccatgcctctgagttaacaggccaagaaggaagttatgaagttggctggagtgattgatctggactactaaggggaaattggacactactctacaatggagaaaaggaaaaatgtgtctggatacaggagatccctaaagacatctcttagtattaccattacctgtgattaagatcaatgaaaaactacaacaactcaatacaggcaaaactatgaatggcccagaccctttaagaatgaaggtttgggtcaccctgccaggtaaggaaccaccaccagctgaggtgcccactgaaggtaaagggaatacagaataggtaatagaagaaagtagttacaaataccagctatgaccgtgtgaccagttacagaaacaaggactgtgattggcatgattattggcattattttgttatggatatgtttgtgtgtatatatacatatggtgagcaaatatctttgttttctttgctcttttagttctttatcatgtaacgtaagatgtattgactttatatcagtatttttatgtcttagtatttaagttataggataccaggacaagaggaatcattactcaaggacttcatctccttttctggggaggggattattgcattttcagttgtacaaagtctaattgtatcacatcaggtggaattatgtccttgttattctttatttggaggttctttatttaagaaggtgtgtatggatgccaagttgagaaagggtggacttgtgatggttaattttgcacatgcagttaaccttgactgggctaaggggggtacccagatagctggtaatacatgatttctgggcatgtctgtgagggtgttttcaagaaattatcatttgaatcagtagactgagtagaaaaattgccttcattgacataggcaggcaccatctaatctgttgaggactcagaacaaaaaggcagaggaagggtaaattcactctctctttttgagctggaacattaattttttcccgcctttgggtgttggtgctccaggttctcagtccttcagacgtggaccaggacctactccattggcacctatggttctcaggtctttgggctcagatttcaaacattggactaaactatacccctggctttcttggttctctggcttgcagatggaagactgtaggacttcttggcttccataattatgtacaccaattcacgttattgatttttttttggagaaccctgactaatacattgtgcctacaccgtagatgagggcgtgagtgccccttccatggattgagagtggggaagaggtagtttctctgaggaaagctagagaaacggtattgtgtcctggttaaaatcacggattatggagccagcattcctagcctcagatctgtgtgaccttggacaaataacttaaatccatttatgccttagattcctcagctaaaaaatgagttaaataatagtttctacttgatagcattgttatgagtatcaaatacatagatatctgtaaaagcacttaggacagtgtctggtgcatggcaagagctatatatgtgatgatgatgatgacaatgacaatgaataacagtgcacacatgctgagcagccagcaaggacaggtgtcttgtcagacagaccaggaaagggtgaagaatgagcaggttctctgtctgccacctggcagtccttcctagaagtgtggaggctctgtaagtggcatgagacccctctctgtatgaatgaaggagtgcagccattcattgccttgagcatgaggagagcaggaagtactccctgcagccagcatgcataggatttggcagcctacctgaaatgattctatctctggatacagttccaaaaaggtcagttggcaccaaggatgatgaattggtccagacacctgaactggcttgactcagttcattgacctttttctgctcatggttggaggcatgattaaagacctagccacacctgcttgcccacctggccagactctcctttagctgcccctgatactcatgcaggtatggaggggtgccctctccttctgcatgaccttggaggaactggtgtgcagcaagttcgtgaagcagaaacacacaggcggtgaccttggacaaggctccatccacgataaaggatgtgcttggttgcatcctctaccctctgctgttccaagcccagtctgagccaggcaatattatggatattagtagagctttgtgctgttggcattatcctacagctatgttcacatcatatcacattgaggcaattttatgaaccaggcactgtcccgtgaacctagctgctgagccaaccattcaataacaatgagaatagacaacatttatgggcactcgccattggagggccacaaagtgtggcagagttcatggatgatgctcctggtcacccacagtcatccttcttgttcttgatctcaccaggcaggaaatcctcaattcatctgtctcttgtacctcttagagagaccaggtctctggtactgtcataagcattacttatggacattataggttattcagcactcagaatactgaccacatacacagcctcctgtgacatctcagaacaagaaacagaggagttgtctctgagggttgggactagggtgagtcaagtgaggtactttccctgggcacagtttaaggggttctcgtctgtgtctgtggatagctggttggttggctggtgggtggatgatctaagatggcccctttcacatgactgacgacgagcaggttgtcggcctgtgtgatttggctctcgtccatgtggcatcatcctccatccaactggctagctctgacttgttcatatggtggtttccaggctccaagaagagcaagagagcatctcccaacactttttaagcctttgtatcatgtttgctaatgtcctaaaaagctagtctctggccaagtccagattcaagtggtagaaaaatagattccagtgcctcattggagaggaagtatctatggttaatctattgcagatcctgttaacccaagaggccatagcagaacagaacccctggagaccatcacactggactttataaaaatctgcatgttatagtgtggctcagagtcatagatggcctcatcaaaagaatgcacctaatttattccctgcctcaatcgccagtggacttaaccacctctagctataagtggttaatgtggcagtttattgatcacgtcaatggtggttaagagtatggactctgaaatcagacatacctgaatttgagtcttgattctgcccagatactcattaggaaaacttgggcatgtcgttcgacttctctatgccctagtctccttatatgtaaaataggatgttagtaccaaccacataggtttatagtgataattttaaaaatatttaaaatgagaaagagttcacaaacaaaagacaaatgaatttcaaagcccttacatgaaagcgcttggcacagtgcatagcaagcccttggtacatgtagctaaggccatttccattgctccacctaggtccataatcaagaatgtactgacaattctctacattcttccacccagagcatgcccttatgaggtgattacagtttccatttccattacttcacacaaacctcaaattctgtgatgcagtgctaagaaaagaactcaaactttggagccagaaaatgctggtgtcaaattccaaatggtctctgctatgtattgctccaatgaccttgggaaaataactttaagttctgtgaccctcagtttatgtctttaaaatagagaaaataatacctaaataaagcggtttttttttttggtaactattcaataggagactgcttgaaccatccctagaataatgtctggcacaaagaaggcactcaatacctggttttaaaatcattattaatgtctggaggagcctctcctgctctataagggatacaggttaccctctgacctgccaagaaataatagctaataataatagctaactttattgaacagggtctctgggcaggcagtacaaaaggactctttgtctggtttgtctaaagatacctttttcaacactttatggctttagaaataatttcttatgatttatagtcaagttactgagtaaaacccactgttaggtcctgtgatctcctaattccatcactaaatcaggtcaattagagatggtagacactaatgttgaccttatccttttgatcaagtctcactttgtgataagatagattaaaaatcataaacttgttaaacttgttaaatgttgaagatttgataaaacagaaatgaaagtattaaatgtatgtatacattaaagtatgtaaataagtgagaacatgtttgaaaatctggttgaaatggatgattttctcataaaattgtcaattttgtctcaaaaagaaattgaaaaccagaataggcaaataaccgagaaagaaatgaaaacattattcaaggatcttttcttctcgtaaaaccccagacaaatatgtttcatgggtaaaacttcttaaattttagagcaacgaagaatttctgttcatttaaaattgtacctgattacaaagaagaaataaagctttacaattttttttaaatgaaaatgagagaaatccagctcaaattagcagtaggaaaagagggcccattgactcctgagaaggacattgggagtagagtaagagcttcaggaccaaggacctcaaaggctggaactgaagctccagtacttgcaagatacttttccatttctgctttattggttagttattttgctctgtaacaaaccattccaaaatttagtggcttgaaacatcagttatttgtggtttctcatgattgtgtgggttacttgggtgattcttctgacctgggtttatttgggtaatccctgctgggctctgtcctgggtcttggtcagctagtggctgggccgatgctggattacctagaacagccttgctagcattgactgagggctggcaggctgtcgatctgggcgtttcatttttcctccatgcgtcctcttttcctccaccaggctagcttagtttcacggttccaagcacggcaagagagggaaatcccaaagcacaggtgtgtgtgtgtgtatgtgtgtgtgcgtgcgtgtgtgtgtgtgcgtgcgtgcgtgtgtgtgtgtgaaatggagtctctttctgttacccgggctggagtgcagtggtgtgatctcggctcaccgcaaccctcccagatacaagtgattctcctgcctcagcctcctgagtagctcggattataggcacccaccaccacgcctagctaatttttgtattttttgtagagacggggtttcaccatgttggccagctggttttgaactcctgacctcaagcgttctgcctgcctcagcctcccaaagtgctaggattacaggtgtgagccactgcgcctggccagcataggtgttttttaagcctttgtttgtgtcacagtggttatggacaagatcagatttggggtggagaaacaaacttcatctctggatgggaagaatagcaaagtcacatggccaaggagcatgcggggatgggagacattggtggccattgtgcagtctaccacactgacccttatctgctgtgccagatgcctcgtttgcccttccaatccactctgctttctctgagagactaagccataatgactgcttcaactggggctcccttaccctctgacctgacctctggttggactcaaggggaggggctaataggagacttggggaggggagagtgagaccctccccgagtcagtcagtatttattatggagtcatcttcactctaccttttgactataggttgctgctcctctacagatcatcttctctatgtaattctctccttctgggttccaggagctactcccttcctttgtcctctggctcttactagcctccaatcccttatacttgcccaacaccatgcccacacctttagaaacagtcctttcattgaacctttcttaaacactcttcactttagtatgccatctgtttcctgcggggcccctgactgatgcatctgctttgtcttgcctcatttgcttctgctgtagatggaacatgtctgcaaacatcgttacagttgaccccatggaaagatggcaaccctagtggaggaattagccttcttcctgcattcgtttttttttttttttgagacaaagtctcgctctgttgcccaggctggagtgcagtggtacgatctcagctcactgcaacctctgcctcctgaattcaagcaattctcctgcctcagcctcccaagtagctgggactacagatgtgcaccaccatactcagctaatttttgtattttcagtagagataaggtttcagcatattggccaggctggtctcgaactcctgatctcaagtgatctccctgtctcagcctctcaaagtgctaggattacaggcgtgagcgactgcacccagccatcttccctgcattcataattgatctcagaaaatgttctgatggagttggttctctatcattgggagaacgaactcttataacctcagacctggatcccatggcatccctttcacccaggagcagtgtatgttataagaagagtgaaggagaaactttgatgcgctgatgaaagtaataactaattattataagcttgcttaaccacaataaccgctattacctagtaaagttggcataaaaagtaaactacaagccagtctcatacatgagtctagatgaacatatcccaaataaaatagtgaatgctattttattgttgtcacggacattatgcattcaaataatgtggaggaaacaatctagagataaaacaacaaagaaaattatgatcaatataacaaaatataggaataaagataaaaatatgccagcaaggaaccgtggaatctggaaagcataaatttagatggtagaagtgatagcagaatgttacccaaccaatgtaaatggattgaaattctctactgaaaggcaaagactatgagattggatgagcaatgtacaactcttggcagtgtataaaagatgcttaaagcacaggttttaaaaataaaagggacaaaagtgtatcatgaaaatacatatataaaaatgaaacatggtcttaataatgatatcaaaagaaataggactcaaaacaaaaagcataaacgggggcagatgtcccagcagatcacttgagctcaggagtttgagaccagcctgggcaacatggcgaaaccaagtctctacaaaaaaaaaaaaaaaaaaaagaaaaaattagccaggcatggtggcatgcacctgtagtcccagctactcaggaggctgatgtgggaggatcacttaagcctgggaggtggaggctgcaatgagctgtgattgcaccactgcactccagcctgggcaacagagtgagattctgtctcaaataaacaaaactaaacaaaaacataaaacagggaaggagaaaacatgaactctaatgcattactggtgagtggcaaattagtatatgttttctaaagagcaaattttccatacatatccagagctttaaacacatttttgacctaagaattactaaatctaatcattttgacctaagaatgacaattctaggaatttttggtaagaaaccatttcaggataaatgcatagatttatctagagtgatattcattgcatcagtatttataatatcaaaaatttgaaaatgacccaagtctcactaccaattagagtttatataagtaaaatatattacagtcatatggtggaatgctggccagtgattcagtgtcacagtgtctggggataaggggaatgttctgtgtcttgactgggatggtgcctatacaggtgtacacatttttcaaaactcatcaaactatatgcttaaactctgtacattactgtatgtaaattatactttaataaaaagtcacagtgattaaaatgccattggcctggaaatgcagtcataatatattgctaaatgaaaaaaaaaaagcagacaacaaaacattaggtcaggtatgatagatttaaaaatataaaaatatatacacatgtaaagccaaaggccacattccctaaataaattttcgtgaatacttaattctgttcactgtcttatgccagacttgttacctgcagagctctgaaggtcactttgggatgttctgtagctggtttctccagttttgtttgtttctggggccactccacctctagtgcagactcaggtttcccacttagttcagtgaggaccaaacttgagtggcggttccggcgtaatcgggagtcacttacagttccttccaaatgtggttactcttgaggtcctccatccgctgggagtcagctcagttcctggactgagcatcttcaggtgcttctaataagattctggcctctgataagtcttgacttcaattcatttttggccccagagaaggggaatcttggctctgccaacaaggccctgtccatttcctgcctcagtgtgagtggcaggaagaccaccttgatcttcagggcaaaggctcgcttcctcctcttggtgtcatccggtctccttggctcagtaaagcaacgtaacagtcaagtgcacttttctcaacgcctggtttcttctgtcttacataaccccaagtggggacacccacagtgaactttcaaaaataatgctccttccagggagcgaagcagcaatgagggttgaacatctctcttgggatgaccatcacctggaccaaaagacccatttacatctctcaaggataagtaatgtcaggggcaatttagtctaaatgatacagtctccacctcccttcctcccttcctcccttcttccctctctcacttatctattatctccctacatctgaaagtgcaccatcctgctgaaatcacatcctgttcacataacactgcagtccatagcttctgaatccacacagaagttctcgtgggcgataccaaatgccaagaggatgccttagaaggagtctggagatactcgaggattggcctctctagctcagaggttacactgtcatcaaatgtccaaagagctcttgtatagaatttttgtggtgcagttctaaaggagaagtaggactgaggtccatctgtgcaggctaacgaagaacagcccatactgaccaactggttgctacataataatattagctccccatccgaggatagtaaagctcaattgccaggcatgctgtagagggcatagctgtggtagatgtgggtttctaccatgttggtggttctactagcttttgttgttttgttgcatgcaacagaaaccatctttggttaacataagttggaaaggaattcattggaaaagatgtggcatccttcagagcgttgaaagaaaacttgaacaaccagaccagttctatctgattttggttcttgtgttacattcagcctaaattcaaattccagaaggagagagattatctggccgagctcaagttgcctaacaaactcttgggtcgggcttttaaaatgttctttcaaagactaaacgctgtgggggtaggatggcttttcaaaggagaatcgaagtactgatacggggagcagggggtggggagggggaagaaggcacagatgttgcgccaattggaacaacgtgtttgctacaatttctaaatgctacattgcagattgcagagagattggatgacaggcttcacctgaagagatagagatcaggacctgggaatccatgtgttaaaaagttcttgggtaattctgatggatagctgggtttagaagccagtgtaaggcaatatgtataaaagctctgaaaccagaatgactgagtttgaattccagtttggccactaactagctgataatcttgggctagttacctaacctccctgcttcagtttcctcatctataaaaagaggataaaatggcacccacctcatagggtccacgtgaggattaaatgagttaacctagatggtaagagcttcatgccgtaactggcacataggacatgctagttaatattattgccacaaatgatcctttcaagtcttagattgtgcatttcaaaagtccatccttatttttggaattgcatgcatttatcttgctttctgcaaaatggaaaggcatctcccatgggctggttggagagaggggctgataaaatgatggtaatgtgataaaatgcagttctcttgattgtcaagtgaattctgcatgattcttctgctctcatttgccacgggctgactgcttctgcaatgcagaacccgcttgtaaaggtcagaatgaattgcttccaaacatccctttgtccctcactgtcacgaagacacagagctgcatgctgtggaggaagaagcaaatccatgatgctggaaggccagagaacagaaaccaaccgtgcacagagaggcgagctgctgggacttgaatgaagctgatgcgtcccatctataaattattgtggcttctcctagttgggaggcaggaccagcctcacaatttcccagaagaccgtaatttctggagcctgcaggcctgggggcaaatggagaaatcaaaaggcagatgaccttggagataggcagccagaaaggatgtgaaaggccctggttctggactcaagagacctcacgtttcctagtcttctttctgtctctgctcttttgtgttcatgaggttcatgccctcatgagggctcccccacctccagtggtctaggattctaggatgtcttggtattctttttcaaaaaaaaaaaactaagagccagcatttatagatataattctgtcctaaacactttacatataataattcttcattcttcattacaccctgtgagataggttatcattgttataattccatttcacagatgaggaaactgaggtactcagagactaaatgacttgctcaaggtcacttgtgagaggtccagctctaggccctctggcccgtggggctatgctcttacctagtacctcaaactgcctggtagacctcaaccctgtgtacctgcacaaatggtcctgaagcaggcagctttcttccctgagagctgcctttccagatatgcactgccaaaggtctgtgaccctacagccttggcctgatttggtccagatgcatgtggacatctctcccaaacaggatcaaattggcctcttctaggagtttagaatttggaatcaagggtgctggttttagtctggactggtcacacagtttttgacaactgtttattgtacgggaaaagtgtccagcttgatgaattctcacacagtgaatttttctttgtaagcagagccccagaagcccttctttgctccttctaatctctacacgtccctccccatccatcaaaataaccactaccagaccagcaatcctttggctgcttttccccccacccccagtgatctattttattttattttggaaagaacacgtaacatgaaatctatcctcttaacaaagttttaagtgtaaaatgcatcattgttgatgatggatgcagtacgagacagcagatctctggggcttattcatcatgcttgactgaaacttgatgcccattggtaagtaattccccattttgcccttcttccaggctgtagccaccaccctttcactctgattttctatcaatttgactatttttgttactttacgtaagtggaatcatctagtatttgttttcctgtgactagtgtttttcatttaccataatgtccttagggttcatctatgttgtctcattgcagaacttccttctttttggggggctgaaaaatattccatcatatgcataaacacattttccttatccatttgttcgtcagtggacacctagattgcttccacgtttagctgttgtgaagagtgctgcaatgaacatggaactgctaacatttcttcaggatgttaatttcaattcttttgggtaaatacccagaggtgagggtgctgaatcatatggtagttctatttttaatgttttgaggaaccttcacacgggctaaggacttgaataggcagttgtccgaggaagacatacaaatgaccaaaaggcatatgaaaatttaaaaagctaaacatcactaatcactaggcaaatgcaaatcaaaaccacaatgagatattatctcacacttgttaggatgactattttttttttttttttgagatggagtcttgctctgttgcccaggctggagtgcaatggcgtgatcctggctcactgcaacctccacctcccgggttcaagtgattctgctgcctcagcctcccagagtgctgggattacaggtgggagccaccacgcccggcctatttttttttttaaaaaagacaagtgttagcaaagatatggagagattggaacccttgtacactgttggcaggaatacaaaatgttgcagatactatggaaaacagtttgcctgcttttgagcacttaaaaaacaaaactaggctgggcccggtggctcacatctgtaatcccagcactttgggaggccgaggtaggggggatcacttgaggtcaggagtttgagaccagcctgaccaacatggcagaaccccgtccctgctgaaaatacaaaaactagcctggcatgatggtttttgtatctgtaatcccagctactcaggaggctgaggcaggagaatcgcttgaggttgcggtgagccgagatcatgctactgcactccagcctgggtaacagagcaagactccatctcaaacaaaaaccaaaaaacagaattatagagtagaccatctcttgtgtctggctggtttctttcatatgtgtgtgtgtgtggccacatgatattgaaaggacacatagcatcctgttcatcaggatgtccagcttcagagccagcaggggccaggcaggtgggtgaatgagtgacgtgtgtgaccacaggcatgtcccattggcccattgaacaccctatctgaaaggggcagcggcactcagctccgtttcctaattcctgctgtttaaaggatgaaggtctaagttttcccatttttttccagagaaatctgaaatcccctaaatttagattttgacagagaattcaagaattacaactgtggtgtattttaaacacatttttggactggattccttctgtgaacctccggtttacaacttctgcattcgtaggtggggactgtcagtggaaggtctcccccaccccacatcggaggggagaagggaaaatgtaaatttagtcaaatgggctttctttggagagtagagagtgtgcaatagtccaaggcagggagctttaaaagaatgcagaagtcttttttctctcttggtgtctgagctctaaattggctgggacatatccttagttaggagtcagtggctatagcgccccctgctgtcctttagcaccctcttcgtgtccagtgagatctgcaggtgagcctggaagccacttgcttctcctgcaggttttgggaggaagattcatcattttaaatattgctcaagtgcctgctgctgccagtgacttcataggctcctgttagactcaccttcacttatatttggtcaattacctactccctcagtcagaccttgccactcgattttttttttctttttgatacaaggtctcactgtgttgcctacgagtgcaatggtaccatcacggctcactgcagcctctgcttcccaggcttaagtgatcctcctgcctcagtctcccaagtagctggggctacaggcatgtgccgctacgcctggttgattttttaatttttttgtagagatggggtttcatcatgttgcccaggctggtctcaaactcttgggctcaagcaatcctcccaccttggcctcccaaagtgctgggactactcaggcataagccaccatgcccagccaccactctatttttttttaaattggaggtagggtaagaaggactgggccaggtcgtccttcccacaattccagtctcactgtttctatctattgaaaagcatttctggcatttgcttggtacctttccctggtttctgggctgaaatagattttatcccatttttaaacaattccttctgatactttcaggggtagtttgtggatgagagcagagtgaaatgcataggctcaggtttgtggccttgcaagttaataaagagtgtggactttggaactagcctgcctgggctccaatcttggctctggtacctactagctgtgtatcattgttttcattgttttgttttgttttattttgttttgtttgagacaggatctcactctgttgttggggccagagttcagtggtgcaatcatagctcactgcagcctccaattcctgggatcaagtgatcctcccacctcagcctcctgagtggttaggaccacaggcatacaccaccacacctggctaattttaaatttttttgtagagatggggtcttgctatgttgcccggatgggtcttagcctcccaaagtgctgggattacaggcatgaaccattgtgtcccaccttagctgtgcactttaaataagtcacttgacctctctgttcctgtttcttcatttacaaggtgaagatgataatatactacttcttagggtgagtattaaataagttaacctatgcaaagaggttaaaacagtgcctagcatatcatagaaatgtttgcttgacccagaggcctgaacctgctttgccttcagtgttggtctttaggtcctggcttcactccttaatgctgcatctcagcctttcctcatgaaactttctgtctttgatccttttcactccttaactgtgaatctcccaaattccactgagcagtgatcaattcttggggcatcttgctctgtgttcccagacattccttcaccctcattttctctccatggccaaatcctatagtgcctcctaaataattatagctgacatgtatgtagcacctatcatatgccacgtgctgttctaagtgattgatatatgctaactcatttaatcctcaccctatgagaaagatgcttttttaacacctattttatagaggaggaaactgaggcccagagaagtgaactgacttgccaggtcacataactaataagcagagtctggatttgagtttggctctagagcctgctcttagccaccatgtcccatcctcactgagaggacccttgttcaactccactaaccctctctggacaagtagcctctggtcctgtctccctgcttcctctctgtctcactggcctaccctttccacacctttctaaaaaccaaatgtgatcatgtcatcctctttgttgaaaacatgtcaatggcttcccattgttcttgggacaaagtaaatactctttgaagtggctgcgaagcagggtggacatacgtcctcctctgccaagcttgcctataaaccaaattggtttgttctgttgtgtcagcgtaccacaaggctggtgcccttgtcatcctcacaagagtccctgttggaagatacaggatatgattgtcctactcatgaggccctgcgtgctctggcgtcagggtccctccagcctttgcttgaccactctgagtaccttcgttcactcctctgttcatcctgccaccaggcatttgcacatacttctcccttggctgagatactcttctctctcttcttccctgtgagttcagtgggtctcaattctagttgcattgtagaatcttctgcagggctttttaactgaatgcagtgtctgcacccattccagaccaactaagtccaaatctctgattgattcagaacctctcagttgcatgcagggttaagggccctggtcaactcacgctggtcctctagactgcagctcaagcatcacttcctcagggaagcccttcctgacctccctgaccaggcccatttccaatattttgtactcagcacaccacatacctcttcttgctgtcacatatcttagggacatctaaatattaggttggtgcaaaagtaattgcggtttttgctattgtaaataatggtgcaatagtaattagttaaaagtaattaaaaataatggcaaaagcacagttacttttgcaccaacctaatatttacttacatggtgacaaagaacccagattctggataaaaatgaatcactagctgtgtgaccttgggcgagttacttaacttctctgtgtctcagttttctcccctataaaataggaatagtcaaaaacctgttttacatggtcgttgaggatcaaattagttcataatatgtaaggcgcttggaacagtgcctggcacatggtgagtgctgtatgtggtagctgttactgcactagtaattattaccccctgctgggatctgtaaatccctgaaggtggggttggcatccgttgtttgatcactccacacctaggatgctgcatgaacataatagctcttcaatacctgtctgttcagcagagtggcgtcctagtgaggttcttggtaaaagatgaaaggtgagatgtggaattgcaaaaaaaaaaaaaaaaaagtatagacatcagagttggcctgcacagaattcaccttcctcagttagggcccttgtctatgcgggcctgctggctcagggtcattgtttctagcggtcatgaggatcagagcctgcctggacttgctgtgtgcagagtccccggtgcagatggccacctggcaggcatttgctccagcagcatcctttgcaggaatgggaggctcctctgtaattcacaaactcaccgtgtccttctatacagaggatctttctgctcttctgaaatgcagacttgggtgtgctgagagcttctgtgacagagggtgctgtcaggaagctgggcatccagggctgcacctggaaaccaagctggcagcggctttgcaagttgaataatcttatgttgtgatcttgcatttacgggaccccccacttagcaaaaaggggtgctcagaccacttcccttagttggcttacggcactgcagggggagaggggtggggaggggaggagatgggtgtggttttgtgggtgatggaggatttatttataatgtgggtgtgatccgttgccatgtgactattccctgaaactactgtacaccctgagcaatgaatgcacaacccggcctgcacaggaagaggtggggctcactctgtgaacagcctccaccagaactcgaaggccccctggggaataccaagcctaacccctttgttttcagaaggaggaactgagaccagaccatggcagtgacttgcccaagatcacagatgtcatttttattctaagctaacatttgtcatatggatactacatgccagtcactgtgccaagctaagcatcatcattgtgatttcattaatctgtacacatctagaaagcaggctcattatattcagcaaacacttgcatagtgtatatatgatgtgccaggcactgtgctgagtcttttacaaatattaatccattaaattctcataatcctatgaggatttagtgtgattattatttccttttatttatttatttaagacagagtcttgctcttgtcacccaggctggagtgcaatggcatgatctcggctcactgcaacctccacctcctgggttcgagcaattctcctgcctcaacttcctcccaagtagctgggactacaggcacccgccaccatgcccagctagctaatttttgtatttttagaagagatggggttttaccatgttggccaggctggtctcgaactcctggcctcaagtgatccgcccgccttggcctcccaaaatgctgggattacaggtgtgaactgccgcgcctggccttatttccattttaaagatgaggaccctgaagctcagagaggttgggtaacctgtccaaagtcacacagctgggaggtcattgagttgggagtcaatctcagacagtctggccttgaagtgtctgctccagcactgtcatttctctccatgtgacagctcttctctccattttacaggtgagaaaatcaaggcttatataactcaagtagcttgctcgaggctgcacgactggaaattaccagagctggtgttgaatttgcacattccagctatagaatctgacccctgatctcatgctaaactccctctcagtggggctagggtcttttggctgaggggtccaagctgggaacaggtcacgggggttgaggcagagcctgaagccagcaggtggaggtggggtggtgtcagccaggtctacctgggttgactctgaacctcatgcagtggagcagttactcccttcccatggggcagagccccagctaggtggccatcgcctggttacaccctctaattccttaagatttcagcttaaacttcattttctcagggaagccctcctgactctatccagccgacactctccttgtaaattctctaagcactgagtgtctcctttgcagctgttggaagtgtacattggtttatgcttctttattgttttccccaactagactgacatagggaaggtactcaacgaatatttggtgactaaatggttaaataagtgaatggcttatagctgtagtagaaggaattggcacaggaaatcaagactgaagtccaagaagtggaaatatatataaggtttattgggaaaagtcacaactcagtaggcacagggatgccctgagcagtgataattaataattaatagttaataataatagcttgtacttattgagtgcctgctctgtgtcaggcagctgttttaaaggttgtgggtaattcattccctagaacctcacaaaacaaatattgttatcccctagggataactaccgctagggttattatcctagctccccctagggttgttgttcctagacagttaaggttaactagggataacatcaagagagctggcccaaggtcaccatttcttcccagcttttaaccaacgttttgagaatacagtattccccatcaaaatcgtggctcaccacggctgtgagtttcacccagcggcctgggtggtcatggtgaaagctagaaatacatctctggaagacattttcaggtatgctacagaggctggcatacccgggctaagagctgctggcctggctaatgaactaagatcactcgttgaaacaacaggtataaatctccaagcagaaaagactcgcttaacatggatggcaaatgttgtctaccaagaagacccaagaaaataatcaaataccctttgccaagaatgtctggttataaaataaagatataaatgacaataacttttctgtattttagcaacaaccagttaaaataaatttgaaaaaatcccagttaaaatagcaataaagaggtaaaatacctaggaataaatacttaggccccaactaagagagtttatgggggaaaaaatcttttctggaaaaacacaagaaggctcaaattacatgtgaattccacccctagctcccccaatctgtttttctcctggcagccgtggttctatatcacatcccacctcaccccttagctcagccacagcacccagctctgcacaattccttattctaaattctgattggcccagttcttccttcataaatttcatatcactgacccaaccttggtctattcagcattggctggaagtatgaggtcagatgctttactgtccactgagctggtgctgtaggttggaatttttctagaagggtcaataagttaagcagccaatgattggcatttccagcacaatctgggagaatacatggataagaataaccaagaaaaatttgaaagtaagcaggaatgctaggggaggggccagtgggtataaaggtgtgtgcctctagataccaagagcttatactatggtatggtgcaacggtggggagagagagacagatcagtggagcataagacaatattaaaaaatgagccgagaatacataagaaattcgtgtatcataaaagaggcatttcaaatcagcagggaaaagatgcatttcatacatttgctgtctaaacattaagagtagaaataaaggtctttcttgagagctcatgctaaaatgaatgccaagggaaatgatgatttcaatgtaaaaaagtgaaaccataaaagactaccagaaaatatcaggaaggactttctaaatacgacagcagagacagaaaccatacaggaaaagggaaaaatttgcactttattaaacacgcaggcacacacacacacacacacagacacgcacatgcgttatacgttgaaaaaagaacatcgacaaaattaaaaggcaaatgagaaactgggaaaacatttactgcatatatcataggtgaagggttaatatccttaaataatacacaggaaaatttgttacaaataatttgaaagaaacaaacttgaattttaaaacaggcaaaattaatgataacagtgaacatttcttctttttttgtttgtttgttttggaagcaggatcttgctctgtcacccaggctagagtgcagtggtgtgatcctggttcgctgtagccttgaactcccggcctcaagtgatcctcccacttcatccccacaagtagctgggactataggcatgcgccaccataactaatttttttttttttttttttttttttagacagagtctcgctctgtggcccaggctggagtgcagcggtgcaatctcagctcactgcaagctccacctcctgggttcatgccatactcctgcctcagcctcccgagtagctgggactacaggtgcccgccaccacgcccagctaattttttgtattttttagtagagacggggtttcaccatgttggccaggatggtctcgatctcctgacctcgtgatccgcccacctcggcctcccaaagtgctgggattacaggtgtgagccactgcgcccggcccataactggctaatttttaaatgttttgtagagatagagacaagatattactatgttgtccaggctggtctcaaactcctgggctcaagcagtcctcccaccatggcctcccaaagtgctgggaatacaggcgtgagccaccggacctggcagaacatttcttaaatgttcatcttcaccagcaactttatgcagtttccatgcagtatctcactgaactcttactaacctaggaattaagcattattattattccagtttccacacaaggaaacgaaaacttaaaagggttaaataactttccctagagtcagaaagttaataactggaagagccaagagttaagcttagatgtggctactaattcacccctatattgacatggactgcagtgcagatcttaacccaggaaatggtattttaaattctgccaaagtttatacaatagaagcttatccttcaaatggaataattacgtattcgccaaatgggcggggttagaagagggcagggtatatcaggcggttgaagcaaatcgtcacccaacacacaagtgtttacatggtgttattggctctattcattctcctctccaggaacaaaatgaaagatcgtcaccaaattatagtgtccccttttcaaatgtgccatgcgtgtgtaattacagcttctaacattctccacttttcatgctcagacaatctccgtccactcagtctcaattaaggtttccctactttttttgtcttttgcaaatttttggccttttgtttgcagttgtgggcatggcagtactgatgtgttactcacggtggtagtacaagaggtgagatttttgtaatacccagataaaccctaaaatattctactttacatcaaaagtatagaaaagtctgtgctgagaagttttactctctgtctactttattctctcttgcctccatagatgaacacttgtattaggttttttttttctttttttttttttggtgtatcctgccagaggtgtaattaagagtcgactttccccggttactcaggaggctcaggcaggaggatcacttgagcccagaagtttgaggctccagtgaactatgatctcgccactgtgctccagcctgggcaacatagtgagaccttgtctctgaaaataattttaaaaagaaaggatacacacttaacttattgcacctcgctttctcacacacacaaaaggtaccatgtaatatacacacctcagcaccttgatttttttgtttgtttcacttaaaaaatacaaccttggtcgggtgcagtggctcacgcctgtaatcctagcattctgggaggccgaagcaggcggaccacttgagcttgagctcaggcgaccagcctgactaatatggcgaaaccctgtctctgcaaaaaatataaaaagtagctaggcatggtagcgtgcaccagtagtcccagacacttcgggggctgaggcaggaggattgtttgaacctgggaggttgaggctgcagtgagccgagattgcactgctgcactccagcctgggtgacaaagtgaggccttgcctaaaaaaaaaaaagaaaaaaaaatgagatttttttccatattaatgcagagaacttcctcattgtactttatacctgagtagtcttccattatgtggctacactatgatttatttaaacaaccctttcccagtgacacttagcgtgtttaaatcttatgctaccctaaacagggcttcagtgaataactgtatctgtatattacttcctatgtatgcaggttattttaccttcgtccaacgtgatggagtgaaaggtgaaaagaatttgtaattttacaaaagcatttgtactttggataggtagtgccaaattgcccccacaggatgacaccaattggcccacccaccaggaatatgtgtctctgtttctccacagcttttcaacagaaactgtcgggatgaacatttaaaattttcattttaaaattttaaattgtctacttcattttaaggtgcattagaaaaggcagtttgcatattgatcccatgagttcacactcttagtttcatttttaaaaataggtttatttaaataaaaatggcagtactgaattgaagaaaaatatcaagtaaatattatgttggtgcaaaagtaattgcggtttttgccattactttcaatggtaaaatccacaatgacttttgcacctacctaatactgttacaggttgaatgcaggcatgcgaagttatgacagctcatgactgaagctggggaaatgttgccatgatgattttttctcttgggaataataaaatcaagaggttttatgttctgtgtgcaggacactgtgcttgaggttttataaagtggatacggttattggacccattttatggctgaggaaccagagactcagggtggttaagtcacttccctgaggtcacacagctaactctggagcctgcgcttgttaatttccctctgttctgagggtatttccaactgggaccttcaatttaaccttgcctacctaccccatgggaagtagagcctcaggagctttcatagcttgtaaatgtccagggatgacacagtctgaacttgcaatttgcttttcctttctcctctatggatgctgttagcttgtgttttctctctgtgtgcctcatttcagcttccttattcctgcagttttacttcagcccaaccagatttcagcccacctgtgggcaaagctgcacagcccattcagactgagagagacttttctttaatcttttctttctttctttctttctttctttctttctttctttctttctttctaggtttctttgtactttgctttgctttctgttccactaccctgccgtcaccttctttctttactttgcttttgattctttctttgctttccttactctctactttctttgctttcctgtctcttgccttcctatctttacttttctctccacgtgcccgtctcgtccgctgcgcggttgcccggtccgtcggtgcagttcggttcgtggtcgggtggggtggtgttcgtggtgcttgtggcgtttgcgttgtcgttgtcggtgtccgtgtcgtgtcgttcgttcctttgcttcctttcatttgtctttcgtgtgttgcgtccgctctcgctaccggtgtccgttcgctatccgttccttccttccttccttccttccttccttccttccttccttccttcctccttccctccctccctcccccctcctccatctctctcacctgtgcttcctttcctcttagctgcctgtgtctgggattaagtgatgacctaggatctgcctgtctttgatgctggggattgtttttcactataaagactctggtttgggggtggcagggacccaagtactctgtcactggccggtgctgaatttgtgtgagatgaagagtgttattgtctataacccccgtgttaggtgggagactctctggggaggctgaggagcaggggggcagccaggggacactgaggggttcccactcggctggctgcatttctggagtctgacaaacttggcttccagtcctggctctcccatgtccttgctttgtgaccttgggcaagttacttctctgagcctcagttttctcatctggaataccaggataacagtctaactcctccatcactgggctgtcaggagaatctggggacatgacatagaggactcagcacagtgcttggcaggtagtatgtgttcaattcaataaaattggtggcagtaaaagtcacattcgacggttattttgttgttgtattcaacaatctcttgaataaagattggaaatggaaggaaatttgggaatccaagcttgcctaataccaggcatgtggagatggagcctcagcaacaggaaatactgggaagaggaatcgtgccaggatcctgtggaaacctgatttccaggggtgggcgagatgactggggatgatcaaggggtgatgctgcggcaggagtgtaatagtttcaaacctgtttttgagagcacttgagactgagtcagacaaactcactcgggagtttaggggatgtgttcacatggggttggattccagcactgttgggaagaaggtagggagtctggcagaggtcccaaatccaaattcctacagggtccaggcaggaaaggggaaagagagaagcaggcctggtgtaagacaatagggaagagtggggactgtggaaaactagaaagtttattacttatctaaaggggaaaaccactgctcagcccacagaaatgagtgttctgtgttgtcacagctgatgatttctcaaaaggaagcaatatttcacattttttattctttctttctttcttttttttgtttgagacagagtctcgctctgttgcccaggctggagtgcagtggtgcgatctcagctcactgcaagctccgcctcccgggttcatgccattatcctgcctcagcctcctgagtagctgggactagaggtgcatgccgccacgcccggctaattctttttgtatttttagtagagacagggtttcaccgtgttagccaggatggtctcgatctcctgacctcgtgatccgcctgcctcggactcccaaagtgctgggattacaggcgtgagccactgtgcctggccaaaatttcacattttaatctgatagttcctgacttaaatatagtaaacttatttggatttctaagaagcaccttgttggccaacggtagcttctttacaggcttgatatagcttctgggttccacactgtggcccctgggcatgaaggagggcccaggccagggatgggacaggctctaggtggcctggaggtgtctagtcagtgtggcctgggtgacgaggatctgatgtaaaatgagactaggggagggattgaggcagagatggaagctgtgtctttttttttgtttttgagtcagagtttctctctgtcactggagtgcagtggtgccatcatggctcactgcagccttgaattcctgggctcaagcgatcttcccaccttggctgggattacaggcatgagccactgctcccagccaggaagctgcatctttgaatgcgatcagaaccaaaccccatagggggagtgatggcttacaggccatgaggattcccagactcatctcaggcttggtcaatacccacagcatcaaggctaggaagggaatgtattttggttaaaggcaggactgatacttatttatttattttgagacggagtctcgctctgtcacccaggctggagtgcagtggcgggatctcggctcactgcaagctctgcctcccaggttcacaccattctcctgcctcagcctcctgaatagctgggactacaggcgcccgccaccacgcccggctaattttttgtatttttagtagagacggggtttcaccgtgttagccaggatggtcttgatctcctgacctcgtgatccgccagcctcggcctcccaaagtgctgggattacagacgtgagccaccgcacccggccaggcaggactgatatttaacctgcatgccctggcactactgtaccagtggtggaaatattgaaatactctgaaaccgatgggtaaatagccactgggtcctctgggccttttcccccaaccttccacttacccatatctgcctctgccagctcctaccacaccccctccatgacgtggtgactagagtgctaactcccagcacagccaggctctgctgtccattccgtttggtctgtgggcagtccctgagccaaggcaattatagatatcttgactcacccctggttgtaggtaacatgcctacctggattggctgaagcacaaaggacaaattttagaggacacagggaggcagatggaattggaaggcaggatgccagaaccccagggaccagaaccaggagcttcatccctggggtcatgtagtctttgtctttgtttctccgggttcctcagagcgcaccataaaaatcagcaccaactgtcatttgctacaatgtggatgaacctggaggacattatgctaagtgaaataagccaggcacagaaagacaaatactgcatgatctcacttagatgtggaatctaatgaagttgaactcacagaagtagagagtagaatgatggttaccagaagctgggggacagcaggaggcaggagtagggaagaaatggagagttgctgagcaaagagtacaatgtttcggataggaggaattgcctttgagatctattgcacagcagggtgacattagtcaataatatgtatgtttcaaagtaattaagagagtaaatttcaaatgtctcatgctaaggaaatgataggcaagttaggtgatggatatgttaattttcttgatttaatcatgccacattgtgtgtgtatattcagaacaatcagaacaatcacattgtaccccataaatgcatacaattataatttgtcaatcaaatataaaattagcagcctcagccctggaactgtatgtctgctggcctcaggactgattacctgtgtcccagccactcagcatatgtgacccttgagccaagtgtccacctctgccccagtcagctgtgttcagggaatgtggatgtctcaaagtacaagcatggcttttgggaggtgcccatctcagagatggcattgggctcaggcaggcatggaaaggtaccctgaaagatgcaccttgagggtcgtggagggagtcatgaggaccacaggtgtaggagtgtggctttaagctctttcaggtagcaggaaggaggagggaagaatccactgaggatgacctggtttgtctggtctgaaggattggggcagtgggtgggtagagttggtgcctacaagtatgatccctcatgaaagcggagggaggggaatgaggtcagaggagctctccagcagcctctaaataagccgtaagaagtcaatgtttccctgcaacttgccgattggttttcctgtctctcatctggctctaatctgtgctgcacagccccttctaagtcattttcctaaaatagcatgtttatggtgcaggggtttgcagtggccaacagcgatgattgcagccctacagctgtcacaacaacccattgaccactgtgtgcaatgctgtgcttgccacgggcaaaacacttcgtctcttagttcttcggtttcctcatctgtaaaacaggggtagtaagtagtatgtactttatagggctgttatgaggatcgaatgcattaatgcctgatgaatcccttaaaatagtccctggcatgaataaatgttccataaatgttaactctcacttattaagtatttattgagcatcttctgtatgccaagtacagtttatgccctgagagtataatgatgagcaaaatttcctcacattgcatgcagtgaagtgtggaagagatgcaattaagcgtgcatttataagtcagtggtttaagtgccgtgatggagaggatttagaatataagttccatgaaagcagaagctcttttgttcacagctgtatccccaatgcctaggaagaacttgaccctcagtatacatttgctaggtgaatgaacgaatgagtcaagttctatcttagccgcacatgaagatgaggtgtcaatggagtaaagttgggagtgaggagagaagggaggggaacttggtgtgaaccccatctctgcaagggtccagctgggtggccttggtgaagttactctgtagttaggatctgtttcattgttgctaaaatgggaacaaatgataccttctgcatggcatgtcataaggattggagagagtacatgtgagacacccagcgtacacatgtagctctcaagcagtgtgttgagactgggtgtggtggttcacacctgtaatcctagtactttgcaaggctgaggcaggcagatcacttgagcccaggagtttgagaccagcctgggcaacatagcaaaaaccctgtctctacaaaaaataaaaattagccaggcatatggcatgtgccttcagtcccagctgctcaggaggctgaggtggaagggtcgcttgaacctgggaggcagaggctgcggtgagctatgatcgcaccactgcactccagcctgcatgacagagcaagaccctgtctcaacaagacaaaaaacaaaacacacacaaacacagaaatgtgtttccttttcccttcccattctttgtgcttcttggtatctcctcttgtttaagagactgttgatatggagaaaggtctggatcatttttggtcagaaatgcttgaatccttgtcttggagatcgctcaagaaaatatttacatgaagaaaagtgcaaaaccaacagaggcaacttattattagttgtgattttgccccagatcttaaagtagagctcacaaggccttgaggaactcctttcttctctactaggcaggactaaggaaattcaaacctgaactcaaacctaactcttggcctctgtaagatcaatatatcagagaaaccagaagggaccacaagagccaagagtagagacagaatgtgtcctaggtcttggagaggagctggctcaggccacttctaccaagggtctcagggcaatactataagacttggacccagtagcgtcctgggagaagtgaaggatgtaagggagaaggagaagagaaagatggcaaggatgccttttaacctccatgcgagctccaccactggggtctggccaatccgtgtcttggaatccatccaattaaatcaactctgcctccttagaggttaagtaggggtgtaagagaacctggagcttctcctacaggccaataccagtcatgaacaggggttccttttttattattattatactttaagttctggggtacacgtgcagaatgtgcagttttgtttcataggtatacacctgccatggtggtttgctggacccatcaacttgtcatctacattaggtatttctcctaatgcctcccctagtcccccaccccccgacaggtccaggtgtattatgttcccctccctgtgtcgatgtgttctcatcgttcaactcccacttatgagtgagaacatgcggtgtttgattttcgaacaggtgttcctttttaggtgggtttgaagcactgaactcccaactttaaggtgaatgtccaagaagcacaatgggaactgttctgtggcacagagcagggggactctgataggaaccttatgtattcacttagtctcattgtccggagatagagacatggctggttaagctgccaaaagggatcccttagttttttggggggtggatttccaagccctgttgttgttactaggacggcacctcaatctttgagcaggacagatgattgctggggtccttttgtagctgagagcactcagggtcccactggcgacagcagaaaagacctcgcttctcaaacttggctgtccagtgctctggacgagtacttcatctgcctgactgcagagggtgggaacgttgtgaaagaaactttgtagctcattaacaagataagaagcaaccgaagtctgcagtggctgaggattttcagtcaggtttattgagacatacgtttcctgtggtaaaagtcactttaaacaattttttttgagacagggtcttgctctcccacccatgctggagtccagtggcgtgatcatagctcactgcagccttgaactcttgggttcaagtgatcctcccaccttggcctccctagtagctagaactacaggcatgcaccactatgtctggctttaatacatatatatagtagagacagggtctcactgtgttgcctaggctgatctcaaactcctgggttcaagctcaagcagtcctcccgccttggcctcctaaagtgttgggattgaaggcatgagctactgtgcccagcaaaattcactttttttcttttttcttttttttgagatggagtcttgctctgtcgcccaggctggagtgcagtggcatgatttcagctcactgcaacctctgcctcttgggttcaagcaattcttctgtctcagcctcccaagtagctgggactacaggtgcatgccactatgcccagctaatttttgtattttaaatagagacagggtttcaccatatcggtcaggctggtcttgaactcctgacctaaggtgatccacccacctcggcttcccgaagtgctgggattacaggcatgagccactgctccaggccacaaattcacttttaaaaatataaagtaaaattcatcacagttaatatatagaccactccaatatccaaaacaaaaaagttgctgcatctgcctctttttagttaattccctatccacctccaaccccttttaaccactgatgttttctgtccccatagttttgtgtttttcagaacatttagaaatgaacctacacttgtgttgaacatctttgttttaccagaatcctttcgaggttcatgaatgctgctgcatgtgtcaatagttcattcctttttactgctgaaaagtattccactgtgtggatgcctcacactgtatccattcacacgtcgaacgacatttgggtcctttccagtttggggctattataagtaaggtagctataaaccttcatgtatggatatggttgttgttttttttttttccccttctctgtcacccaggctggagtgcagtagcacgatctcggctcactgcaacctccgcctcctgggttcaagtgattctcgtgcctcaccctcccaagtagctgggactacaggcatgtgccaccacaccctgctaatttttgtatttttaatagagacagggttcctccatgttggccaggctggtctcgaactcctgacctcaagcgatctgcccgcctcggcctcccaaagtgctggaattacaggcgtgagccactgtgcccggcctggatgttttcatttcaccgaaaagtaggattcctgggtcctaggagagttccagtttatgttctttcttcactaacacttggtatcgttggttttagttttcaaacattttagcaactctggtaggtatgtgatatggttaggctttgtgtccccacctaaatctcatcttgaattgtaatcctcataatccacacatgtcaagggagagaccaggtggaggcaattgaatcttggggcagtttcccccatgctgttctcatgatagcgagtgagttctcacacgatctgatggttttataaggggcatgtccccctttgctcggcacttctccttcctgctgctttgtgaagaaggtgccttgctttcccttcgccttccactacgattttaagtttcttgaggcctcctcgtcctcaagaaaattgactgttagtcaattaaatctctttcctttgtaaattacccaatctcaggcagttctttatagcagtatgaaagcagactaatacagtatggaattattttaaagttttgaaaagaacagtttccttaggagaagcactcatcacattaacagcacataaaagaatatctatgtagtatgtctgtttatttgcttacatgttcattttctgtcactagagtacaattttaaaggaggcatctgtggcagcatcaataaatacatgtgaatggatgaatgaaggaaggaagaaactggtagcatgtaccaaaggctagggtgtcagatcagccctggattggaacctaaggcccatgttattaacttctgccatgtacttttttttcctttttttaagagagagagggtcttgctctcttgcccaggctggagtgcagtgatgcaatcatagctcacacatagccttgaattcttgggctcaagtgatcttcccacttcaacttcccaagtagctgggactacaggcatatgccaccacacctggctaattttttattgttgtagacatggggtctcactatgttgcccaggctggtcttgatctcctggcctcaagtgatcctcccaccttggcctctcaaagtgctggggttataggcgtgagacactgtacctggtctgcaatgtataacagagaaagcaacttttacagaaagagttctcttgaactaaaaccaattctgtgaggaaagaatctcttgaagaagaaagagaaatgcagagccaaaggcttacaaagggcatggtctgtttgggagcgggggtgcgctctgagtgctgagaatgtacatagtatgtgtgcatgtgggtgggtgggaggagggggcttagctggggatcaccttggccaaatagtaatagcaatcatggaaagcttatgctgcttgctatgtgccaggtggttctaagacctctacacaggttcattcatttatgcttcccaacagtcttataaggagagcactagcatatcagcattttacagatagggaaactgaagcacaaaaagatcaaattagctgggcatggtggtgtgcacctggcattccagcaattttggaggctgaggtgggaggatcatttgaggccaggaatttgagactagcctgggcaacatagtgagacccccctctctacaaaaaaaaaaaaaaaattaaaaattagctgggcaggttgggcacagtggctcatgcctgtagtcccagctactcgggaggctgagacagaagaatcacttgaacccaggagacagaggttgcagtgagccaagattgtgccactgcactccagcctgggtgataagagcaaaactctatctcaaaaaaaaaaaaaagatcagctcagcatagttgcatgcacctgtagtcccagctactcaagaagctgaggcaggagaatcacttgagcccaggaagtcaaggtcccagtgagctataattgtgccactgcactccagcctgggtgacagagcaaaaccatgtctcttaaaaaacaaaagaaaacaaaaaaccatcaaacaacttgcacaaactcacacagcttagagccccggaagtttatccaagtctgccttttaccactgcactgcactgccaggctatcaagggcatatttattgattaggaaattatgtaaggttctgtgagaaatagctcccaaaatatagtgacttaaacaaggcagaaattaggtttttctctcaggggtcagcccaaagggacaaaattcaaggctggtagggtggctttgtcctttccacatatggctccaagtttgggtccaggacagtcacttccagttctcaccatctttgaaccagtgggaagagggaaaggctcaaggaagtatgcatttccatttgaagggaatggccctggagcacacacatcccattggccagaactcagcaccatggcggcacctgcaagaggtgctgggaaatatggcctctatctggatagccatgctctctgctaaaactcaaggattctactattaaagggaagaatggatattggtggaaaaccagcagtctctgccacaacttgcagactgtccactgggctttgaactttattctgtcagtgatgaggaactggcaatggtttctaagcagggagatttcacatccagacttgggtttttgatcactgcagaagcatgcttggagaataaaggtggggagaaagaaaagtcaggagccctgtttagatgatgtgtctgttactttgttttcccatctctggagtccctactacaggcaggagcctgtaggttgagttcccaggcaggcccagatggagggtttgcaggcagggtgagtgagcatggggctgcaaagggaacaatcatctgtctttgtccttcattccttccacaactatttatccagcaccgtttctgggcacagggctccagcgatggtcccaacaggtacaatgacctctggggaccaagttcagttcttggtgagttctccagtgcctctcgatgtaggatgaaccgttggcatgctccactgacgctggctccttctgttgtttctcttggctccaggacccccgcagcaaacacaagtttaagatccacacgtactccagccccacgttttgtgaccactgtgggtcactgctgtatggactcatccaccaggggatgaaatgtgacagtaagtactttttctctctgggggcatctgctgatggcagaagcaatgggaagggctgcttccacttggtttggggtccaggtctgccatacattcccccctgtcctcgttggggctggtgtaccagttatctgttgctgcataatgatcctcccaccccaaaacactgtgactgaagacaataaacatttttttagctcatgactctgcaaggcagtcctttgaatctgggctggcctcagctgatgtcacgcatgttcataaagcatgaactcatggttcatggtggattagcagatggaggtgggctgggagctgtctgggccatggtggcctcacccacatgtcctggaggatggctggctgtcatctgggtgatggtgatgaccaggccacgtgtctttcctcctcagtgggctaggctacctagcctccgtgcatgcacggaggtcacagggtcctgagtttcttaggagggcaagtcccattggcagccacacttcaagtctctacttgtgtcttttgctcctgatccactggtcaaagcaagtggcatgtgagatgcacagtcacagtgtgggaaggggcagtccatggctgttgacacccagaggcatgaacaaatcatgggcatttctgcagccatgcaccaccactgttttcagcattgagatgtggggctgatgcattctttgcatggagaagacctgtggccctgcagcacccacaggtttgtgctggaggaggaaagagcatcattctctggccaggatgtggtaggaaaggcaggtggggtaggactcctctttatgaggccaaggcccggatggcctgtggggcaggggagcagacaggctttgagagctatggccacaaagctacagggacactggaggtgctggtggctcccacagacctgttggtctgcagcaggctgggtgtcatgaggctagtggtactgctctcccaagggtcctgaggcccagaggacagagggagaaagtcatagggcagagagtgacagagaggactgtgagggtgaataagggtggtagggagcaagacagacagcaagaaacacacatgcatagacagacacagatgcaggggaaagatggacacatgcaaccctaacacagggaggaatgtggggcgtggaagctacagagagactcagctagagagagactcaggcaaaaggagggacaggcagacacacagaccaacagataagccaggtgcagtggttcactcctgtaatcccaacactttgggaggctgaggcgggtggatcacctaaggtcaggagtttgagaccagcttggccaacgtggcaaaacccaatctctactaaaaatacaaaaattagccagtcaaggtggtgggtacttgtaatcccagctacttgggaggctgaggcaggaaaatcacttgaacccaggaagcagaggttgcagtgagctgagatcacactactgcactccagcctgggtgacagagtgagactctcaaagaagaagaagaagaaaagataaaatgattggcatggacacagagagagacgccattacacaggctcatgcagaggtatagagatggaaagaccagagacagagacagaagcacacatggagagccacagagagacacggaggagagaggcagagagacacagttggagaaagggagagacaaagaggccagagacaagtgcagagagtggaacagaccgattcacagacacggccaaggcagtgagccacgtgcagaagtgggacagcagagacaagagacatgcagcaacgtggaaacagagagacagacacagaaacatggcaagagccacagggggacagtgaggttggagccttctgcctgcaggacaccagctcctcttaccacacatggggccctaatatagggacaatgtccctgcctcagagacagtggtgggtgggagctcaggctggtgctcaggtcccagagggctctcccttccctccccacaactcatttctagtttttgtaataggcctgctgcctcctgggacttgggtggtctgagaagggtcccttgcccccagatcccttgaaataggggcccatggggtgacttggcctctccttctggcttctccaactggaactagcgtccccctggagaatcctgggtgcctggcacaccttcctggagtggggcattattgctcaagacctagaagaaatcacccaccacattgaaatagacacagatactctacggaggagtgcgcagagggagtggatatcctataacatgagagatggccgaaggccaaattcagtgtataggcacattttatccaccctgccctggctctaaatctttttccttgtaattaattatggtggacactatggccagcccagaccccctcttcatggtcccaccccatcccctagctgtggttcacagcagtgccccatcctgcataattgcccaagataatgcctcttccagggagaccagatgattgtggtgcccagccctcttgtctcagtttggaacaactctgaagggtcatctcagctctgggctccccctaacatcagctttgattgcatccacgtggcaaacgaacttctccccacaagagcactccccaaaaaccttgtgctcaaaactccccgtctcagactctttccagggagcccaacctattagctgttaatatttaaaaatcagagctgtcacgtacacatcgagattcctgcatacgttgagaaatggggaatgtttttgctctgtttcccacttggcttggccaagtccctgccacccccttagctttcctcactcatgtgaccagccagcctgtgagcattgaagttggtgactctggcttcagagccttaaggggtgtggggtgtgcttgcttcagactgcacccttggctgtgggtggggaacagacaagttctacctcctttgcccatcagggttcagggggaagagttggaaaagcccttctgatgagatcctggcaggcaagttggtctcagccaggctcgtgtgtctcagctgtctcaaaggagggaaacaggaagggctcagcggtcttgggtggggcagatgtctgcagcccccagcctgggccagcctaagccacatcccctctctctgccctcacagcctgcatgatgaatgtgcacaagcgctgcgtgatgaatgttcccagcctgtgtggcacggaccacacggagcgccgcggccgcatctacatccaggcccacatcgacagggacgtcctcattgtcctcggtaggtggccctggggctccactggctcctgaccttgcttgacctgtgtgattgagaaggggagggtggcggaggggtggggcagtccagtggaggggtggggcagtccagggacggggagggggtgtggcactgcttctgccccatgccctgcccatgacagcccctccctgcagcagggggatctttagaaactgtacaccctcaaagcttcgtccatcagcaccccaggctgacttgggttcagagaggagacgtctgagttccttggacttctaacttcctcaggatcctccacttcccttctctccttctcatttcccactcttttttagtaatcttttgggatgggtagttgcatttcctttactcagatagcagagaagggaagcttgcttcttccgcaaacttttccagcaggaaaaatggagtcttgatgataaaccccagatttggagaatataatatcttgggaaggaggagggttggagggtgcaattcaggggctttccacatatttgaaatatttctttcttgaacctgatggtggctatgctgtaattttattattctctatattttctgcatgtctaaaatatttcatgataattagaaagcaggatggtacagtctcctgggagatgcagtgagaggaggagctgctggtggtggtggtggtggtggtggtggggctgtcactcatgtatcccagcattcaagacatacctggctctgatatgggaagttcaagcaaaattggaactcagcagcactggcttgaggaatactcagccataagccccggtataaccagcactgagctggctgggagtggagctaaaactttgcaggaatttcttctcaaaggctagtgacaaactactgtggactttatatatctaatgaatataaataagggtttatgagttggtaactcaggaaattgatcatggaagagattaattttgcaaaaattagtgtttctgaggcctcagactggttcagtagctctgatgcattgagccctgggttgcggaggggctttacgtagattgtgtaaaagctgaaaaatacttatccctgtacaatataattcttttaaacttgagatttcgtgaagcccagtgagattttagaaaatgtgcaatccattgcattatgttttcctccaagtggtcgcctgcctcccagtgtgatgcttgggggccccaggggaaatcccgcagtttcaggttcaagggaagccagttttccccactgattgaggttcccgatgctggtgagacaaatatgagactctgcttccctctggtgtcattctgtgggaaatacactcgttccaaagcatgactgcgggcagccaacatttatgggccgcatgggatgtgcagtgctctaaaccttacgtgttatctctttccaccttcacaacattgtgaaatctctattattcttgtttgagagggagactccatctgttgcccaggctggagtgtggtggcgccatcttagctcactggaacctccacctcccgggttcaagcgattctcctgcctcagcctcctgagtagctgggattacaggcgcccaccaccacgcctggctaatatttgtatttttagtagagacagggtttcaccacgttggccaggctggtctagaactcctgacctcaagtgatccgcccatctcggcctcccaaagtgctgggattacaggtgtgagccactgcgcccaaccttctattattcttgttttatgaacaaagaagccacggctcagagaagttatattccaagagctcacaccatttgcaataataataaaacaatagctaagatgtgtttagtttttaaaatgtgttaatcattgtgaaaagcacttacaggcagtatctgatttacattgtttcaacaactcaaatgagttaagttatcattctacccatcagaaaacacatttcctcacctaggtctgtttgactcaaaagtactatatagtaggttacttttttgtttagtttagtttcgtttcgtttctctatgccctccaccgtatttattccttttgtggtttggctagggcacctcctatgggcattccttagggagtctttgttctgatgtggtacagtacaatatttcttcaagttcaaggtcaaagtcttcccccttaatcatagatatgctgtgaactttgagaacctggatcacaagcccccgcttctcaggacacactgataggaggtgtatccatttgctgtggctgccataacaaaataccacaaactgggtggcttaagacaagacgtttaaaaaaaaaaaaaaagaaacgaaaagaaaaagaaaaaaacaataggccaggcacagtggctcatgcctataatcccagcgctttggaagaccgaggtgggtggatcacttgaactcaggagtcagcctgggcaacatgtcgaaacatcatctctactaaaaatacaaaaaattagccaagtgtggtggtgcacgactgtaatcccagctacttgggaggctgaggcaggaggatcacttgagcctgggaggtggaggttgcagtgagctgagattgcaccactgcactccagcctgggtgacagagcaagactccgtctcataaaacaaaaacaagaaaaacaaacaaacaaaaaaggccaggtgtggtggctcacacctgtaatcccagcactttgggaggctaagacaggaggattgcttgagactaggcgttcaagaccagcctggccaacatagtgagaccctggcatattgtaggatttcatttctttgggatgttcagagcaggcaaatgtataaagaagtttaatagcactttgtgcttttccaaatactttgatatcacaccattcgggaaagggcacgttgttgccatcatggaagggaaaacgaagtctcagcaaggctgaacaccctgaccaatgtcacatgctgagcaggggtgagcacctgggcctctggccccatgtcacaatgccctgcaattgcccatacaccatgctgggcacagcctgtactcagcatgggcttgttgattgatggatgatagaagagagccctgatgctgtggccgagttctctaaaaatagagccaagatggggattttgttccagtgatttattgggctgctcatgggaaaagagaagtgaaggaaccatgcttccttcctcaggcagggaaaaagcttggcgagagtgtggtctccgtggaagtcttcttcagcctggtatctggtggaattttgtaccaaacactgtagcacagtcagtcccatcttgaggcaagggggctgttctgtcgtgttccaggtcagtcagtgctgtgggatgacttgtgtctcccccagatttgtatcttaaagcctcacccccagtgtggtggtatttggagctatgggacctttgggtggtaattagggttagatgaggttgtgagggtggggccctcataatgggatttgtggatttctaagaggaagaagaaagagagatcattctgtctccaccaaaggaaggatacagcaagaaggtggccgtctgcaagccaggaagtgagtccttaccaggaattgaagctgctggtacctcgatcttggacttcccagcccccagaactgtgaagaaataaatgtctttttttctttttttctttttattttgttttagatggagtcttgctctgtcacccaggctggagtgcagtggcatgatctctgctcactgcaacctctgcctctcatgttcaagcgattctccggtctcagcctcccgagtggctaggattacaggcacgtgccaccatgcccagctgattttttttatttttagtagagacggagtttcaccatgttagccaggatggtctcaatctcctgacctcaagtgatccgcccgccttggcctcccaaagtgttgggattacaggcgtgagccactgtgccggcctaaatgtctgttgtttaagccacccagtccatggtattctgttatgacagcctgagctggctgatatagtcagttactgctgtaggctgctggggatggaggtgggaaggtagagtaacttcccaggtgaggaggcttctgtgcagttgaggacagttatctggacataggggtaactgtgagccattaacagccatcatacacagcacccaggggatgggtgcattggccagcatggaggggagctgggcagggtccaacagcatctggcacactcaagtttcccttggtctcctgactgtcttcctggtttcattgctgggactccagccccctcctccttggtcttggcaagacagatcagagaggagcgagcactaaaggttgtgtggggtccttcccagcagtgccaggccagaagtggccttgtggtgtttgtggaatggccccacctcatccagacccaagaagcatggtcagtattaggattttccactgaccatcagcccaggacactgccgtttgccctgagtgtcatatgttctttggaaatctcagcatctctagaggtcaaaggttttctaacttgcctggctactgaaattgagctcatatatctgttcttagtgttttggcaggtcaagatgagaataaatctgatcagttctcctccttttaaaaacccatcaatggtttcccattgtctttataacagactaaatctaacatggcgatctcattctttattcactgtctcctccccctttcttttaatccttggtcctctgcagactgccacacaccataagacatctgtgcgttctgtttagaatgtttgccattgccatcttctctttttctagcaattaactcttcctctcgatctcggttcatttttaccatctaataagcttcctccaacttccccctttcgtagacactcatggtaacctgagcttggccttgtgaaaggggtgattttatgttggatttgattaatgtctgcatctcatcacaaggcattagctccatgagggcgggactgtgtcttgccactctactcccagcacctagcaaggtgggcatcactaaatatttatgggctcaatggctgtatgtatgaatgagaaacccctggaggatcctgatagatagatataaggctttcactgatggtccccagatcagtgcctcctaaagtcaggaaatgaaggtcaacggattgtccaatttataccattattctcatgggaggtagaacatgcagaaaatcttaagtaccaggtccaacgtcaacagcaaatgttactgggactgagacccgcttgttggagtcatgaccacccttgttccctggacaatgtagaaaagacatggagcagtgggatttgtagtatcccaggaaaccgtattgacatcatgatgcccataggtgtcatgagatcaggcaatacaatgtccagatcagagttgtaaaatgctcccaaggtttgtgaagcctgcgtgttcatacatgcaacaataattttttttgtgtgtgtgtgacagagtcttgctgtcacccaggctggagtgcagtggtgcaatctcagctcactgcaacctccccctcccaggttcaagccattctcctgcctcagcctcccgagtagctgcgactacaggcgcatgccaccatggccggctaatttttttttgtatttttggtagagatggagtttcactgtgttagccaggatggtctcgatctcctgacctcatgatttgcccacctcagcctcccaaagggctgggattacaggcgtgagccaccgcacccagctaacaatatcttattcaatgctttttcaattcagtatctacctatcaacataacaactgacatctattatttatactcccatctacattacagccacctccaaatgcttagccatgtccatcctcatatctatctcccaaaagttgggagtgttcttaaagaaagcagaaagaacctttttttttttaaatgtttctctttggaactcccattctatattcttaccattatattgtgttatacagaaactttttagactgaaacatctccctgacagccttaggtactcccaatattgtgatatttaaatccttcttaagatctgacatccacacatcaaaagaaaaagagtaccaaagaggctgagtgtggtggctcacgtcggtaatcccagcattttgggaggctgaggcggctgtatcacctacagtcaggagttcaagaccaacgtgacaaaaccctgtctctactaaaaatacaaaaattagccaggtgtggtggtggatgcctgtaatcccagctactcaggaggctgagacaggagaatcgcttggacccaggaggcagaggttgcagtgagctgagattgcatcacagcactccagcctgggtaacagagtgagactccatcttggaaaaaaaaaaaaaaaagaattgggaagaaaaagggcaatgtaaacaagaaaaaaaaatccagatagcttaatatttatttttgtttaacttttatttgaactttggtgggggggtacgtgtgcaggtttgttatataggtaaacttgtgtcatgggggtttgtgtaatattgcccagccatgcgtcaattgcagacagaaaattattataaactaggccgcgagggcccactagggggcagtctctgccttcaaagccattcctcctcggaggctctctcaggagatgccccaatttgtgaaaccacagtactgtcattgctcataatggaaggtgcagcagagaccagctacgctcactgaggtccagagaaaggttacttcttcaggtcacacacagatagggcccagttctggtagatctcccttcccttttacattattggtttgtaattttttcccaagtctttattttgaactaagttgaaagaattttacagcaaacactcatttatccaccacctatattctgtcgttaacgtttccacacttgcttaatcacatttccaactatctcgctctccatccatcaatctgtcttatttttgacacatttcaaagtaaactgcagacaccaattcgatttcccccaaacacttcagcatgcccaacatcaatagaattcaaaatttacttgtagggtttcttttttttttttaacttttgaggtgaaatgtacatacaatgatacatacaaaattttttttttttttgagacagtctcactttgtcacccaagctggagtgtagtggcgtaatcacggcttactgcagcctcgacctcccaggctcaattgattctcccacctcagcctacaaagtagctgggactacaggcatgagccaccacactcagctaatttttgtagttttgtagagatggggttttgccatgttgcctaggctggtcttgaactccatggttcaagcaatcctcccactttggcctcccaaagcgctgggattatagatgtgagccactgtgcccggtgatgtcttaagtgtacaatggctgagttttgacaaatgcatatgactgtcattctaacccttatcaaattaattctcttttttgatgtcacagctgctgttgaggatccaagggaaggtatgaaccagagaaatgcctttatgtccccacacactgcactcatactcatgagctctggctattgggatgtctattatacctaaaatcccttagatgacatgaaacttaatagttgttcaattttttttgtttgttttttgaggagttataatgcagtaaagtagaaactttgaaaattggaaattcttgtttacaattttttgttatgtattcattgaagagcaaaatgcctttaaaaactcaatacacctgctttattttgctttttttttagtattgttgtaatgaagaagttcagttaaatcatatctgtctatggaacatctatcatctttctcagtgtattactgatagttgtctgcacaccccatgaggccaggggaagggtctcttgcccatccttccttcaaagcctatcagcttgttaggttgaggtgagtgtctcaggcactgaagttttgggatactggacctaaggagatgtagggaagctgacgtcttgctattcagtgttccttctcttcttcccctggtcatttaagtctcatgagaattatcaaggccaggccagcgtctgaggccttcaggatgtgctgggcgcggtcattgctcccaaatgtctagggaattgcattgaagtgggcactgctgggacctgcagggctgtgacttgtgactgcctttggggacagtggtccagcaatgtctattaaaatatgtatacatatgaacattttgactctcacgttttcctttagggaatctattctcttaaaatgaaacaccagcgtgcaaagaaataaaatctagaacaagcatgtttattgatgttttctttgagatgcaaagaaaacatcagcctaatgaaggggtacccattttatgtgatactaggtagttgttgaaagcattgaattaggccaggcgcggtggctcacacctgtaatcccagcactttgggaggctgaggagggtggatcacttgaggccaggagttccaaaccagtctggccaacatggtgaaaccccgtctctactaaaaaaaatccaaaaaattagctgggtatggtggtgcatgcctgtaatcccacctgctctggagggtgagacacgagaatcacttgaaccctgcaggtggagtttgcagtgaacagagatcaggtcattcatgcactacagcctgggtgatagagtaagactctgtctcaaaaaaaagaaaagaaaagactgaattaaaatgagaaaatgagtataatttttgacatgggaactggttacacaggtgaatttcctttgtgagaattcaagctgtaagattatgatttatacacttttctataggtatattatacttcctatacttttattatttaaaagtttgtgataaaaattctaaataactaaaaacaaaacaccaatgggttagagctacagatattggtgtaaagcagaggttgccaaactggcctgctgcctgtttttataaataaagttttattggaacacagccacatccattcatttatatattatctatggctgctcttgtgatacaatggcagagttcactgcgtagttgtgacaaagcttgtacaatctgcaaaatgtaaaatatttgttctctggcctttactgaaaacatttggcagtccttgaactagaggaacatctatggttaagtgaaagggttaggttgcgtaaaaatatatttagtatgatctcattttgaagaaataagcaacagcaacagacacctcctatgtgtgaagttttgtctgtatattttataacctgtgtgtgaagaaaggtgtggaaggataccaaccaggttgtaaacactgggatcgcagcaggattgggagtgaagaggctgtggcggtgagggggattgtgttgtgtctctgtagttttcattacgtttcacaggttgattgcaatacatatcatttccgcaatttttgaaaaataaaaacagaaaaatctccaaataggaaaaatgaacagaaataaattgtctcaacaacaatagcagaaaaaaaaaatgaatggataatgccccaaatgatggggtgttggttgcttgaggagggttgttgggtggttctcagcttgagcagagctgggcccaggccctgtctgggtatttttgagtttttattgtcactagcttccatcttgtgtagcatctgccttgtgagctgggcctgttctccgagtttcatggtgtttgatgttttttgccttctttcagcaaggtcgctggcatcatccttgctgagtcgcatatgttctgggaaccacctcctcttctctgtgcctctcgcctggcaggtctacgctaaactgccccctgccctcccaggcccaccccacctccaagtctgagttctttgacttaaacttcaatcctgtttcccatgggctgtggcttcccaaccctcagtttcagttgaagctaatttttttttccagaaatcactgtgggccctggctgctctgggtgtggtctggggaccagctgcatcccatcggcattacctgggagctcgttagcaattcgggatctcagcttcccctccaggcctgctgaatcagaatctgcaatttaacaacatcccctggggatgcactgtaacattcgagcagccctgctgcagaggatcgcagtgagacgggaagaatgtgtcttttccactagatggcaggccttacctgcgcttggctcctgcgcagaccaccacaggtggatgtgccaggggtgatgtgaacctccagccccgcgttggccatggcatcttaccagtcatgaagctcgggtgtcagtcccgccagggctggaatcctctttcattggtgacctgcacctacctgcatgtcctggcctggtgcagcatgagcttctggcttgagccatttgtgtaaagtgacccagagcctttctttcttccctgctttgcctttgtcctctaccacctggaaggtgaaggcatgtctctggggagcttcctagtcattagcctctgtgttgcttttctggatggcttgctgcacgtctctgctaattttaggccaatgtggtctatgattacaaaggttttgcatgggctttggagtcaggcctgggtttgaatcctgcctttcccactcctccaacaagtatttgttgggggcctcccatgtgctgggcactgcttacaggcaaggcccctgtgctcatggcctctgccttctttctaatgatgggagatgaagaggaagcaaacaaaacactttgagaaaacaaggaacactatcaaggaaataaaataaagcggcatgatgtgatagagggtggccagtgggctgagtgtgattagcagggataatggcatttagttgagacctcagggaccagcaggagggagccagcttgctgaaaattccagggaagagtataccaggcagagggagcggcagaggcagaggccagagggaagagtgaagcagcaggcttgtgagtgacaggaactgacagccagtgggtgtgactggagcctcgggatggggaggggcgggtgacgctggaggaaaggcagggacagccagttaggctttgtgagccccatggtgggcttggtttctttctaagtgcatggaaatttagatcccaggagtatnnnnnnnnnnnnnnnnnnnncatgcaaggtcagtgtgtttaggccccaaaaccacccagtgggggcagtcattttgtttttctcattttacaaaggagaaaacagagccttgaaaaatctgagcctggtgtggtagcatgtggctatggtcccagttactcaggaggctgaagcaggatcatcagttgaggccacaagtttgagaccagcctcagcaacacagtgagaaaaaaagtcttaaaaattagctgggtaggcagggtgcggtggctcatgcctgtaatcccagcacttggggagtctgaggtgggtggatcacaaggtcaggcgttcgagaccagcctggtcaacatagtgaaacctcatctctactaaaaatacaaaaaaaaaattagctgggcgtggtggtgcgtgtctgcagtcccaactgctcaggaggctgaggcaggagaatcgcttgaacccgggaggcagaagttgcagtgagctgagattgtgccaccgcactccagcctgggtgacagagtgagactccatctcaaaaaataaataaataaaataaaataaaataaaatacaaattagctggacatggaggcatgcacctgtagtcccagctacttgggaggctgaggcgggaagatgacttgagcccaggagttggtggctgcggtgagctatgatctcgctactgcactctaggctgggcgacagagcgagaccctgtctctccttctaaaaaaaaaaaaaagaatttgagcacccgcctctagtccctaaggcagtgcatggaggaggctggatttgtaccctgggtccatctgtctggcaggttctaacacattaagtcagatgttggaaagatacagtttaagactatgagacattggaacataagaaacacccaccataccagtggggagaggaaggagatgcttcagcactggtagttctcatagtcttatctttcagtggctttagggcacaggttgggactagtttagccttaaggtcttggagaagacctgcttttcatttgcctgttgccccagcactgtggggtcagaatctttcttgtgatcagagtttagagaagggagggagcagtgggctggaggcattccaggtagccctggagaaggcaggagaggcataagttagaagggtgagggaagggaggagggccagtggctgacgcttactgagcccttgctgtgaacccagcacagtgctagccatcgtggggcacaaaagcctgtgcaagatgcagtcgcagctcctgagcagcctcgctgtctggttgggttccatctgctttaccactaccaacaaaaccaagggacggacacctcttactgatagtaaccaccaggcactgggcgaagcacgttgctcagccatgtcgtataatcctatcaacaacctgtagtcccagctacttgggtgggagagagttactgagggcatctccattttacagatggggaaactgagacacagagaaagaggttaaataacttgcccaagccacacaactaggaagatgtggagctgggacttgaatctaactatgccattccagataattaggctcttggacaccgtcttatcctggcactaagtacatcagtggagtgatgatgatacatgatattagtagcagccacttttacttctttcttttcttttctttcttttttttttttttataacagagtctcactctgtcgccaggctggagtgcagtggcacaatctcagctcactgcaacctccgcctccctggttccagcgattctcctgcctcagccttccaagtagctgggactacaggcatgcgccaccatgcccagctaatttttttgtatttttagtagagacagggtttcaccatgttggtcaggctgcctgacctcaaatgatctgcccacctcggccccccaaagtgctgggattacaggtgtgagtcaccgtgcccagccacagccaccttttctaaaacccttccaaatgcctggcttttgctaggaactctacaagcgttccttcaggtaatcctcctaacaacttttgctattacccgtagtccttctctccattatatggtgaggaaactgagactttgcttcatatgactccattttccccaacacttcctgctagcctgttttgctcctttgggagtatgagagtcagtgtttgctggactgtgaggctgaagatgataacatttcttcaaattggcctgtttttttttttttttttttttttttgcagaaagacagatttcactggccaagatctgcccaagaggctgaataaattcctaggttgtgagaagcaggtggatggagaagactttctctccaaacctccctgtgttaggaccagggaatgggttatgtgaatctggcaaccctgtcccaccctggacctgcaccctttaccactaccctggcacatccgggacctgcaccctttaccactaacctggcacatccgggacctgcaccctttaccactaccctggcacatccgggacctgcacccttaaccactaccctggcacatccgggacctgcaccttaaccactaccctggcacacccgggacctgcacccttaaccactaccctggcacatccaggacctgcaaccttaaccactaacctggcacatccaggacctgcaccgttaaccactaacctggcacaaccaggacatgtgcccttaactattaccctggcacaaccgggacatgcacccttaaccactaccctggcacatctgggacatgcacgcttaaccactactctagcatcatccgggacctgcacccttaactactaccctggtctgcctccttgagtggcccagggaacatctagaagctgagagaaagagagggataaaaccaagttcacagcagtatcctaagaaagtgttctcacttaaaaatgcaaagatgctcacagagtgttcaggttacactggaaaactccagaaacaaagtggtttgtgtacatgggaggaagcagaatcaacttcccaccttagcattgtgggtgcttagcccacgcctgtgtatcgctcagggaatcagagtcactataagcatcatggaataagggatttactgtacacgttagaccttatacaagcttggagatgctggagacgggaagatctggaggggtgaattgagaatcagaggaagagcagtggtgcaggtggacaagtaggagttggtaggggatccaagaagccaagcacgttgagctgctgacatagatattgatgaatttcatgaagcttttacaggcactggtttcacccttgggtaactcagtacaggtatgtcgacagccttccactaattcaaagatggttcataggtgtcccagaatcttttaattcccaagtgaggcagccccaactccttcagccatttactttctaatccttaatccacagcccacaacctcaaacacatgatagggccgagtatgccatcattgatgtcaacccggaactcttcctagacaacactccagttggagtagcttccttataaagcagggtgcccagagtgaaagagaatccacctgtgttgccgaggagcgaaggattgtcactttccttattctagatcagctgttttcaaacctttcggcttccagcccatctaggttttatgtaacacacacacacacacacacacacactgcacaaacaagcacaaactcacaaacacacacacattgcacaaacaagcacacactcacaaccaaaaccaaactgccattaatgcttacctctacttatgctcaccacacactctgatacattctcctctcttttgtggccctcttttctgttcatttccattctatttcctttaagaaaccctttaaggaaaatgctcttactctgcaaattgatttcactaacaattggcaaatgtgtcatgacccgccgcttgaaaaacactgtcctagacaacaaaattctctttctgcatcctgagatgatactactcttttggggggtctgggggtaccaccagccacattgcactgttgacttatcttgggtttatgatcagttaaagctctcttgtctatcacatcgggtgctgctagcctgcaggccccacatccttgtgcaagattttttttttttttgagactccaggatgaaacctgatgcatttcatcttgtagggtttggccttttgctccacggccaggctgagagcttttgggtcttcctgttcttgtgccgagtgtcttccggacatcaccttcctcacaccattctctgtgctacttgttctgccctccttacttttgaaaagatagtttattactcatagatgaggagcaggcgtgccactccatgaaaggccacacagggaagcagcagggtctgccaggaggcagaggaagcggaaagaaaacgtggcaggagcatttgctgctgtttctgtgagaaggagcaggtagggcgggaaaccagccttagggctggctggtttgaatgatctcagcagactctgggtgtagaggctgtctctctagttgcctggtacctgatacctggtgcttttacctggggtaattagcacaggctggcccagagtgtaagagccccatgaaggagttggttggaggtttgggctttggattggttggtttgcatatgaaaggtgcgcttgcaggtgagttctttactgtctctaggaatgggctagccctgggacagacagtttctccagggtcagcaaggctccgagacaccaaagcatcagaaatacagaaaatagagccaggtgcagtggctcatgcctgtaatcccagagactcaggaggctgaggtgaagaatcacttgaggcaaggagtttgagaccagtctgggcaacatagtgagacccctgtccctaaaaaaaattaaaaataaaattacccaggcatggtagtgcagcatgcctgtaatctcagctactcaggagactgaggaaggaggatcactgaatccaggagttcaaggaaagaggccgggcacagtggctcacgcctgtaatcccagcactttgggaggctgaggcaggtggcgagtgaatcaccaggtcaggaaagggagaccatcctggccaacatggtgaaaccctgtctctactaaaaatacaaaaattagctgggcatggtggcgggcacctgtaatcccagctactcaggaggctgaggcaggagaatcgcttgaacctgggaggtggaggttgcagtgagcaagcgagactccgtctcaaaaaaaaaaaaaaagacataaaattaatagaccttagactattttatttaattattttatcaaaataggataggcatagttaaaaatgccaatgtgcattggagagctgaggatgaaaagcaatgtcctgtacttgagcttgcatcagaatcatctagagagtgccccaccctcagagtttctgattcagtagacattgaagaatgagaatttgaatttctaacaggtccccagagaatgctggtgtgttcacactccggttaccagaaagggatcccgatccagaacccaagagaggttcttaggtcttttgcaagaaagaattcgaggcaaatccataaagtcaaagcaagcttactaagaaagtaaaggaataaagcatggctactccacaggcagagcagccctaaagctgctggctagccacttttgaggtcatttcctgattatatgctaaaaaaggggtggatttttcatgagttttctgggaaaggggtgggagattcccagaactgaggattcctcctctttttagaccatgtagggtaacttcctgacgttgccatgacgattgtaaactgtcatggcgctgctgggagtgtctcttagcatgctaatgcattacaattactgtataatgagcagcaaagacgaccagacgtcacttttgttgccatcttggttttggaggattttgacctacttctttaacacaacctgttttatcagcaaggtctttgtgacctgtaccttgtgctgacgtcctgtctcattcagtgacttagaatcccttaacctcctgagaatgcagcccagtaggtctcagccttattttacccagcccctattcaagatggagtcactctggttcaaacatctctgacactctgagaaccactgcattggaagacactattttcaactctttaaactctttcttccagcacttgagctctaaattttaatcatgtgctctgtctctctgtcatttcactatttcatggctctgacttcctgagaaggttttaattctctgatgtgatccctctagttctcttcccctcacatccagcacggggttactgccatttgtagttcactcactcaaaaaaaagtgattattaagcatcttctgcatgtcaggcattgacttagtcactggagatttgtcagagaacaagccaaagtcctgccctcatggagcttatattttagtgcagggcttgacaaactttttctgtgaagggccagatgggctttggagctatctggtcactgtcacaactacttaactctgccattgtaacacggaagtggccacagtgtgccaatgaatgggcacgggtgtgtgccaataaaactttatttacaaaaacaggcaggaggctggatttggcccttgggctgtagtttgtagacctctgttgtagtgtgggagaagacaaagtaggtaaataagtaaaatacgaacagtaagctaaggggaaaaagaaaaaacggaaaaagaggatgggaaggaggcaggaggggactggacctgcacatttagatatggtggcaagcaggcagtcactgagatggggacattgagtaaagactttcaaaggagatgaaggagggagccatgcatctccctggcagaagagcattccaggcacagtaacagctggtgcaaaggccctgtggcatgagcatgttcggtgtgcttgaagaaacagcaaggaggctcgtgtgtctaagtggggcaagtcaagggaagggagcaggagaggaaagcggaggaaacagagaggcagctgctgagggctatgtgattcttgggagggaatttgtcttttctcttagtccaatgggaatccattattgtgactctagtagttgtaatagttcctttaagttttatttatttattttagatacaggttctcactgtatcactcaggctggagtacagaggcacaatcactgctcactgcagcctcaaactcctggcctcaagcaatcctcctgcctcagcctcctgagtagctgggactgcaggcacacaccaccatgcccagccaaatttttaaaaattttataatagagatgggatctggctatgttgcccaggctagtttcaaactcctggcctcaagtgaccctcttgcctcagcctcccaaagtgctgggattacaggtgtgagccactgaacctggctatttaagttatgtatttgcaactccatttcttgctttcccaatggtaggcaatatctcttaactttgtcttttgtagagcatttttatatgcatgatatcatttactccctatgagatgtgactattgtccctattctgtagaggaggcaactgaagctcggaaaggttaaatgacttggccagattcatatagctgataagtgctggtgctggaatttaaacccaggtttgtcttaatatggagatcttagcacctattttatatgaagagacaatcctttagggatactggggaaacctgtggcttttggacaataaattaaaaaccctttcccaagaaggggagctgtgtgtgtatcaatcaaacaaaatgagaactattctgagagggaggaaaaggttcttttctgtgggaacgctgaccaagccgttgacagctcatttatgtgatgctggtgcagtttgacattcatagtacaagacttgcatgcaattagcacgaatcgttctaacagtctcttgaaaacatttggaattttccctctgtctggccttgtgcatgatgtaaacatggctttatttagttggtcatccatcccagaatagtgtggtctgcatctgtctgcatcactgtggtctgattgaggtcttgttttcctggagggcagagactgttgtgtaggcttgctttgtggatcctcctcccccaggatcattcgccacaaacccgatggcagcctctctctttagctcatgacaatttctccaagtgtaagctgggggtcccgttcagtatgcaatgcaaatgagatgcaaatgaggggccctcttgggcacaggccaggaggccagagctctggggacttctgtacccctcctctgagttgcctaatgaagctgaccgttcctttcacaatcatcttctccacccaccaaaggcctcttaatgagggcagaagctgactgctctgaaaccccttcagacacctggtgattggaagctggagagacagtgagctttagatgggctgtcagccgctgctgagtcctcatcagctgcctgctgggttctgagaagcactagggaaggaagggagatggccctggaactgactgctattgtctgttcctcctcccctgacgagctgcatgcggcagccacggatggctgggtttgggctttcacgtcggcttctctggcccttgctggatgcctgcttcagctcagagaatgtggcttcacagggacttggaataagagctgagagcctgttccccccatcgaggatcaatgctcctttgatttcatttcttctttccagacgaatccactgtcttagcccgttgttggagaaatcccgacctaagcaggctttcaaattggggaaagaaaagtgaaccaatctgaaatcatggaatggttggtggagaaggacaagtaggcatatccataaagagccagcagtcccaaaggatgttccagtgcatctttctgcttatttcttctagttttgtaggggtgtgtggtgtgcaatgctgtttgcttgacagaatcctttcagtctctctctctctcgaaatataaatttcctgcactacaacagcctactaagtgccagacacagtgctgggctctttacctgcatcaacccattttgtctccattgacaaaaggggaaactgaggctcagagaggttaattgacttgctcaaggtcaactgggcttctgtgtggcagaactggagtttggtcccaggtctgtttgcatctaacacccagccccttaaccactttgccgaattgagaatttggaaattaaaatggtgatttcaactcagggatgggtgtgctttctttcagccttgcagtaagtgcacatcttctttctcttttcctctttgaagctgccagcctctcccttggggttctccttggctctggccatgatttccccagcttcctcattcatacctcctggcatcagactgacctgggctaatcaccatctctgcctgtcactagttcaagaggcagcttatggggacttgtgggtcatacaggttcccctagaaagatgatgggcagactgacattgggattgaaatgtcttgtctccagcgttcttgaataggggcaacaatgcccactgggtctccaggcatggggtctaaaagtgaatgcaaaatacctgtgatacagtgtggatgttttatccccaccaagtctcatgttgaaatgtgatcctcggtgttggaggtgaggcctcgtgggaggtgcttgggccatttttgggtcatggggcagacacctcatgcctggcttggtgcactccatgtcacctaaacgagttctcgctccatgttcactagagatctggttgtttaaaagagtctggcacctcccctctctcattcttgttcccgctcctaccatgtgatacacgggctcccctttctccttgtaccatgattggaagcttcctgagtccctcaccagaagtggatgccagcaccatgcttcctggacagcctacagaaccatgaacaaaaataaacctcttttctttataaagtacccagcctcaggtattccttgagagcaacgcaaacggatgaacacagcctatttccatagccttgctattggtgagtcttgggcccgtggtgcatgcacaggggccagatccagcccttaccccaagagcagattcaaacgtgtctttccctgattatttatggccactaaaatggaaggtgatggttgtggtgggtgtctatgatcagggctcaataaatatttgttgaaaacaaaaatgtaaacaagaaaaagacaggaccttgtcaacaagtgttatatagttgcagatctttatcttggattgttcagactctgcccttctctggcaggcacacttttgggaatgggaagggccaacagtgcttctttggtcccattagatccccatgtcagccctatgaaataatactatcccatacttactactatttcagctttacagaagggaaaaatgcagctcagagaggtgaattcacttgcccaaagtcccatcgctagggagcgatgggatttgaattaaaaatgcagatgtgattgattctaaacgcaggctgttaatgcatagctttcctggggaacaaaaagagctttcctttcatacctcattcattcattcattcacttattctttaatctcttctgtatgggaggtcatttgctagatactggatggctgtaggaatgaatatgattctttacacgctgagtatttcatagccctactaagagagaagaagagagagctcactataaaaggggggattggtgaagagataatggagtaggaagcacatgctgtgggaggtgccaggggatgagaggttaattccaacccatggggttgtgataggcttcacagaggcaaaggcagtggacttagttctggatggggcagagatctaacgcttattgatggcttgccccttgctaggactcagctcggtgggcgctttgtctattttctactttgaaagatgaatagaaactttgacggtcttttgccctctgaaatccactcttcacacccagccacaggaatctttctaaaatgtaaatcaggccatgtcacccccctgcttaaatgattccaagccttctcagagcttccaactgaaacctaaactcctcactcctgctctaagagcctgcagattctgcttccttcagcctctttccaaccttgtttgttcttttcccatgatagccacatctctgagccaacaaatatttttccttccttcttgcacttgctcttccctcagcttgggttgcttttccttgggctctatgtgttgccaactttccagtagccttcagtcatcactaaatgtcaccttctcagaaagcccgcctctgagtcttatctgaagaaacccctcccagtcactccctatcccattactctgtttgcatttgtttatttatttgcttcttgcctgtttctctccactggatggagagcaagaaccttccttattttttatgccactttgtgctagtgcagtgcacaattgacatgtacagatgcacaattagagtttgctgagtaaatggctaaataggttaaaaaaaaaaaccaaaaacggtgggctgctaggcagaagtgtaaccacacaagtgaaccttgaaagttaccatgaaacgtaaccttcatgccctgtgaaggtgccttaggtttctggtgtgtttggaccatagattgtagctatgaagtctgattaatgcctgaatcagacattgaatgacctgaataaatagttaaaaagttggacttctaggctgaagtgtaaccacatgagagaagcatgaatgttaccatgaaggtgcctagggtttctggtgtgttcagaccatagattgtagctatgaagtctgattaatgccagctcacagaagagcttgctcaagcatgctagggatttggtgagccattgtaggtggtaatgacctgatctagttaccatgggtgacaattaaaaagaaggattaaagatgtaagggactagagctgtagagacccatccaggagctattgatccctgtaggatggaggagatgaaacatacatgaattaaggaagtggaaggataagaataaattgatgtagaggatcagggagaggatggaggagtcaggactaacagagatttctgactcaggaagacatgtggatagtgagcgtgatagccaattagggttagaagtcacagaagcttaccagaagggaaaggtaatcatcttgctttagtatatgttgagatgtttttgggttgcatgggtgactgtgtccagtaggcagatgaatctgtatatccagagatccgattggaaaaacagagccaacagtatggatgcaggggtcaccggccctaacagtggaagctgaattctttgagtgggtcaggaattagtgcagcactgtaagagcaggaaggttcaggctctgggaaatggagccacttcagtcatcagtggagcaagaggagccagtgaaggagaatttaaaaataatgcttttaagtccaggtgcagtggctcatgtctgtaatcccagcactttgggagtctgaggcagaaggatcgcttgagcccaggagttcaagaccatcctggatgataaagggagactccatttctacaaaaaaaaattttttttttttaatgtagccagtgtggtggtgcatgcctgtggtccaagccactggggaggctaaggtggaaggagcccttgagcccagaagtttgaggctgcagtaagctatgatcacagcactgcactccagcctgagtgacagagtgacaccctatctcgaataataattattattagtagtaataattatagtgcttttagagaatgaaggggaaccagccgagtaaatggtcatagaagccaagggaagagagaattcaagaaagtggatatggccaacaccttagatgctgccaactggtaatgataaacacgaggctaagaattgaacagagtcactggatttggtcatttaacttagggacttgggaagtgctctttcagtggcatagtaggagttaagaggcaggatgccggaaagcctggatgctggatgttgaggagggaattgaaggaggggatgtggaaagaggagtgtagacaactcatgagaatttgggttgtggaagaaaggggccagggaaggcgtcttagaaggaagttatttctgagaggcatctgagcaggtttatagcatgaatggaagaaagcaaggtgcctgggaatagggataggaattaagcagaagcggtcctaggctttgtcttcaggaagataggtgttcaagtcccagctctgccacatgctggctgtgggactttgggcaagttaatgaagccccatgagtctcagtgtcctcatctggcgagcagagagagtagcctgtaccttgcagagtcatggcaaggatgaaacaagaatgtctctcagggccttcacagcgcttagtgcataatgaggggttagttagtgaactcctaccaagctcctttgtacagggcatttagcaaagacgtcagtgaccctgagaatccctagtctaaggtaggtaccccttccctaagcgctgaacttcctcccttatgcatgtatcacatctacaatgtttccttgtgtagtggatactgtggtgtgccaccaggatccctctctcagcacagaggcactcctgccccaagccacgcagagtattggctctgaccactcacggcttcagtatttccgtaggatttgccctgagggagctgcagtgcccaaggttatgccctcttccaggggcagctcacagtctatgattggttgctggtggggaatgggcttataaatgctcttccccagcctcagtagggaacaagtctaaggggccatcccagctacagagctccctcatggatcaggtgacacctctgttgcagctacattgcagttcagtttctcgatttcatcctgcttcccccattccttgcaggagttcctcccaaggttattccctgagaagccgcctgcatacaatatccagatcagtcttttttcagggaacccgacttaagatgccttgtttaatgtttgtatcttttctctaaaatataagctttttgtagggactgactattctgtcttgttcattttgtgtcaccatgtctaggtacataataggtgcttgttaataatttttaatctttttttttttgagacagggtcttgctctgttgctcaggctggagtgcagtggcatgatcttggctcactgcaacctccgcctcccgaattcaagcaattcttatgcctcagcctcccaagtagctgggattacaggtgtgcatcaccacacccagctaatttttgtatttttagtagagacggggttttgccatgttggccaggctgatctcaaactcctgagctcaagtgatctgcccactttggccccgcaaagtgctgggattacaggcatgagccaccacatgcggccattaattgaataagtgaatgaacaggtttcctaaacacacacacaggagtgccctgatatatacagtttttcagagttgtgattagagaataggttatctggaagtgccttcctgtgggagtgtgagcttgcataggctcccccagcatggagccatcactagcaatggctgtgtcttccacgagctatttccagggttccatcagcaaacagtggtcacgatttataaaacgttcacacaagaacatttgggctgcattctacatcattttagtacagagaggttgttccttggggcctttaattttctagctttcattattgagagagtaaaatgtatcacttgcattccaaaattgatttttatttcccaaaagaagcccataaaaataaataacttcccgggagggaaaacagaaaagcactctatacactgggcaatttgttaaaaaagaaaagaaaaggaaaggaagcctggagcgacaaagcaatctaaacatttagattgtatctcttgtattcccccactccccctgcaccttaaataaataaaaaaaaaaaaaaaaaaaaaaacttgaggcctgctggactttgaaaatgcccatgttgttgagaaaactctgttgggcagcttcatgggacagcatcctttggagcactgcctcatggttcacacccctggtatcccaacccactgctatgttgttattagcaagatacgtttccagtatctcattactaattgtatcagtaagcatttgctgtgtaacaaattgctgcaagggtagtgggcttaaaacaacattctttctctcaattttgtgggtcttctgggaggttcttgtgatctgggccagcttgtctggggctggagggtctgtgaggccctcactctcacatctggtggttggctcagtgtcagctggagggacagggatgccttggccattgcctgccaccacccagcaggctagcctttgcctgctcactggcatctcaagagcagtaagtgagggcatttcaatccaagccccaattcccaagcacttttgaggattctgtttgcatcgcattggctaatgtcccagtcacatgaccaaacccagatgcagggaatggagaaacgaattgttgttctttccttgacattttactttctcaagtataaaggggggtttgtaggcaaggaagatgccaagtagtcccattttatagctaataaactgagaaccagagaggttgagcaactggtctgaagtcacgcagcaagcccagaacacactgggtaaccaatccactgggggtgagttcaccctgtgcagccacatttgatctccccttgcttcattccctccagcactctggcagccaggaggacagctccctgtggggactgtgacattactggcccctcactcagctcttcttgtgccaattagaatgcatacttatttttttttgcaggttgtcctttgcttgcatccctcacctcccccatccactctgtgatcttctctgtggctcaagagcctgactccttcagagtgcatgacatgggctcttttcctttttagtttctgattgagttcaagcagtaagaggcattgattggcaagagattgtaggatggtaggaatgagaagatgcggcatttctgtcccaattcctctgctcttggctgtgtgtccagcagtatcagaaggccccttctctgtgtctccagatttcactgggctctggtaacactacttccttctttggcctcttcaggcctaggggtagcaatgacatctcaatgctgctactctctggatgtctcaccatgcgttgttgatccctttaaccctgtcttcacatttgtgagtagtaccttaattaaaatctctagagccttctgaattggattctgttttctgcttgcgcctatcctgatacactttttttttttttttgagatggagtctcactctgttgcccaggctggagtgcagtggcatgatcttggctctctacaacctccgcctcctgagttcaagcgattctcctgcctcagcctctcaagtagctgggattacaggcgtgtgccaccatgtctgcctaatttttgtatttttaggagagacagagtttcatcatgttggccaggctggcctcgaactcctgacctcatgtgatccgcccgccttggcctctcagagtgctgggattacaggcgtgagtcaccatgcctggccactgatgtactttcactgggttccattttttttataaggggagaaagaatggagtttgcagcatgcgcttagggaacccagtatcatgatgatagaggagtgagtagcctgcatgaatgctgctgtggcaggaagaatgtttgagaacttgagcactagagtgtgagatttctggttgtcttggctccattcagggaattcttaggactctgggaaggacataccaggatatttatggcatcactgtttgtggtggcaaaaagctaatagcctcctgaatgcccgtttttgaaggctgaacatgttgtagtctgtccatgctgtggtataacttgcagttgaaaaagaatgagtttcaaactgactgacatattgttgggtgggaaaagcattttgcagagcagcgtgtatagtgtgattccgtttttgtacagtaaccctcccagtccatttgtttctaggtgattgtctcagccaggagaaaggtaggaaagagtaaacaccaggttgccgtccttcttacctggcagttggggaggaggagaaagatagaatgggaaagcaagtaggtaaagggagcttgaaaaaaaaatcatagcaaatgggaacatacacatagatttaatttggtgtcccttttctaactttttgagatagatatagcattgatttttcagcctatcttctttcctaatatgtacattaaggctacacattttcctttaagcacagctttagttgactctcacaagttttgaatatttttgaattttcatgatgatttttcctatgatttattcaaaagtgtatgtttaattttcaagcatttgtaaatattctagttatctttttgttattgatagtttgtttccaccacagtctgaaaacatacataatttcattcatttgacatttgggtaaatattccatgtgcacttacaaagaatatgtatcctgtgtttgttggatgccatattgtgtgtgtgtaaattagtttcgttagttgtgttgttcatattttctatatcttgtttgatttttattttgcttgcttgttctgttactgaaagaattggatttaagtctcctattatgattctgggtttttttcctttcagttttatcaatttttggtttgtatattttgaagcaatgttattattataaaatataattgatatctcctcggtgaattgatccttttatcattctgaaaggtatctgtttatctcaaataatgcttcttgccttaaagcctactttgcctcttgtaaatataccagttttcttttggttgatgttttatgatgtgtgtgtttatatgtatatacatatatacatatatatagaccgaatatatgtattatatatgttttatataatgttttatggtgtgtgtgtatatatatatataaaaagactgaaagggaaaagggggaaatatatctatatataaaataatataaatatatatatatttttcccccttttccctttcagtctttctgtagccttacatttagagtgtgtcttttataagcacaatttttaatacagtctgacaatagttgattttaattggagcatttagaccatttacattttatataattgctgatatatttgagtctatatctaccacttcctatgatttttcgtttgtcccatgtgttttacattcctttttctctttattattgccttttggggatcacttaagtatattttattatttcatattcctttctattaactaattagtcatgtattgtttttattatttttatattgattctagagattgcaatatgcatctttggattttagaatttaatatattagtacttttattacgttccaaatgatcctaggttctttaacattttagtcctgtttaccccatcctaccatacacattgtaattttacatgtgatttaaactacattatgataatgcttcatataatcagcatttacttggatttaataatatatttaccctttctgttagttttcattctttcttacattttcacatttccatctgggatcattttctttctctctaaagaacgtcttttattatttagtttaggcctgctgcaaatacatcttaagatacttgtatttcaagctgggcacagtggcacatgcctgtagtcccagctattcaggagtctgagacaggaggattgcttgagctcaagacttcaagtccagtctgggcaacatcgtgagatcccatctctggggaaaaaaaatctttatttcacattcacccttggatagaatttgaaactggctgttattttctttcggcactttaaatataccatcccgttgttcttcttccatcatttttgttgattttgtcagtcttattgtggctcttttgaagtcctattgttgcctttatgcaatctgtatgattttagattttctctctctctttgattttcagcaatgtgactgtgatgttcctgtgtgtgtgtgtgtgtgtgtgtgtgtgtgtgtgtgtgtgtgtgtttgtatgtgtttatcttggttggtgtttctttacttcttgcctctttaacttgatgtttttcattagtattttcttgtccattgtctgccctatccttttctctccttttcatgcttgactttgattatatgtatgttagaccttggtactgtgtcctctgtctctgacactctcttctgtactctctgtctcttttaatctttatgccatagtctgatttttcttaataatctgtttttcagctcactgatttgccttctaactgcttccaatctgctgctaagccatgcattgagttattaattttaagtattgcattttaaataaactttttattttagaatagttttagatgtacagaaaagttgcagaggatagacttcccgtatacctttcactcagttttccattattaacacgttacatgaccatgacacatccgtcaaaatgaagatgttaacactaattagtactgtattgttaactaaactccaaactttatttggattttccttttttttttcacgatattcttagtgtattccaggatctcatgtaggataccaaattacattaagttgtcatgtttcctaagtgtcctctggtttatgacaatttctcaatcgtttcttatttttcatgaccttgacagttttgagaagtactggtcaagtatctggtagaatgtccatccacttgggaattattgtatgtttaattctaaagctttcatttgctttatttagttattttgagacaagggtcttgctctgtcacccaagctggagtgcagtggcacaatcatcactcattgcagccttgaactcctggcctcaagcaatcttcccacctcagcctcctgagaagctgggaccacaggtgcatgccactgagcttggctaatttttaaaaatttttgtagagatgaggtctcgctgtgttgccccaggctggtcttgaactcctggcctcaagtgatcacccctcctcagcctcctaaagtgttgggattacaggtgtgagccactgtacccagtcagtttcttttttgtaaccaatagttctctggtgaaactttccacattgtcatcctttctcccttcttttaaacatcttaataagttattttaaagttcatgtttgataattccagtgtctgaatcacccatggatctgccctcttgtctgtttttttaaaattttttagacgggatcttattctgtcacctaggctggagtgcagtggtgcaatcatagctcgctgcagcctctacctcctgggctcaagcaatcctcccacctcagactcctgagtagctgggactatagatgtgtatcaccacaccccactaatgtttgtatttttgtagagatggggttttactatgttgtccaggctggtcttgaattcctgagctcaagccgtctgcccatgtttgcctgtcaaagtgctgagattacaggcatgcatcaccacgcctaggtgttttttgcttctggtcctatttcttggcatgtttggaagttttgtttgaatttcagatgattccttgctaaattagaaagctgttggacaggtgtggtggctcatgcctgtaatctcagcactttgggaggacaaggtgggtggatcatctgagatcaggagtttgagatcatcctggccaacatagtgaagccccatctctaccaaaaatacaaaaattagcctggcatggtggcacatgcctgtaatcccagctactggggaggctgaggcacgagaatcacttgaacctgggaggcggaggttacagtgagcctgggtgacagagcgagactccgtctcaaaaaaaaaaaaaaaaaagagagagagagagagctgaggaagaggttattttccatgcaggttggggtcacccttctggtggtgatcgagctcactgtgtgctggtttatagccttcgtaaggtttgttctatttctggttcatttccactcctatggtgtagaggtttccaactctgaggctgaagacttgccagggccctccttttaactgggtcctgaaccccaatttttgtttctctagcaccataagcctgacaaaacctctcagctgatttctgttttgtgtctcaacctctgcagtgtgattggtagagactcaagagaaaaatcaatgcctagcgttgagttcacttctctgctcttcccctcccactatgatttggcccctcaagtcctgccttccctggaagctttgattcctagccccaagaataagcttcaagctctggtggcctccctccttcttagcaggtgccctctgtctagcttcttagtcctttgccctgtgttgagaattgatttatggcccaaaggaaaaaaaaaaaacaaaaaaccacacacagaatattggacttatcttaattctaattccttcaaaattccagtttcttgaaaaatattttttatctggcttttatagttgctctcagtgggagagctactttatcattgccccaagtggtatgatattaaataaaaatataaaatacaaaatagatttagagtggtataattatgtaaaaattgaatgttaacatggaaaaagaccagaaggtgaatatacaaatgaaagcatttatttaattttgggataagatctaaggtaatatttgtttggttcagaaaattatttttaaagaagggtgttgtgagcatcagtgatagagtgaggaatcctcatttctttcagatcctggtaggggaccctgagaactttggggagtgaagatagtgaagtaaaggttgctaagcattctgctagaacactatggagacagcgatataaaataagagccaataataacaaagtagcacatagtgaatgtttaccatatgccagacattctattaatttataatgattgtaacattcctatgagccaacatccttatcattagccccattttttaaacaaggagactgagttaccgagaagttaggtaactttcaggtcacaaagctgctctatggcagagctgatctgccaggatctctgggtttaagctcctcaccatcacacttgactaatttggtatagaaagtggctttagatcagataagggtacatgaaatgcaggaggtgccgtgttagaggacagtttggtccagtccccatgtcctggggcaaatgaagcagatggcctcagaacagcctgtttttaaatcatgtaagactgacttctttcagctgctggattcctgcctcccagagtgagacgttgaagtttggcccggaagaggctgagcactggggacgagcagtgctgtgctgtgtatagagtgcttaaaacagtgcctgggtctgagcgtggtggctcatgcctgtaatcccacctctttgggaggccatggtgggaagattgcttgagcccaggagtttgatttcagcctgcaacatagtgagaccccatttctacaaaaaattttaagaagtagtcaggcatggtcgtacacctgtagtcccagctacttgggaggctgaggtgggaggatcacttgaaccccaaaggttgaggctgcagtgagtcgtgattgcactactgtactccagcctgagtaacaaagcaagactttgtatcaaaacaaaacaaacaaaacaaaacagtgcctggcatatagtatgtgctcaataaaagttgtcattgttattgtcatgacatcatcagagcctagaacaaatcacaaaacctgtatattctctctgggctggaggtcttaagattcttctccattcccaacgggtactcccgagatgacgtgattcatggccattccttccttccttcagtgtgtggctcacactgtgctgggctatggcgtcaccactgtcaatacgacaaataaatggataattacagcaaagtgttaggactgctgtgccagacacgagtgcaaggtgtcctgggcaaccagggaagggacgttaacttacactgggattggggccctgtgatggtaagcttttcatcttgcaggaaaccaggggatttttttttttttttttttgagacaaggtcttgctctgtcgtccaggctggagtgcagtggcacgatcttggctcactgcaacctctgcctcctgggttcaagcgattcttgtgcctcagtctcccaagtagctgggattacaggcatgtgccatcactcttggctaatctttgtattttcagtagcgacggatttttgccatcttggccaggctggtctcaaactcctgacctcaagtgattcgcctgcctcagcctcccaaaatgctggaattacaggcatgagccgttgcgcccggccttgaaaccagggaatttaatgacatttaaaaatcatttattaagtatatatgaaatatatagaaaatagtatcccaggcacctaatagaacagaataataataatgactaggagttgttgagtgtaaaataggttgcagtcattacaacgcatataatagcatgaagtatatagctcctcagccctctcagccatcttatgagggaacactgttgctattctcatattacagatgaggaaactgaggctcagagaggttaagtaatcctccaagcctccgcagccaggaagtggtatcactttgaactcaaactcaggtctgtttgatcctgaggccaagcccttggccagaaaaattaggaagtcatagtcccttcccttaaggagctctatttaatatagcagaacaagtaaagcaagtacatatctctctaaagtatactgtgtcactgaagataagaaaggaagaaatcctgtgatgggtcagatgaagtcaggaaaggcttctgggaagaggtggccttatagatctaactagaaggatgaatgagctttgggccaaaggcaagggagggaaccatctggacaaagggtagttagtacacactgtgacctgaagagggagctcaaagcccccctccactccagggctgatgtgaggatgtgagttaaggacttggatgctgctcttggggctttcagagataggggaggagcttaatgacctcgtcttcatgatataccctaagcattctctcttggctttccatttgagacttactctgccttcagacctctcagaactctgcatatctggtatggtaagaggagcctgagctacctcttctctgcattgccttgaaaacaaaacatggccgggcacgatggctgacgtctgtaatcctagcactttgagaggccaaggcgggtggatcgcttgagctcaggagtttgagactagcctgggtaacatggtgagaccctgtctaaaaaaaaaaaaaaaaaaaaaaaaaggacaaacaggactggggaaaaggaataagaggagcccgtccaaccttccaatttccaccaattttaatgtggatccagaattgagaatgctagtctagctcaactcaacagggccagtggttctacttgtgattgggggtaaaggtcctagggtagtaaagagagtgagtacctgcctggcttgtccgctctgcacatgtctctgggcagtagctgtgggatgtggtcctggacactagatcccatctgtctcctcctatggaggcaggatcttacagggaacagccggcagccaaggctagctggagtctggcctacaccatataaggagatggtgcaggaaaggctgaaagttatggtgggggccgaagagggcgttgagttgcagtaaccatgcccaagcctttgtggagttaatgatcacagtggacacattctggaggggtcgtcggcatcactgggccctgctccaggatctcagcaaggatgttattattatcatgagggtgcccaattcagtttgctacttgtttatgggctgattgcaatttggatagagtttaacccccaccccacccccgccttttgtttttaaaaatttgctgaggtgaaattcacatgacttaaaatgatctgttttagagtgaacagttcagcggcatttagtacatgcacagtgttgtgcaaccaccactgctatttagttccaaaacatttccatcattccaaaataaagccccatactgattaagcagtgactacccatccctgccttctcccagcccctggcaaccatcaatctgcttttgtttttaatttttttgagacagggtgtttctctgtcacccaggctggagtgcagtggtacgatcatagctcactgcagcctggaactcctgagctcaagcaatcctcccacatcagcctcctaagtagctgggactgtaggcatgcaccaccatgctcagataattattatttttattttttataaagatgggggtctccaactcctggcctcaagtgatcctcccacctcagcttcccaaagagttgggattacaggtgtaagccaccacaaccagccaatctgctttctttaactctctctttctctctctctctcttttttttttgagatggagtttccctcttgtcacccaggctggagtgcaatggcatgatctctgctcactgcaacctctgcctcctgggttcaagcaattctcctgcctcagcctcccaagtagctgggattacaggcctgtgccaccagaccgagctaatttttgtatttttagtagagacggggtttcaccatgttggccaggctgatatcgacctcctgacctgaggtgatccacccgcctcagcctcccaaagcactgggattacatgtgtgcgccacgcacctggcctaactctctctctctttttaaggctgtttaaaaatgaaactattcagtagctcaagtataccttactgtaaagaggaagtatttatgcagtgctcagtcatcttgatcagagatgattatcaaaacatcaaaatatctctatgccagctggcaactaagaaataccaccagatgtcctctgcctctctggccttgttagtttcttctccaagagcccttggatgtgatctgataatgaaaaggtgaatgtctagttcagtgggagccttcacatctaccccagggctttggctgtctccaatctgatggataaaccgcttgctaaatattttgactatcagccctgtgattaaggtcaggattagaactgttgtatttgtaagaacctctcctaaagatggcctcccattgcccacctgtttgaatcctacctgccttaaacatttttgccatttttatttatttcttagaaacaggatcttgctctgtctcccaggctggagtacagtggtacaatgttggctcattgcagcctcagactcctgggctcaagtgatcctcccgcctcagccccttgagttactgggactacaggcgcatgccaccatgtctggctaatcgtgaaaattgtttttgtagagacaaagtcttgctatgttgcccaggctaatctcaaattcctggcctcaagtgatcctccctccttgacctctcaaattgctgggattacaggtgtgagccattgcgcctggccggttttttaaatgtctcagtctaaagttcaatattcatcccctagcccctaagccatgtttttaacacctcgataaacgatgtgctgactttacctaaaatgtgtccagtattccttctgagatggaaagatgctattttgggggtaaatatgttgatcttttccagaaggagtccaagacagctgatgatagcttttgcttgttctctatagaagagcaagtgatggccgggcgtggtggctcacgcctgtaatcccaacactttgggaggccgaggcaggcggatcacgaggtcaggagatcgagaccatcctggctaacatggtgaaaccccgatacaaaaatattagccgggcgtggttggtggcgggcgcctgtagtaccagctgctggggaggctgaggcaggagaatggcatgaactcaggaggtggagcttgcagtgagccgagatcatgccactgcacttcagtctgggtgacagagcaagactccatctcaaaaaaaaaaaaagaagagcaagtgatgtgtttaagacacacctcgaagctactgccatagaatgtgtgaccatggttatggatttcataaggggcaccctaagagggaaaaataatctgacccagatggatcttccgaggcactgtgatgtcgtgcctaagagtgcagccttgggaggaagacagagagggttcaaatcccgctctactgttatcagctctctgtataccttggacaagtcactcaaccccctcagctgtcaggttccacatcagtaaaatggggaaaacagtaacactcacatcataaggttcttgtaaggattcaatgagataattcatgtgcagtccttagaatagtgcttggctcatatagtaagagctcattcaccgtcaactattattatttaatctattttctatcatattttggaataaaacattttggcttactaaaaaagaacaaaaagaacatgtatttaaaatcagtaggcaacagtgagtcagtgaggatgttctgagagtaggaatgacatgataagatctgcgttctgggaagattaatttgtctgaagcttatagggtgacctgaaaggagacgaggaggggagggaaatctgtaaggaggctgatgcaacggtctaagctgctttgtgcaatatggcagccactagccacgtggggctgtttaaatttaaattaacgagcttggcctggtggctcacacctgtaatcccaaaactttgggaggccaaggtggaaggattgcttgaggccaggagtttgagaccaatctgagcaacatagcaaaaacttgcctctacaaaaaataaagttagccaaatgtggtgggatatgcctatagtcccagctactcgggaggctgaggcagaaggctcacatgagcccaagaggttgagactacagtgagtcatgattgcaccacgcactctagcctgggtgacagaacaagaccctatctcaaaaaaaaaaaaaaaaatttaattaaagaaaattaaataaaatgcaaaactcaatttttccaacacaatagccacatttcaggtattcagtggcctcatgtggctagtggttactatactggacatcaaacacttccattattttagaaagttctattggacagtgtaactgtaataggttcactgcccaatgcatgcagcaagtcaatacactaagccactgagttgcagcagagaaacaggtttaattgtagggaagagacaggaggaaacctcaaatccatctcccagaggagtctggggctaggatttttaagggttttgcagtgggctgaagtgtggagattgttgattggtggaaaagagcaggatggagtcatgggacagggagataaagaagctgtgttctcttgctgattcagttcctctgtttggggtctttaaactggttggcatcagctattctgctggaattcaggatctgtttaagcaactcttaaacaaaagcctatgattctaatgtcagaaatcctatctgtaggaacaacgaggttgcaaatggtcagtatccagtgttacctgacttttagttgcaaggaagtgggtcaaagttagcctgattaatgctgaattgtaactatatttctgtccagaattcttcctaccctggtgaggctggcttcaacaacactggtcaaaagcagtggttttcatacatgagtgtcacatcagagtcatctggaaagtgtgttaaaatacaggttgctgggttccatcctcaattcagcaggtctgagcagggcctgagatcatgcatttctttttttttgtttgttattatactttaagttctagggtacgtgtgcacaatgtgcaggtttgttacctatgtatacatgtgccatgttggtgtgctgcacccactaactcgtcatttacattaggtgggaggaataacattaggagatcatgcatttctaatgagttcccaggtgatgctgacgctgctagtctgggccacaccctttgagaaccactctctgaaacaggacttctcagtcatggtgtgagggaaaggggagttgtttggagcatgtgaaaagccttatttatatgccccagttaagcccaattgggatttggactcagcctctttccaggattggcagttgttggcagatgtacaggagtgcttttggcttttctggttaaaagaggtgaaaggtggggctaattcagagtatggagatcagaggggtgaatcatggagcaaaaagggggccttatctgcttcttcatccattctctctgtcatcctggagctcagcttttggggcctgatagggagaaagacgagacagaagctttcagaactgagaagtcagaattcactggctttgttcctcactaataccttgacaactttctccctaaggcagtggatgactcacgtctagctgcatggtctggggggaggagcctcagggtacaagtgacagaattcaatgaagtgcaaagtgggagaaacaggcacttcaaacctcaacgtattaccttgctacaagtgtgcctttaactcactgtttgagtcacagaaggaaacagcatagggcttgctctcagggagcccgagtatagcatctgctgatggccagggtcactggaatatttgcctctgtctgggcagagtttagaataacaggcagaggcatagggtgggggctgtgccggaactccgtctatctcagctgtgtacccttttatagatggtcatcggatttgtatttgcatctcagtgtagtcagacattcttccagaacactccagcagtgcttctgtgcctgctggaaaatagctgcagctctctcctgaggcagctcttcccacagtcccagctgctcccctgggatcctccttggacctccccatagcctggcaagtaaagttagcacctgggcatatcagggggcctctaggaccctgttccagtactgagcacagcatcagtactggttagcttgtgcttgggctgtgccatttggaagtattttgaagatgcacatgcacgtgtgtgtgtgtctgtgtgtctacggtggtgaagaatggagggatgtgggatggggcagattcagtagatgccttgagatatggatagtttggtaaaattatgataataagaaaatggaaaggatgccagtttccttccagctagttaagacccattactttactcattgacccacctaacccatccatccatccacccatgcattcatctctccatccatccatccatccatccatccatccatccaatccatacattcatccatctaatccatccatccatccacacatgcattcatctctccatccatccatccatccatccatccatccagttcatacatttcatccatacattcattcatctgtctacccatcaatctatggggatcctgtagagtcgactgcagcaggagctttgggccacccnnnnnnnnnnnnnnnnnnnnttgtggtcttgttctttgtctgcttgtttcgtttttcttgtgtctgtgtttttgtctctgttgctggtgttcttttcgtttgtgtcgtgcgctttgttttttctttgttctgtcttgttgtgtcttgtgtcctcgctttgtcttgtgtgtttttttttggttgtttttcttgtgttctgtcttttgtgtttgttctttctgttgtgttggtcggcggcttgttttttttctcttccttccttccattccatgtccattccattcctatgttcatacattcatccatacattcattcatctgtctaacccatccatccatccactcagccaactcatccatccatgtaatcatatatccgtttaggataaatgtatccagcactctcttttagtgcttctgtgtgactgaggatgtttgacaatgaaaggaggaagcattcatctgctgggaccccttctaacagatgttttcttctcccttcatccctgaacaacagtaggagaaacaggaaacttgtcttcaaatggtagcccttttccctgactgtctgaggatcatggtctgagaatgtgcctctcagtttttaaaaatccttgaattccatgattcagtgatgtagttaatgtagacagggctcttctatcaaagcagggagcctattgaagatatgagaaaatatgcactgtttctctagagaagggaagtaaacccgccttcctcagagctgggaaggcttttgtcccaagcttctgaaaattaaacccatcacttaacgttctcactgagcagattgcggggcttctggccctatgctgcttgggttgtgcagagctgccgacagacagttttgattgaatgtccaaattaagctgccaagcagcgactctgcagctccagggactccatgttagtatttatgtcacatctttagaaataatcacattgcaaagcagcacccagagccatgtctgcagccgctgcagcgtgggagagggggctgttgagcacctcctgcctccatgcttcatgctgcatttactcagcacccaagcaagggtggggccccatggcacgccatcctggttcctgtcccgaggatatgagtgaggaattggtaaacctcgtctgtccttcttgttttcacttaacttgaggcaggaggtggtctccaaacaagaagtaaagctaacttattggatgcctgactcccaaaccatctgtcctaggcagacagaaagaccctcagggccaacctgaggggaacagatgtttatggggggcaggtttactcttgtttttccaagctgggctgaagagctcctcttccatctgcatcaagccctgaaaactctgccgtgcatgagtaaagtagcaagtgctgcatcccccagtgagatccagtggtgacattgtccacaccactggggaatgctagttattaagagactgggcttgtgagagctcaaaggtggactaacccagatcttccctgtcgagggaaatggtctctagacttgtggggttgtggttgtgtggagtcagagtaagtgtggagcaacgctgggaactgtaggaccctgaatgaccagggaaaccgctgtagaaaatagttgacactaaactgggtttagggggtcataaaacctccaagatttcaaagcttctgggtcccaggaggactcagttactgagcacaaaagttgcatggttttggtgtcaggcctctgagcccaagctaagccatcatatcccctgtgacctgcacgtatacatccagatggcctgaagcaacggaagatccacaaaagaagtgaaaatagccttaactaatgacgttccaccattgtgatttgttcctgccccaccctaactgatacgatatattctcccccgcccttaagaaggtactttgtacacctatcccaaacctataagaactaatgataatcccatcatcctttgctgactctcttttcggactcagcctgcctgcacccaggtgaaataaacagccttgctgctcccacaaagcctgtttggtggtctcttcacacggacacacgtgacatttggcagtgttgcaaaaccctcagaagtccgagtatcagctggactgaaccttggggcacccgcgttgtgtctagttccagtttgttaagaattaggtgcacaagaccagccccccttttacacaatgatttctttctctcagatttagagtaacatttttttttctaactaaaaatgtaattaatgctcaactgagaccatatattgaatgtctccttcttccaaattcccactgaagtgacaaagagattaaaaatggaaaaaaattgatcagggtgacaaaccagaaaaatggtatcaatcagatgccagaatctttggggaatttttctaagatacaattcagacaatccaagctgattttgtgttctcttttccaacatctaagcctcttatacaatacttttaaaaaatgtaattgcgttgattggtactttcagaacaatgttaaattatgatagtgatggtgggcattcttaatttgattgtggccttaatagatatgcctctagagttttacccgtaagcataatgaaggctgttggtatatttattacgtcaagaaaagcattcatttatttctatttttccaagtgttaaaaggacgaatggttattgaattttgtcagtcgcctttttcgtcattttttaagataattatatagtttttctcctttgacctagttttatagtgaatcatattattaatagattttctaaaattatgaaagatttttgtttgaagagtgtgcgatcggtttctagcttttgaaagatcactttggtgggggagtgaaggaagggctcaatagaagaccacaggcaggaaaccaatgaggaggatcttaatttcacccagagaggaaaagtgagtggccagggagcaatcatatgagcagctgctgtttatgaatcactcatcacctgcccagcacaataccaggattcaaatataacttaataatcacagtaattctatggcacacttattattgttcagatggcagtgatatgaatagtagggactcaggtacacaaaatgagaaagaggcagatcaaacagcacggggttgtagattgcaccaaagggaggagaccagaatgatttctagattcttactggggcagttgggtggatagttcaacactcactaagactggcattgaaagacagggaggagacatggtggtgtcgggggagcaggaggataatgagcgttgttggacatgttgagtttagcgtacatatgggacatccagtacaagataaccagtggacagttgtacatacagttgtaaaggtcagtaaagaggtgtgggtgggagttgtcagtatttaggtagaagtaaaatcataagagtagagcccctggaaaaatacggaaactaacaaacaaacttccgaataatccatggtttagttcaaagaagaagtctcaagggaaataagaaaatattttgaattgaaagaaaataaaagtataacacatgatactttgtggaatccagattaaaaagtgcttaaaaggaaatttatattggtaaattctaccaacacttaaagatgaaataatactgattctcctaaaaagtagatgagaagggaacatttttcaacctattttatgaggctagcattaccctcataccaaaaccagacaaaaatagtacaagaaaactacaagcaaatatctcaaatattttcttccagttcgtcatttgtgttttgcagaacaaatgtttttaaactttaataaagtacaatttatcatttttttcttttataggtcatgtttttagtgtcatgtgtaagaactctttgtaaacataaatataaaaatcttcatagaaatattagcaaattaaattcagcaatatataaatgaaaaatacactccgtccaaatgagttttatcctgagaatgcaagctggcttaataataaaaaaaaaaatcaaccaatgtaatttaccatattaataatctaaagaaagaaaaaaaattaacatatcaattgatgcagaaaaaattggacaaaactcaatattcatttatgatgaaagttctcagcacactagaaatagaagggaactttcttgatccaataagaagtatctaccaaaaacctgtaacatacttaatgatgaaaaactgcatgctttctcattaagctatgaaacaaaactaaaatgttcatcctccccagtcctattcaacatcatgtcataaccagcacagtaagataaaaaaaatttttaaaggcatgtggggctcggctcggtggctcatgcctgtaatcccagcactttgggagcctgaggtgggtggatcatctgaggtcaggagttcgagaccaacctggccaacatggtgaaacccccacatctactaaaaatacaaaaattagtcgggcgtggtggcagatgcctgtagtctcacctacttgggagtaggcaggagaattgcttgaacctgggaggcagaggttgcagtgagctgagattgcaccactgcactccagcctgggtgacagagcaagactctgtctcaaaaaagtaataataaaataaaaaataaaaaccatatggaatggaaaggaaaaaaagaaaaattgtttctatacacagaaaacagtattgtttatgtagaaaatccacaggaatctaccaagaaattactagaaataatgagtgagtttagctgggttgcagcatacaagtcaacacacaaaaatcaattgtatttctatatattaacaactagaaaccaaaaatttaaaaaatactacttacagcagctgcaaaacaaaggaaatatttaggtataaatctaacaacacatgtctagaatctatatgctaaaaattccaaaacactgaaagaaatcaaagaatacctaaataaatgaagagataacccatgttcatggattgaaagactcagcagagtgaagatagcaagtcttacgattgatttgtaggcttaatgaaattcaagtcaaaatcccagcaggattttttgtatgtttggacacagtgattctaaaacttgtatagaagggcagtgaatccagaatggccaaaacaattcttaagatgaagaataaagttggaagaattactgtacccaatcttaagacttactatataaagcttcagtaatcaaatgtgatattggtgacaggatagatacacaagccattggaacacagtagagaatccagaaatagacccacacaaatacggcctattgattttcaacaaaagtgcgaaaacaatgaaatggaaaaaggacggtctttcaacaaatgatgttggaatgattagacattcatatgaaaacaaaatgaaccttgacctccatctcacaccttttgcaagaattaactcaaaatgggtcatggagcaaaatataaaggtataaaatttcagaaaacacaggagaaaatctttatgacctgtagttatacaaagagttcttagacgtgacacttaaaaacgtgacccataaaagaaaaaaaaaaagtggtaaattgtactttattaaagtttaaaaacttttattttgcaagaaacaaactataaactggaagaaaatatttgcaaatcacatatctgacaaaggacttgtatccaactcattgtatcagaactctcagactcatttgtatgaagccagccttacttaaaatgtaatctaaaaacctgaacaaacactttaccaaataatacaaggatggccaatacattcatggaaagatattcaatatcactagaaattacagaaatgcaaattaaaaccacaatgagataccattgcacacttactagaatggctaaaataatgatgataatgataataaatactgtcaatatggtgtgctaatgagtatgcagaacaagaggaactctcattcatcactgtgggaatgcaaaatggtacagctgctccgggaaagtgtggcagcttcttataaagctaaacaaacgcatataactgaatgatcccactcctagttatttatcttaaagaagtgaaactttatgctcacacaagaacccgtgagtatatcagctctatttgtaatcactaaaatttgaagaccactgaaatattctttaacagttgaatagataaaccttgatacatccatgcaataaaatactactctgcaataaaaaagaattaactgttcatatacacaacaacatggatgaccctcaaaggccctttgccgagaaagagaaaccaatctcaaaaggttttcttgctgtatgattccatttaggtattattcttgaaaagataaaactgtagtgatgagaaacagatcggtggttgccaggggctgaggatgagaagaggatgtgactatagaggagaagtatgaggaatttttccgaggtgatagaactcttctgtattctgattgtgtgatggttacgtgaatctatacatgcattaaaatgtataaattttttcacaaaactgtgcaccaaaaagtcaattttactgcatgtaattaaacacataaaataaatgttataggcagaaaataagctgataaaagacacaagtacacacagagagagagaagagagagaaaagaaggcaatagtccaagatgaagagggagatggataagaggaatgcagaagaaagaaggttgtcatgttatgatactaaaaagtaatttaaaacagtagactaaatcaaagtgtgtagaagcagtagatagaggagtgcctactgcagaaaatgtaataagtaatatggaaacaagcttaaggagtgctccaatggggatggcaggggaaagggacaaataaataaatataaccactaaataaatgacagatgtagagaacaaatagcatttatccatgggtaaatgagtatcagatactcctagagaaaagaccagagcaaatggaaaagcatctatactgtattcaaagtagagttcaagacaaatatataatatactatataaaatgtgtcttttatttatggtaagtaaagtctggggacaaaaagtaatcatgaacctagggccaaaatgcataaagcaaaaacttgaaatgaaaggagtaatttacagaaataccataatagaagggctttaaaaacacactttgtcagtcttggacagataaaagcggttaagaaaatggatatagataatttaaataatataattagagtgaatataaaatacctctctatcttgaatcctgaacccttcaataaaagaattacattttttccctagtattcacaaaattagtgatatattaacttgttaaggaaacctcattaaattccctccaaaatgcccccagaaattgctcagcccacattttccgataaaaataaaacagaactagaaattaatgacaaaaacatataataccaaagatcaatggatgagtgagatggaggtaggaatcagatgggagcctcaagaattgaaatcttgaaattgcttctgtaaggaatgggaaattaactagggacacccaataggtttgacaagcagtgtgcgggactttgctgtggttggagatcatgggtatatagtggcatgaagcccctatgtgtgacactttcccctggggacactgtctagagcaaatttcactcatggttgagggtatgcacacaggatgttgaagagacaggaaggtaaggacatttaagccactggtcagaagcgattgaatggcttttccatatgggaagtggtagggaggaagtaaaaccgtagcaatgcactgatggaccaggggaaaggaaacagttgaggaactggagggtttgatgaaatgaaaaaaaaaaaaaaagccaggtaaagggagtagagacataaaaggataaactaccactggagagtttagaggctatgccatatcaggtgaaactccaaatgcctggactggagtggagaggaggtcataagaagaatggatgatacgtttgacttcacgtcgtctattattctcagacctcctccaagattcatttgtatgaaaatcacattggagggatactcttttagccctggaatttatcttgattgttacataatttggtctaaattctctgaaaggagaaaggaaatcaacatttgttgagcctctgccatgtgccttacattccactttgacactgttatcctctatcattagggtagtcatataatttattgttaaaatttggactctcttaagagtgagaggacaacagttctaaattgaggttgctctgggaaaactgggatggatggtcacccccactattatccaagagcccatttgagttgtctgtgtaggtttatgagaatttgggggtggggagacaaaggctcagagaagccatttgagtgagatcacccagttagtgagagtcatggcagaggtagaattgacaaccgtgtctgcctgactctgaggtctagccattgctaacttagttcctgattcaccacgctagctctccaccattgtttcactagctgtggcttgacaggctctcttcttgacagacaccatgacagtcccagctggaagtctgtctcaacacagataattagatgtgtgataactgtaccactgccagcaatgatgggaagccagctgttctaggagcctttgggaccacgatgtgctcgggaggactttgatgctggatgtgggctgcccaaagaccccacgtttgctggttttgtaatcagagcctatcaggtgaagattatacagcatggccagttacagaggctgggaaggggattctgagggatttcagggctcataaaagccacagcatcagagaaccttggggtcagaaacccccagggttagaagaagtaataagtaaacaggaatcgatgggacacaaatctagattgtagagcaaagggctaaagaagcttccaacttgggaaggtatggcagggcaggggggttcaagcaaaggaccaggtaaactgtcagccaccaacagataactgaaacaggagaggggcagggcaggacagtgaaaataggttgatggatctgaaatgattgacctgtttagtctctccctccaaccctggttagggcatgtgctgaggatgtccagctgacctcaatgagcttatcctgggtctgtgtgttattcaccacggagctcattttctgggttctatgatgcaaaccaaaagtttttaagtatcaccctgcggatccaattgccctataaactctttggaggaataggatggggtctctgaaagccagggcaatagattcttggaaactgtaaaagcacaactgaatttgtaaattgttttaataacacaattaatacaagaatacattctctttgtcagaaatttaaaatgtgatggataaagctaaaatctttattcacaaccctcaaatcaggttcctctacctgttcctcagaggtggacattattttaaatcaattttgggtatatcttttcagactcttttctatatatttacattcatatatgaccttgtagaaaatgcattttactgtacctttcttttaaatatttggagggcctttaaaatttttttattctgacataatctcaaaatgacagaaaattgcaataacagtaaaagaaatttctgtatacactttacctgatgtactaattgtttatattttgctccatttggtttagcattttctctactaatgtatttttatatgtgtgcacattttttttctgatccatctgagagtaagttggggtcatggtttccacttatcctgaaatacttcagttgtatttcccaagaacaaaaatattcttagtacatttattcaaatgaggaaatgcaacattgacccaatgctattatctgacggttcagctccagatttcactaattgaaccactaatgccttcacgcttctttcttaaacaaagaggcattatattgccctcatcttcttttttcaacgtgcttcatcttgcttttttcaacacgtttctgcatatagataacccaatgttatcggcatgggcaaagtgcgtcacagtatgaatgcgccatatattatttactgtttcccccattggtgggcactcaggttatttcctacttttataattgcacacatcctcaggctgaatattagtgggtattactttggattaatgttcttttatttttccttaataaatccttcactggaatgaattactgttttgaggacacacagtgaggacaaagcaagactcacaatattgaggaaagttccttcaaaaggagttaaataagagatgctcctgattcacataatgtgggatcgggatatgaaagcagcacaattattctgagttttctgacagataattgtatcttcttagaaagaaaaaacaattaaggaacttcttggtgaagaacaattcttggaaaaatagttaacatgcatgctatctttttatggattcagtgctgtcttagagaacttggaccagaatgcagaggcctcgcttgctccaaagacccttagacagaaacaggcagacctcaccctgcacccagagccccatgcccacggcaagcagtgttctctggaccaggacacgcttctcctgtactctttgcaaacttccaccagtggggacgtttgctatttctgctctgtgtgaagcatttggtaccatctgggctggctgagtttcaacaaagatagtaaagaaacatttatcaagaaaaatcaaagtcggtctcgccaagtgtggtctagagagatttgcttccgcgatacatatgcggctctcttgctgctgggaaacacgactcaactttgaaacacttcaggagggacagccctttggatcttagcctgcagctactgtcaactgctcatgatagatggttttagtagccagagctcttggagatgtgaatgccagcagtctcaggatgcattccacagcattccgttgcacagaaagttttggcccctttggtagagaataagctcaaaaggacaaaagtagaagaaaggacctataaaggtgagggaagagtcatgcctcagtgagtaatgtttggctctgcaatgattagattcccaagaaaaggtcattcttggctgcacacagtggctcacacctgtaatcccagcactttgggaggccgaagcgggaggatcactcgtggccaggagtttgacaccagcctgggtaacatagtgagactccatctctacaaaaattttttaaaagttagctggatgtagtggcacatgcctgtagtcccagctattcagggtgctgaggtggtagcatcgcttgatcctgggagatcaaggctgcagtgagccgtgatcgcgccaccgcactccagcgagaccctgtgtcaaaaaaaaaaaaaaaaaaaaattgctcttaaaccacgagtcttgagattgacagcttcaaaatacaacactcttgtccagcaaagagcactctaaaagagctgtaaattccttaagcttatgatagaagatctttttccagtgactacccttgtggtgtcagttcataagactggggcggaggagggggagtggccttgccagggagaagaaagatgagctgtttcctcttgcctctgtgttaccaatcaaccagacagacaagcttctggcgcatctgagtgtctcaatcctgtgtgtgtgcagctcactatgtgatagatgtgtcactccaagatcccagcctagaaactggtacatgttattttccttggaaggctcaagaaatgaaagtaacagttggatattatattctatggggaaaatgcatgggtattttgagaaattattattctccagaacaatgttacttaatgtgtgtcttatagactggcagcatcagcatcacatggaaatgttttagaaaagcatatggacaggtttcactgcagacttagggaatcagaatctatctgtgggggtgggtgccagatacatgtgtctcatgagtcctctgagtaatttttatgcacactaaggtttaagaagctctcctgtggaagggttcgagtaaacatcgaatgcattgttaagaagaaaaccacaaatggttccatttgatgtcagtacgtgtggaaatggttaactcttcataataaaaatagacaaacaggcaaggcatggtggctcacacttgtaatcctagcactttgggagaccaaggctggaggatcatttgcatccaggagtttgaaaccagtctgggcaacatagagagacccccacctctacaaaaatttttttaaaaattagttaggcataggttggcaagcacctgtagtcccagctacttggaaggctgagttgggaggatcacttgagcccgggaggtcgaggctgcagtgaaccatgatcatgccactgcactccagcctgggtgacagagtgagaccttgtctctctctctctctctctcacacacacacacacaacaaaaacgtagtgaaagagggcattgcatatgaataagaataataatgaaatagcagtaatatatagcagttaacatttattgagtattttttaagttccaggttctgtgctaaacatgtatattctttatccaattttactcttgtaacaacctattttattgatcaagaaattgaggttcatatgtgtgaagtaactgcttggtaagatgcggaccctgggatcttatagccctgtgtccatgacactatatggtctgtcttggggacaagattaacattttattttgtcccctatatccccagggcctagcagaatgcttagcacttagtagggacttgcttgttgaacttaactgatcaaggtcaacatcttgcttttggtgtaaaaatgagatgcagcttgcaagctgagatgggagatgaattcagcctgtggaaaaatagaagacactgccatgttgctggagtgcagaaaaaatgtcagcacagaataagttacagcttgatcctggtagccgattcaatgcttctcccatctcatttattcggtctcaaccccttactagctgtatcattttagggaagtcagtcttatttattttccagcaatggtcagctgtttgagtgtaggaaaaggacagagtaagaaaggacaggtatttgaatttaagtagggctggggtcatgtgagacaagtaaaataaaaagaaagaggggcaagggagttgagggtctttccaaaggagtagctaaaatgcaccataaaattgaatctggatatgaatggagtaaaagcaagagggaatagggagatcaagagaatgtgttgggttcgagggactgattggtggagaatggactgacgaataggggaagatttattgcagtagaataatagaactaatgaattggaaaaatagaaattggtgtaagatagtagggtacttgaaactgagattgagaaagtggtataatttctgggataataggctccagagcgtgaccatggtaggagataactatgattgggggtgagcaaaggttgcaggaagtgagggggtgctttctctcctactttccaatattctttcttctaatctgtttttcttgttatcttgagtttacaaaatttctggttttatttatgctgtggatatttttccagccttttccctatgggctgtctgggtgcaggttatgggtgatacatgggtaataggtgcatcttggtttagagggtaactctttatttcttactgcacttatggaacacgagaaaaaaaagtattaaataatggctatggtaatggatatctttgtcttattccttactttaatggaattgcatttatcatgaaccatggtgctgttatttcagatagcctttatcctgttaaaattctctgctgtttctagataactacaatgatcttatggttttcttctttgatctataaatatgatgaatatattgaaaatagatttcctaagattgaaccatctttgcattcctgataggagtcattatgtattcaccttttagcagatagttagagtcgatttggattgaatgtattactgtggattgttctactgtaagtgagatgattgacattgtatccttaagagctgtgcaattctcattttctagtctgcttccattgactacctgcattactggtttctgaattgattcctaattaactacttcctgtttctccaagctgatgatttagtctccctcatcctttctatagccagttgcatcttcactgctgattccctgcctccttttctcctgtaagttcatcttttttttttgacggagtctcactctgtcgcccaggctggagtgcagtggcatgatcttggctcactgcaagctctgcctcctgggttcacgccattctcctgcctgggcctcccaagtaggtgggaccacaggcacctgccaccatgcctggctaatttttttgtattgttagtagagacagggtttcaccatgttagccttatagcctctttacctgggtgttctggagtcagggtggagctgagctctaatgctgctgacattgttccagccttctctctatgggctgtctgggtgctggttatgggtgatacatggataataggtgtaccttggtttagagggtaattcttcctttctttagctttttctttttgaatggaggtaaaattaacgtaacataaaattaaccattaactgtttttaaacgtacaattcagtgacatttatagaatattcacagtgttggacaaccatcatctctatctagttctcagaaattttcatcacctctaaaagaaaccctgtactcattaagcagtcactccccatttccctttccctccagcctctggcaactattaatagtagtctactttctgtctctatggatttacctgtttgggatgtttcatgtaaatggaatcatacaatatgtgaccttttgtgttggggtacacaaatgttcatagcagcagtattcacaacagccaaaaagtggaaacaacccaactatgcatcaactgctgaatggataaacaaaatgtgggatatctatacaatggaatattattcagtcatgcaaaaaaatgaagtgctgatacatgctataatgtggtgaactttgaaaacgttatgctaaatgaaagaagccagcctttcctgtgggctttgtggaaaataagcttagaaaacttacagttaatcttggtatgggaagagcagtgtaaaagtcagaaatccatttttaaccaacacagaccagagttgacatcttatcagcccatctcattttgtgcactgcttcagctatggatgttaataaaattaaatttctcactaaacaagtgtgatgccaaagaaccttccacaagttctgcagctgtcactgcttggtgcttaaacatgttggacagtattaatgcaaaaactgctttttctttttcagtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagattgtaagtggaaatgactgcagtgagcatgggtggtggaggttgggttatgtgccacctgagatcagggagttcctcctcccttagctcctgtttccttccttccctacctccctccttttctgtcttctccatccctcactcctatctttccctcccttcttttccatctgcaattttgtattgtgagccaagaaaaaaaattagagctatttttttaatagagatgagaatgcctgtggtgtgggggagtgggtaggacaggaaatggtgtgatgtgttgctaagtgaaggcaagttgtgggagaaatgatggggctcagcaaataggggaacataacctacagggtgtggtgacagcctctctagagttgggtttatggatgatgcttggcctgcagccttctgggacatctccaccagcctcccttgagggtcttccctggccagggctccaagaatctgggagtctctttcttgtacatctaggcatcaggagttggttataacagccaattcactgagcatatatgatgtgtgacaaacactgggttaagcgatccgacttcatcggctcattttattcccaatgtagcaatagggcttatagaggttaaagagtatgcccaaagtcccatagcaaatatggggtggagtgggattcagcttctggcagtctgactttagcggtcatacttttttagccaccagctagaagcacagttccttgtcctgtctcctcttccctctctcagggcaaagctgggccccttctcagcctcagtcaaggacatgtctcagaacagacaatttccccaggatttttctccatgcatttcctcagcctcattctcaacccacctgtgtgcagatatacacatgtacacacccaattatgcaattgatatctgtatttcttataggcaataggaattcctgaatatcctgaaccctattaagacataagataacaaaagtagttagaactgttcttgtcatagccaatctaagacctctgcctgtttaagccacaggctgtcaaacagaaaaagctctcactccctggagagctagcctgggatggaaactgaatatgtttctttcagcagcttgtaatctttaaaactttctacctccaggtcttgtcctcttgtacatttattctgcttgagaaattactacaacctccactgatgtcttttctttttctctatgcagtcagctgaaagaatcggacaaagacagaagactgtcagtagagatttgggattgggatttgaccagcaggaatgacttcatgggatctttgtcctttgggatttctgaacttcagaaagccagtgttgatggctggtaagtaagattttgccttgaaagctaccatacagcttgctccatcaaacacggggtcaagtatgttttcctttttctccaaaaattgaaatactaaaacagagtcccaaagtgaagtctggttgattggatctgccttgcagatatgttttgtttggtccttgtactaaaaacaaaaaagaaagaggccaggcctcgtgtctgacacctgtcatcccagcactctgggaggccgaggcaggtagatcacttgagctcaggagtttaagaccagtctgggcaacatggtgaaaccccatctctatcaaaaacatgaaaaattagctgggcatggtggtgtgtgcctgtagttccagctactcaggaggctgagatgggaggatcacttgaaccctggaggcagaggttgcagtgagcaaggtggtcagagattgagccactgcactccagcctgggtgacagagtgataaaaaagaaagagagagagagagaaggaatgaaggaacgcggacgggaggaaccgaacggaaggaaggaacggacaggaacggaacgcgaaccgacccgaacggaagaaaaagggaaagggaaggaaggaaacgaagaaaaagggaaagggaaaggaagaagaaagaaagaagaaagaaagagggaaagcaggaaggaaggaagggaggaagggaaggagggacagaaggagggagggagggaattagttctagtattttaaaaatctggggctagaaggcaacaattgagaacagttgaatagttaatgccccctttagacaggacatggattttctatttgtcaccgtcctcaccactccctattttattacatctgggccaatttactaaactacatgatgagactgtaactgcccagtggcttctttgtgcctgctgcccagacagagccgatttatcaagatgggagaattgcaatagggaaagagttttacacacatagagccagctaaatgggagaacagagtttttttatgactcaaatcagcctccctgaaaatttggaagctagggcttttcaaagatagtttggcaaggagtagggtggctagggaatgggtgctgctgactggttggggatgcagtaataggggtgtgaaaaatggtcctcgtgcactgagtccacttctgggtggggccacaggactagttggcaggtccaggtggggcagtctggttgtcaggaaggcaaaagcctgaaaagacatctcaaaaggccaatctcaagttctacagtagtgatgttatctgtaggagtaacttaggaagttggaagtgttgtgagctctgggataaaggctgataataatccatgtctacatcttagcagaattcaggctcctttcattctcctaacttggcaatatttcattagttttacaaaggcagtttagttttgggaaagggctgtcataatttaaaatatacaacaaatttctttcaaagttaggttggcggtctggtcggggtggagccattggttacgagaaatgcaaaaaaacctgaagagacatctcaaaaggccagtctacaatagtgatcttatctgcgggggtcattgggaaagttgcaaatcttgtgacctctggaataatggctggtaatcctttatgtctacaccttagcagaattcaggctcctctcatcctcctaacctcatggtccctcattagctttatgaaggtagtttagttttgggcaagggctattatcatttaaaatgtacactaggccgggcgcagtggctcacccctgtattcccagcactttgggaggccgaggtgggtggatcacgagatcgggagatcgagaccatcctggccaacatggtgaaaccctgtctgtactaaaaatacaaaaattagttgggtgtgctggcatgtgaggatcacttgaaccagggaggcggaggttgcagtgagccgagatcatgccactgcactccagcctgggtgacagagcaagactccatctcaaaataaaatgaaataaaataaaataaacactaaatttgtcacaaagttaacttggcccgagcccaggaaagcataagggcagtttggaggttaaaggcaagctgggggttggttagatcaaatctctttcactgacgtcatcattttctccctgttacaatttctgcaaagacagttccatgactggctccatggacactagagtggcttgtacacttcacctgaaagatatgagcaacccactgtcagatggtgtctgagaagctaccgcttccttgggagtccttagcaagtctggccacagatcatagatgtactggggtgttgttttcatagtcagctgctgtgtctcctttgtcctgaagattttattttgctcccttcctatggcaaaaaaaaaaaaatatatatatatatatatatatatatcctccaatgttaccaacagagaggctgggtaagcccccttggcaactgtttcacagttaactgagtcaaggagtcagaagaaatagcttaacctggcactataactttgggagaagtggcaattgggctgctattacttctttaagataaattgtctcatatctgaattgtctcattcaggaccttttcagcttcaagtgaaagaaaataaaaatcaaactggtttagcgagaaagagatgtgtcctttggaccacacacacatctttcctttccattgttcaccttatgacttccttgtcttggctccatgtttcatcttaggccttttttttttttttttttttttgagacggagtcttgctctgtcacccaggctggagtgcagtggcgtgatctcggctcactgcaacctctgcctcctgggttcaagcaattctcctgcctcagcctcccgagtagctgggactacaggtgcccgccaccacgcccagctaattttttgtaattttagtagagatggggtttcaccatgttagccaggatgatctcgatctcctgaccttgtgatctgcctgccttggcctcccaaagtgctgggattgcaggtgtgagcctccgtgcccagcctatcttaggcttttcttgaaacatatattgagtgtccactaggtgctggtcactagaaacacatggaggtataagacagacatgacttcatggagcttagcttatggcagagggtgggttggggagataaacattgaacaaggaattacgcaaatgacaaatcaatgacaacatgatggaagatgtgaagaagacaggagctgagagttttgaacccaaaagtatctgagacagatttcaatcagtttagaaagtttattttgccaaggttaaggatgtgccagtgacacagactcaggagatcctgatgacatgggcccaaggtggatggggtacaacttgcttttatacattttagggagacgtaagacatcaatcaatacatgtgagatttacattggctcaatctggaaaggcaggacaactaaaagtgggacggggaggtgcttccgggtcataggtagattttacaattttctgattggcaattggttgaatgagctgttatcaatagaaaggaatgtctgggttacataaggagttgtggagaccaaagttttatcatgaagatgaagcctccaggtagcaggcttcagagagactagatggtaattgtttcttatcagacttaaggtctgtgttgatgttaatgctggttggcttttcctgaattccaaaaggaaggggatataatgagacatcgtgtctgactctcccttctcatcatggcctgaaacagtttttcaggttaactttggaatgcccttggctgagagaaggggtccatttacatggctagggggcttagaattttattttggtttacagaatgtaccccaaaagagttgtgttaaagcacaattcacaaatggttaaaaacatagttctcataagatagataatgggcattaatgggcattggccaaagatttccttagctcactaaggagaaaagcagcaggatgaatgaatgattccacagaaggtttgataaactgatgttcgtgtagtcagtagaaaaagatatgctgaaataactttgctcagttaaatataaaactgactgatatacaggacaatagaatcataagctttggggttatctactagaatgaaacaaaaaaaagattttggccaggcatggcggctcacacctgtaatcccaacactttgggaggctgaggcgggcggatcacctgaggtcaggagtttgagacgagcctggccaacatagtgaaaccatgtctctactaaaaatacaaaaattagctgggcatggtggcaggtgcctgtattcccagctactcgggaggctgaggcagaagaatcgcttgaacccaggaggcagaggttgcagtgagctgagatggtgccacggcactccagcctgggcaaagatttcacctcagttttctaaaagttaacatgtatctttgcagactagggaggccatctggggctgacctgatggtgaataataaactaaacaaagtaatattactgtgaggaaagaaatagctaattagaaaatgctctagcatgacattaaaagttcacacggtcatctttttggttttctttttcccccaagctttggatatttttccctaacatgcaaatgacttgactttgcagggtgtacatcagttactcacagtggatgtttcattctcattttaaatcaaacttaaagaggttaaagagaaagaatgcatgatcctcagggggtatcagtgtgacaggaggaaacataataataataattataataacaatagctactactcattgactcttaatagatgccaggctctgggttgagcttttccagatgtcgtggagtcacaattttacacagcactgatcaggtgtgcagaaaaaataaagcttatttcttttctataatggacttagactttctcatgcacttttgtgagctcctggtgaccgaggagaagggactctatatgctgcatgtggtactttctgagcttcactgtttcacttttctgactggtcactgttaacagcaaaacccagctctgtaaaatattttaaagaagtttattctgagtcaatataagtgactgtggcctggggaaacacaaacccaagaagctttgaataagtggtcctgaggtggttagattacagtttggttttacatgttctggggaggcagaagttacaggcaaagacataaatcaatacatggagattatacattggtttgggcccaaaaggcaggatagctttaaatggggcttatgggttataggagattctttaatttgcagttggttagagtaagactttgctaaaacttggagttaacagaaagaaatattttatgttggctgggcgtggtggctcatgcctgcaatcccagcactttgggagaccgaggcaggtggatcatttgaagtcaggagttcgagaccagcctggccaacatggtgaaaccccgtctctactaaaaatgcaaaaaaattagcaagttgtggtggcacatgcctgtaatctcagctactctggaggctgaccaggagaattgcttgacgcaggaggcggaggttgcagtgagctgagatcccgccactgcacccagcctgggtgacagagtgagactccatctcaaaaaaaaaaaaaaaaaaagagtgtttaagttgaggatgctgtgcagcaagatggcttgcttatggtgcaacttcacctttgcctggcctggcgttagtcctgtttataatctgatattttattgccacaaagagtctgttttgtcagtcttatgatctctactttaacattcatgtcagtccattgttgtatataaactcccaaagaaaggaggcataacaagacgtgtccaatctcctttctctcatggctgataattctgtttttaaggtttttcttagatcctcttggccgaggagggggtctgttctgtcagtggggggccttaagattttatttttagcctacgttcctaaaccagcgcccactgaagtgggactggtcccacctagctttggggcatcattctggctttgtgctgaagatcctggcctgttgcttctccttgtgagttccctccatgcagcaccctctctgtcccactcataggccactgctgggcctggttcagggaggccaggaacctgcctgagtcctccccctgaggagtcttttctgctccttctgctgctgctggaatgatgttgcctggtgcatggataggtctctggccagcgttccagccgaggaggagggaaacccacctctccccaccacctgtcctttctccttcccaaggttctccaagccccaaagggaggggcttctcctacaatcacccaatgagttcatctagagctgattcactgagacggcaatattttagcagagaaagagtttaataaacacagtgccagccaagctgaaggatgggagtttattactcaaatcagcctcctccaaaattcaaagactagggtttttcaaggacagtttagtggtaagtgggggctagggaatggggaatgctgattggtgggttgagagtgaaatcatagggggtcaaagctgtcttctcatgttgagtcagttcctgggtgaggatcacaagaccaggtaagccagtttcgttgtatggattcccagtctgggttgcaccagctggtccatcagaatgcagggtctggaaaatatttcaaacaccaattttaggtctataatagtgattttatctataggagcaattggggagatcctgaatcttgtgacctctggctacatgtctctggagccagaattctaactttgtggctaatatgttagttttacaaaggcagttttagtccccaagcaaggagatggttagttttgggaaggagctgttatcgtctttgttttaaagttaaacgaatggccaggtgtggtggctcatatctgtaatccccgcactttgggagtgccaaggtgggaggattgcttcagttcgggagttagagaccagcttgggcaacaatgagatcctgtctcaacaaaaaatttagccaggcatggcggcatgcacctgtgctcccagctactcaggagcctgaggtgggaggatcacttgggcccaggaggttgaggctgcaatgagctgtgattgtgtcatcgcactccagcctaggcaatggagaaagaccctgtctcaaagtaaataaagaaacaaatacaaataaaaaatgaagttgaactgaaactaacttcttcccatagttagcttggcctaggcccaggaatggacaaggatagcttggagattagaagcagatggagttagttaggtccgatttcttacactgtcatagcttttctatgtcatatttctcttactgtcataatttttgcaaaagtggtttaactcccacacatgccatatccttcttcctgggctagtgcctgccttgtctactcccctaaggctgagagcagggaagaaaaaaacggcttaagaatagggatagtgtatcaggagtaagcccaaaatattactgcatttacacttagatgatcatttaattctccagttattctaggtttcatcatttccaaggctcagaatagttcagcagtgtgttagggatacacagcttgtaagcaacggtgctgggttcaggtccagatttctatgatgccagagcctaagcatatacaaattccattctgcctcctgatacagggttaggtggaaggctagagggtagacagctgggattttatttcggctttcctgactggatggatgctttgtgacctcaggtgagccacttcacctctctgtactacagctttcacagcagatatgccacccatcagattgattacaacaccccctgtcctccatccaccacttaggatagctgtgaagttgatgacataatagttggaagggaacttttccaaaataaaagccctctgcagatttttgcagataaaagtcctcctcagatttacggccaagacatttgcgatgctgtcttgactgtaaatggaccagatcctagacatttggattcttgcccctgggattctttgaacattatgtgatcttgagcaagtctcacaccctttctgaaactcagattcaccatttagaaggggatgggctccatcagctcttctgttgtgctgtaattgaagaccgtgtggcagaaacagcagatgcagctgtggaagctatcagatgtggtgcaccagccccaggccccctgtctgcctcttggccaactgccctgtatctgttgacaaatccgcctctttgtttctaattttgtttatttatactgtctcctttctttccccttcattttccagaggttcatctgttttatttacttatttattttcttcaaggaattaactctgggatttgtgtatcaattttgtttgttttctccttttctgtaggtttattttgtgtttggctttgactttcagttgaacattttactaatttattttttcttctttcgcctgactctgctctttaaaaataatgaatagcttttttgtttgtttgttttgagacggagttttgctctgatgcccaggctggagtgcagtggcacagtctctgcaggttcaagcgactctcctgactgagcctcttgagtagccaggattacaagtgcctgccaccacacccggctaatttttgtatttttagttgagacaaggtttcaccatgttggccaggctggtctcgaactcctgacctcaggtcatcctctcacttcggcctcccaaagtgttgggattacaggtgtgaaccaccgcacgtggccaaaaataatgaacaagcatttaagggaataaatgtttcctctaagttttgatatgctaacattctggcttttgctacttccttgagggcctgcagttgaggttttagtttcttttctaacatgctttaatttaggcattttttttaacccctagaattagatttttgtttaaatttttaatattaatgttaagttactgttttagtgctttcaagttagagaatatggcctgtgcacttttctttttccctcctgttttctttcctttctttcagcatagcttagtatttgttcaatgttgttaaaagttctgtggacttgcaagaaaaagattatattagctattcgtagagtatacttttttgtggagaaagaataaaccttttttcaacttttattttagattcacgggatacatgtacaaatttgttacctgggtatattgcatgatgctgaggtttggggtatgaatgattccgtcacccaggtactgagcatagtacccaacagttagtttttcaatccttgtcttcccctcccctctcccctctacagttcccagtgtctgttgttgtcatctttatgtccatgagtgtagggtatacatttattcattccaatgtattataaggtccagatcttttttttctgaggcggtgtttcactcttgttgcccaggctggagtgcaatgccgcgatcttggctcaccatagcctccgccttccgggttcaagctattctcctgcctcagcctcctgaatagctgggattacaggcatgtgccaccacgctcagctaattttgtatttttagtagagatggggtttctccatgttggtcaggctggtcatgaactcccgacctcaggtgatccgcccgcctcggcctcccaaagtgctgggattacagatgtgagacaccacgcccagctaaggtccagatcttttataccttcatattgtccttttgtttgcttgagctaaatgtgtagtgtttattaagtttcttcaggcaaaatgattcacaaacattctttttatttctaggggtttttgccttatctgtatatggcaatattattaaccacataactctacaagtcttattatattgacatgaagttatctttgttgcagctaatgcgttttctctataattttactttgttgctggcattcattcattcattcattgaatatacacagtgagcacctgctgtgctgaagagacactaatgagcaaaacagacaagaatccgtggcctcatggagttttctttttagttgaagaaaaataaacaacaattgtaaatgaacaaaaataagtagtaaaacatggcatgtttgaggctgataagtgtcatagagaaaagtaaacaagaaatggggacaaggaatcttggggagtggagatgttcagattttatagggaactcaggaaagaactcactgaaaaggtaacatagagcaaagatctaaagcaggtgaggagggagctgtgtggatatctagggagaggttgtcttaggcagagaggacggcaagctcaaaggccctggggcaggagtgcacccggcaagttggaagagcagtaaggagactcctgtagctggagctggatccatgaggggagagtggaggaggattaggtcttggaggatatggggagagggttggcggatcctgtcggccttgtcaggactttgtcttctactctgaagaacacggggagccaaggaattaatgagattgaactgacctttgcatatgtcctctagttgtggtgtggtcgatcccttttccctagtaggtcctttcccattcttttatgtctaatctttctaagtcctttggtcttgtgtaacaagcggcacgttgttggatttttttttttttttatttttgagacagagtctcactctatcgcccaggctggagtgcagtggcacgatctcagctcactgcaacctctgcctcctggattcaagtgatttttctgcctcagcctcccgagtagcagggattacaggcatgggccaccacacccatctaatttttgtgtttttagtagaggtgggccttcaccatgttggccaggctggtctcgaactcctgacctcatgatctgcccaccttggcctcccaaagtggtgctggggttacaggcgtgagccaccaagcctggcctttttttcttttttttttaaaattttactttaagctctgggatacatgaacagaaagtgcaggtttgttacataggtatacatatgccaggtggtttgctgcacctatcaacctgtcatctagatttcaagccccgcatgcattaggtatttgtcttaatgctctccctccccttgcccctcaccccctaacaggccccggtgtgtaatgttcccttccttgtgtccatgtgttctcattgttcaacttatgagtgagaacatgcagtgtttggttttctgtttctgtgttagtttgctgagaatgatggtttccagctttatccatgtccctgcaaaggacatgaactcatccttttttatggctgcatagtattccatggtgtatatatgccacattttctttatccagtctatcattgatgggcatttgggttggttccaagtctttgctattgtagctagtgctgcaataaacatacatgtgcatgtgtctttatagtaggatgatttataattctgaatctgaagatcttttttccacaggaaaatgttttaatgtttatagctataattgccatgtttcttatggtgtttctaaagttttctttttctttcctatttcattctttttttttcatctccttctaaacagataactattatcttaaatcagtgttatattactttttttaaaaaaaactttctgttattattaataatcacattttggtcttattacaaaaaaaaacaaaaaacaaaaaacaaaaaaactaatgctttggaatcagacttcccgggttagaatttctactgtaccacttcctagctgtgtacccttggcaagttacttcgcctctctgtgctgtgtttcctcatttggagataatagtcgtaattatgtcacaggattgttgcagtatcaaattagttaatataagtgaggtgcccaatgtctgctaaatagcactcagtaagtgttagtcattattgttaattgaataattattagaaaaatataagaaattggagaatttcagagaccccagattcccagtgcccataaccactattgaccctatagagagagagagtgaagcaaaaaatgaaatcttactgtgcatactatttggtaccctgcatttttcacctaaaaataatccgcaataaacataattgtggcaaaacttttgtgcccagctttaataatttcctaataaatttctaagcctggaattgatgactttaagcatatacacattattaaagggtttgccaaaatgtcctacaattttaaaaatcaatttacagtcttatcaatcttgtatgaaacttttcagtttattaacattaacatccagtgctataaatttcaaagatatgatacaaagattatacacatattgtattagaaattatgttgaacattttcatttgcatattgccatttgtttatatttatatatgactatgtccttttgcctttttcttattgacttgtaagaactttttatatgagaagaatattaatatgtctttcctgacatatgtatgttgcaacgttcctcctcctccttttcatgttgtaaattaattttggtaatatgcatttttcttatggtatataaagcattcggttcaactccaatctaatatgatagatatcaagccacttgccagaaacatttctcaagtttttcttttcattgactaattgttatctgaattatccatgctgtgttcactgtctcaaatgaattttttaattcagtgattatatttttcttccgaaagtagtctttcccactctcgtatttgttcccttttcacagatgcaccaacctcttgaatctcactgcaaatatgaattaggtagtttctagaatgttctctcttttggcagcagttgtatttcatgggagttactttgattctgcattgtttctttctatttaaatgactaaatttttcacacatcctattgtgcttatttgcctatccttatagaagggtgagcacagacatttctgtgtccttgttctaacatttcatatctggataaagggagacaggagtcttttgtattttttggaattctgttttgtcagatcaggagtcctgttcctgacatttgggcggggctacagtggagacaggtgcataacaggcacccctcaagccagatggagagcccatcttcctcacgttggttctgtgcatctcaaagtcagaaggggtcctgctcctctctgagggggcacacgtgtcctatttggaggcagtagtggcagcgtccttcactcactctgtggcgtactggccaccgtgaacacacgctgtggcaccatgcccctgcccgctgcgccaggcactgacatgtctcctcttgcatatgaatgggaatcggcaaccctcacccggtcattgatggtctcagccggggtcattattgggctctgttggggcaccttttatggatgacagctggtcaattcccctttatctgtattttcccaagtgtgagaccccaaatactctagatggttcacagtcagggcataaataatattgaattgtgccccaagaaagcaattattttgtcagtgttctttcagttcttcaaattatggcaaagagaaaatctcagaggtctctgatatatcgttaacactctaacacttgctcttcgctgatctcccattaaaaaggggcaggggcaggctttcgattgagagcctttagtaagcaacaccatctacttgcacgtgcataaccttgatttccttgatttccatttgtttatttttttttctttttttttttattggaacattaattaggttttattttcactttttgtttccacagtaacatgtatgggattaggttacagtgtttatttgtccccaatcttttatttatttttttttattattttttttaattgattgactttttattttttattttattttttttttaatttatttatttatttatttattttttattgataattcttgggtgtttctcacagagggggatttggcagggtcttaggacaatagtggagggaaggtcagcagctaaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcctgcctttctattccacaaagccgccattgtcatcctggcccgttctcaatgagctgttgggcacacctcccagacggggtggtggccgggcagaggggctcctcacttcccagtaggggcggccgggcagaggcgcccctcacttcccggatgggggggctggccgggcgggggactgacccccccacctccctcccggacggggcggctggccgggcggggggctgacccccccacctctctcccagatggggcggctggccgggcagaggggctcctcacttcccagtaggggcggccgggcagaggcgcccctcacctcccggacggggcggctggccgggcggggggctgacccccccacctccctccccgacggggcggctggccgggcagaggggctcctcgcttcccagtaagggcggccgggcagaggcgcccctcacctcccggacggggcggctggccgggcggggggctgacccccccacctccctcccggacggggcggctggtcgggcagaggggctcctnnnnnnnnnnnnnnnnnnnncggggggctgacccccccacctccctcccggatggggcggctggtggggcggggggctgacccccccacctccctcccggatggggtggctgccgggcggagacgctcctcacttcccagacggggcggctgccaggcggaggggctcctcacttctcagacggggcggctgggcagagatgctcctcacctcccagacggggttgcggccgggcagaggtgctcctcacatccccagacggggcggcggggcagaggcgctccccacatctcagacgatgggcggccgggcagagacgctcctcacttcctagatgtgatggcggccgggaagaggtgctcctcacttcctaggtgggatggcggccgggcggagacgctcctcactttccagactgggcagccaggcagaggggctcctcacatcccagatgatgggcggccaggcagagatgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgcgagcctgcaatcgcaggcactcggcaggctgagtcaggagaatcaggcagggaggttgcagtgagccgagatggcagcagtacagtccagcttcggctcagcatgagagggagaccgtggaaagagagggagagggagagcgtggggagagggagagggagagggagagggagaggagggagaggagggagaggagggagagggagagggagagggagagggagagagcgtccccaatcttttaagtctattttttttttcttgagacggtgtctcgctctgttgcccaggctggagtgcagtggagcaatctcggttcactgcaacctctgcctcccgggttcaagcgattctcctgtctcagcctcccgaatagctgggactacgggcgcgtgccaccatgcccacctaatttttttgtggttttagtacagatggggtttcaccatgttggccaggttgtctcgatctcctgacctggtgatctgcccaccttggtctaccaaagtactgggattacaggcataagccaccatgcccaaccttttttttttttttttttttttgagagacagggtcttgctttgtcacccaggctggagtgcagtggtgcaataatagctcactgcagccttgaccttctggactcaagcgattctcctacctcagccgctcaagtagctgggactactggcatgcgccaccatacctagctaaatttttttaatttttttgtagagacagggtctcgctatgttgcccaggctgatcttggactcctggcctcaggtgatcctccttcctcagcctctctaagtgctaggatgacagacatgagccaccacgacgacctgtttatctttttgtttgttttgttttgtttgtttttaacaattattttctatttgtaacaagtgatattgaatttccttccaaggaagaaataaaaagtgtcctttaaaattaaatttattattaaaaaagtaaaacagatatttcaacgctgatatacaaatctagcaaaatccacaaaggtagcatctgaatggataaagttaaagtttacccaaaatagctctgttttctttctattactttaatttgtaggaatccctggaagtccctgctgtgtggatagcacccttctcgatttccagcaaagatacagatgctctcttgtttttatatttcttttggtaatttccgtggaattttggaagaaaatttggaatattaaatgtggaggcgtagaggctcaaattgtcttctctgctttgaatcacctagcccatttttggaagctgcgtaagaagattcgtgaatggagagaaaacattgtgatgaaaattttaaactttggttaggaatgatctttgagagcgaggagttttggggtcttttttctttcccactgattcaaatgcttttagaatgtcccttttctttcctcacactcatctcatcctcttactagatgaaaaaatctttgtggtcaagaaacaaactgaagcccccatgtttattattatattagtagtagctgggcatggtgggatgtgcctataatctcagctacttgggatgctgaggcaggaggattgcttgagcccaggagttcaagactggcctgagcaacatagcaagaccctatctctgccagaaaagaaaaaaaagaaaaaaaaaacagccaggtgtggtgggatgtgcttttagtctcagctagttgaaagctgaggccggaggattgtttgagcccaggaggtcaaagctgcagtgagctatgattgtgctgctgcactccagccttggtgacagaacaaggccctgtctctaaaataataataatgacattagtcacagtaataataatcatgatgatgccactaattgaatacttgctgaatgccaagtgctgtgcttatcattttacatgcgtcattacatttcaatttcacaagaattctatgaaaaaggaatttgtattccaatttatagatgagaaaaacagacgcccagagaggctaaccagcctgtctaaggttatgagatgagatttgcacccagacatggtttgactccagggcttgtgcgcttaaccactaagggatgccgtttctcaaaaaggctgactacagcacattttgggaaaacttttgcagagaaaatagcatcatgaagtcaagtccatggtcacctaaatgcagttgagtgccaggatggcaaagtggcaccctatgcaccctatgtagggtgaaaggtagaaatgctggaagagcatgacaagagtgtatttacagtcaggcagtgggggttgcaatttgggaggatagggtgaaaagatcacttgaggtcaggaattcaagactagtctgagaaacatagccaactcccatctctacaaaaaaatttttttttgtttaattagctgggcatggtggcacatgcctatagtccccagctactcaggaagctgaggcaggaggatcgcttgaacccaggagctcgaggcttcagtgagctgtgattgcactattgcactccagcctgggtgacagagtgagaccctatctctaaaagcaacaacaacaataacaacaacaacaagaaatttacgatgagggatcttcatagcattctttcagaataagaaactacttaatggacaaaaagtaggtaaaaatatacagtaatttaacgatataactaagaaaactgtgtaagtgtgtatagagagagagtgagaactttgcctcctatgtacatgtgatatacattttttttctgctgtccatggaagagttacaaaaatacatagtgtacctggtagtgtaccatgcacactacccccacccaacatactgaaaaacaaaccaaaacaaaccaaaaaaccctcaacgtatattttttcaagtagagctttatataggcctccttttcatatgctgatcaataaaataataccgagtcgagtcatgaaatgtgtcccacccccttgtctcccttcaggtttaagttactgagccaggaggaaggcgagtacttcaatgtgcctgtgccaccagaaggaagtgaggccaatgaagaactgcggcagaaatttgaggtgaggtttcttttctttttctcttctttcttttttctctttcttttttccttctttcctcctgctccctcctctttctttctctttctctcttattcttttttctctccttccttacttccttcttcctctctcttttctttccttctttctcctttctttctttcttgcttacttgcttgctttctcgctttcttcctttctctcttgctttctcttgcttgctttctcgctttcttcctttctgtcttgctttctttcttgcttgctttctttaccccccttttctttgttttttccttccttccttcctgccttccttcctctctctttctctttccctctcattctttcttttctttctctctctgtccttcctttgtttctttctctctccttccttcttcctttcttccttccttcctttcctcccttccttctttccctccttcctccctccctcccccctttcctttctttcttcctccttcctctctcttttcattctttctcccctttctctctctcttcctctctcttgtctctctcttctttcttcatctcctttctttcatcagtgggaaccagttaggtttgctgctgtgctgattttcctgtttatggcatggtttctactaagacttttcatgactctgagcctttgcaaggttgttttatctcctagaaaactctgattaatccttcaagaccccaattaaatgcccttgccttatgaagttattcctgcttccctgtctgcattcaggcttagacatttcttcaaaagtgctcattcactgcccaccattttgatggtgacttggactggaatggtagtcatggtgaatgaaagaagtagacagagggccgggtgcggtggctcacacctgtaattccagcactttgggaagctgaagcaggcagatcacttgaagtcaggagttggacaccagcctggccaatatggttaaacccagtctctactaaaaatacaaaaaaattagctaggcatggtggtgcacgcctgtaataccagctactcggaaggctgaggcacaagaatttctctgggtggcagaggctgcagtgagccaagattgtgccactgcatgatcagtaatgctctgttgcccaggctgcagtgcaatggtgcgatctcggctcactgcagcctgggcaacagagcgagacttcatctcaaaaaaaaaaaaaataagtagacagagaagtgatatattttggaggctgagtcaactaggcttgctgatggatggaatctggattggctctattgacagaatgatgctatatagttaacgaatggaattgattgtgctaatgacttcatgaaataccctgggggtagatcttcccagagaatagttttatcaaatggaaagcccttggctgtgaccttgagttacattgctggctctgctcctacctgaaataaatccctttccttctacggggacaaataaacaccattttcagctacctaagagcagcaggtgtataggacacatccttgctttacaaagaaaatgtttgggggaagataggtttgaatacttacattatatgtgcattgagtgattttagtagtttcctgaggaaaagcacattattttgttcccacaaactcaatacactgagtctggtgggagatgatcaattctagataaaccatgatggcctactaactccccaaaaatgtatataatagcatagctaaaatgaaatgaatttttattattgttattcatcaaataatgacacacacaaataaaaaaaaaacgtgtaaagaccatgtaaagtcctgggaaagagaggtcaggtaccttgagaacatgtacaagagaaatgtcacgtagtttgagagaatggggaggtgtcaggaaggaaacagcaatggaagtttaccatgtaaaaagaggggaaaatgtattctgttctgcaaacagcatgtgcaaaggccctgtggttgggggttatatagcaacgatgtgagactgaaagaagaccagcctgggtagagcagagaaagccaaagagagtccaaggaaaggctgaggaagtaggcatgagtcacagtacgtagggctgtgctggccttgacaaggattttagcatttatcccaagagtatttatcccaaggacttgagcatttatccaaagagtatctatcccaaggattttagcatttatcccaagagcatttatccaagagcatttatcccaaaagtatttatcccgatgattttagcatttatccgaagagtatttatcccaaggatagcatttatcccaagagcatttacccaagagcatttttcccaagactatttatcccaaagattttagcatttatcccaagagcatttacccaagagcatttatcccaaggattttgttttgttttgttttgtttttttgagacagagtctttctctgtcacccaggctggagtgcactggtgcgatctcggctcactgcaagctccacctcctgggttcacgccattctcctgcctcagcctcccgagtagctgggactacaggtgcccaccaccacgcctgcctaattttttgtatttttagtagagatggggtttcaccatgttagccaggatggtctcgatctcctgacctcgtgatccgtctgcctcggcctcccaagtgctgggattacaggcgtgatatcccaaggattttagcatttatcccaagagcccagttaccacacgtggtatatttcagtacgtcagagttggttgcctctgtttggttacggggctttgagttctagggctctaaattgcagacatgaaaaggcagccattagtgagtgtattcctgtttctgagggcacatcgtacacagcaagataaaggacaagtttgtttgttgaaagaaacaaactatcaagtttgttctcccctcaacttgatagaaatagcgcttaggggccaggcacggtggctcatgcctataatcccagcactttgggaggctgaggcaggaggattgcttgagcccaggagttcgagaccagcctcagcaacatagcgaccctacctctattattaaaaaatatatatttaaaaaaaaataaaaaaagaaatagcacttacgtattcccaaattccttgtcttgagcctatgcccacccgacatgctggaagatagtgatagttctgacccagtggggtcctcccttcctgggaacaagtggaacagacacattggccttgagcttatcagtcattctccagtgaccttgataacagaggcttgttcccaaagtcttggactcaagcccaagtgaactgaaaaaagaaccttccctccaagtagaactaaaaactggatactgtttgataaaaattaagacaggaaggcagtctttccagagaacactttctgtctctttcccccaacttgctgatgaagtggtatcatttgctgctgttatagaaatgtactattacgggtgaaaaacacaaggccagtattttcttgtatataaccaagtctcagttttgcaaaatgatttttttctgtcctggggcagctggggtgacatttcagaacaccaaggaaaagatttgctacacaaacagagcatttgtctgggccagtaattggcttggaataggagactgttttatccgcatgcaagaaattgtgtccctttctttctagcaagagcctgcaaatgcttgtttatgcctgacttataatcgctgcatactgtagttgttgattaaaaaaaatgtttccaacagaccgaaaattgttctcaggctcacagaggaatttcagttgaccttgaacatgagaaatgtaatccctgggcgataaccaattagcacccggaatgactcagaaattactttcaagcctcttatctggaggaattctgagtgacagtaaaatcgagctgctagaattggggtaatagaatttcatggtagtgtgagcttggcgcagttaccacacgtggtatacttcagaacatcagagctggctgtttgcttagggggctttcagtcgaccgtgggctttggaaaagaagactccattttggatggcgcacagtgggatttctcagagtcttaaaatttatttgtataacaaagtgcttactgtgtgccatttatgattctaagtgctttgcaaatattaactcaggtaatttaatccttacaacaacctagaatggtaggtactattatcacgctattttacttttacaaatgaagaaactgaagcccacagaggtttaagtaactttataaggtcccagagccagtcattgtcctgggtttgggttttcccagaaacagactataaggattcaagtgcaagtactttatttgagaggtgatcctggaagcaccataagttaataaggaagcattgccagaaaaggtgggaaaccaggaaagtaagtattatcaagcagactactgctgtgggcagctagggtttaaccctgctggagaactctcaagtcagcgcggaatgcatgcctcagaatttcccaatcaagggacaggaagctgaggggttatccgtcggctccccttccgttgcaggctaagggctgctcccagggaaatccactcacccgcactttcaatgtgccctgtgcgctgtgcccgctcctataaccagaaaataagctacaggcaaagaatcacaggtgtttgctgttagcagccctaggtgtagagagcagcatgctggtggtgtcttggaggaacaccagcgattgtacctgtgcaatgtagcctaatggttaagtgtgattgcttgagagccagactgcctagatttgaatcccagttctgccacctccttgctgagtggctgtaagcaagttgctttgtctctctgagcttctgattccctacctgtaaaatggggaattatagcacttcttacctcatgaggttatgtgaggattgaatgaggtaatgcgtttagcagagtgtctcacatgtcatacatatccagatgttagatgctagcatcatggtggttgttataattatcgtctcccccttcgggataaataaagctcagaacatcctctttctgggctttggaagagctgcttggaggttagggaaaatctacagggactcctagcctacagaggtccctgccccactgctgggtagctgggagtgcctgtagtagttccttgtaggggtggagtggcagaggaatctgcagttttagccaggacaggcattcatcatcgggagtggagcccagagtctggctgccagggcttctccactgtcccctcgtgctgtctggaaggtggcttggctctttgctcagaaatgctatttgctttctctcttagcattgagttctagggctctaaatcgcagacatgaaaaggcaaccattagtgtattcctgtttctgaaagcacatcccacacagcaagataaaggacgagtttaatttgtgcctcaattttaaaatgttcgctctttgatgcagtgtgtgctaggcattgtccccttggaacaatgggatatttcaaaggacaaaggacagggctcctgtcctctgaaggctcactgagtaggggccacaaacccaggtgttttcaggagccaggcaaacaacaagaaggcgaaagagcttggcatcacccagtgttagcagatccccttcttcaaaagaagctggggatctgggttttcatatctccaaattttcaacagttggcaactaattaaatattaaaatgacaacaaactctgtgcagaccagaccaacagggttatcagacttcttttttttttttccagggttattagacttctgatctagattctagaagttaaattaacatgcccatgagaaaagttataaaagcaagctgggagggagggaggaaagaggggtgccagccccagattcagaggagagaagggagtttctagtgctgagggatgaggctgttagctgctccttgaaggacaaggaaaaaatcaacccctcttcccacccccccaaaaaagtccttatctgtccactacgcaaagtcaaatgaagaaatcaggaagtttgaggtccgtgctcacgtttcatggggagtgtgtgctgggacccgcaggtggatgggaaagttcccaggatgggaaatgggaactggggcaggcaggacttggatcttcacagtctggagaatggagactgtgaatcagatgggtcctgagccaggattcaaagaaggcaggacacatggtgctaaggtgatggggtggtggagcagggaggggagtagggaaagtgtttgggtcaggccagcttgggggtgatgatttaggagggtgtgaggacatagcccgagaaaggtgagacggcttctgtcctaccctggctcttttgtttgcagtttccattgcaaataagatgaccttgtagttttaactaccccctcgttgcctctacaccccaaatctctgtctccagtccagatatctttgctcaagccccaaacccatgtatacaactgcttactgggtatttacacttgggttaaacctcaacatatcttactgcaaagtaaactgaccaagtatattcacagcagcgttgttagtaggccgaaaggggaaacaactcaaatgcctgtacacaggagacgggataaacatcaacaatgagtgccattcagcaatacaaagagacaaattaccgatttatgcaaaaacatggatgcatttcaagaacattttgatgagtgaaagaagccaggcacaagagtacacactctacaatgctgttcagatgaaattcaagaacagacaaaactgacctatgggatagaaactggaacagagattgccttagtggcgggggttgcggggggcgtcgactgggaacttttggagggtgatggaaatgttccgcgtcttgtttggggtttgggttacatgggtgtgcacatttgtcaaaatctacagaactgtgcacgtgagattggtgcactttgcggtgcccacctcaagtttcaaaacatgaataaagagaaaatggcggatgctttgttagccatggttcctatatggtaacagtggaatatgcaccccatgagggagaaataaaccttgaagttttaagctgctgtggggaagaggggatctcaacatgcctgaaatcacaccggtcatctctgcccaccctcttccccacacttccaaacttgctcctcctccgcttcttctcatctcagtggaaacaaccagcatcctgccagttggtcagaacagaagctggggagctgtccttcatctccaatctcccttctcccttgcccaatctgctacccatctggggtcagtctgtctcccaaatagatccactttgttcagtctacactgcagacaactgagtccatcatttttttttcttttaagacagggtctccctttatcactcaggctggagtgcagtggtgcaatcatggctcactgcaacctccaactcctgggctcaggggatcctcccacctcagcctcccgcgtagctgggactacaggcacacaccaccatgcctggctcatcatttctctccttgataatgcagtgacttcctagtgatcactcagcccacgtgctggggggtctcctctccactcagagtgacctgttaaatatgtatggtcataccatagccctgcttcaaacctttcaaaggctgtctgtcatgctcatagtcagcctgaatttcttaaggtcctttcaacactttgtctgcctcctgtgccatatctgccttgcatttcatgatccagccagacgatgtttcattccttgaatgtgtcttcccctctgttccataaatgctgttcctgctgccaataccagtttatctacttcagcaaccccaacataccttttggacacagtatggaggacccaatcccagctagaatgcacgttttttcagagtatctgtatccattttgccctctgatgtatcctcagcacctagaggagcacttagcatgtagcaggtactcaacaagaatttttgatttgtttgttggtttgtttatgacagagtcttgctctgttgcccagactggagtgcaatacagtgatcagagcttactgcagcttccaactcctgggcttaagggattctcctgccttaaacctcccaagtagctgggactacaggcccactgccaccatgtccagctaattaaactttttttttgagatagggtctggctgtgttgcccaggctggtcttgaactcctggcctcaagcagtcctgcctcagccttccaaagctttgtgattacaggcatcagccaccacatccagcctcaataaatgttttttgaatgaatgaatgaatcttccctgatattcaaaactttggaaagatttattttgcctctttatcttcaaagcaaccaaataatgcaacaataataatagctaccattcactgagcatgtgttgtgtgccaggaatgatactaaggactctgtgatacatcatttcatgtcatcatctccatgtcttgaaaaggtgatgaatgtttaggaagcttcaatcaccaaatgcaaattaagtgccttctctgtgccatactcctctaggtaccagggaaacagtggaaagcaaaacagacaaaatccttgccattggggagcttacattctggtataaggagaaagatgataaattgggaaacaagtaaatatatggtttgtaagatggtgacaagtgttttagagaaaatcaagtaagtaaggcggatggagattgctgagagcaattttatgtagggtgttcagggaagggccctcttatcagaggtgagagagttctggggaaagagtgctctgagcagagggaacagcaggtgcaaaggccctggggtaagagcatgtttggtgcattcagagagcagcaaggaggccagtgcggaagtagaaaggaggctgaaatcagaggggctcagtcatctgtggcctttggcttttactttgagaataatgggatggtatatatattgggcagaggaatgttatgacttaactgatgtattctgggccacacagctgattcatgtcagaggattctaccacgaggctttttttttttttttttttagtgagagagagatgggatctcactctgtcacccaggctggtgggcagtggtgtgattatagctcacagcagcctctaactcctgggctaaagcagtcctcccaccttggcctcccaggtagctgggatgacaggtgcacaccaccttgcctggctaactttctttatttttgtagagacagggtcttgttatgttgcccaggctgttctcaaacttctatcctcaatcgaatctcctgtctcagcatcaaaaagtgttggaattgcaggtgtgagccactgtgcccagccacacatgagcttttaactccacagttttctctctgctaaacgtgaatccagtaacgaagtcctggcagctgcaggtctcccactcatggcttccagtttttgcctcattccaaagcacctgctgccactctgagccccattccacagctcatggcaaggagtccctctcccattgcactgaggacacacgtggccctcactcatccatttatgcaacaaatatttagttgggaactatactagttgtcaggaaaaccatggagaatgagaaatattccgtgtccacaacagtctccaatttattggaaggaaacaagtgaacaggcagttatcctccagtatttatgggaagagaagtggatgaaggaagaaaatcagaggagaacctagtgcagacagagagaatcgatgagggcttccctgagccatgaaaatgtgaaccccaagctgggttgctgaaggggagagaatagccatttgtaccacagtagcagcagcaggtgcaaaggccctgtggttggaggggcctgggacatccaggggagtgaaaggagaatgaagctacattgcagagaagaagcaccctagcaatgatggagctggaaagccaggtagggcctaaacacacaagtccatgaaagcacctcgatctttaccctgaaaatgatgggatgccactgagacattttaagcaggaggggacttggttggatgagaggctcactgtggttgtgtgtgaaacccagtgtaagggaaatcactgtgccttgtgcaggtgagagatgatggcaggtagtgatggttgagatggaaagaagtagatgaattctagagacagctgggaggaaagaaatgacagttctggttatggttgagacatgagggataaaagaaagatggagttgcaaaggatgtccgacaggtttcaggcttgtggagtgatgcatggctatgcttttcatggggacagggtgccggagctgcaggaactacagcttcccattgtgtgcctgtgccttcctacaagatcgtcctcaaaccctgagcatgttttctgtgtgcttcctttttgcagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtatggtatgatttggtggctccacctgctttggaaggaacatctaacaacacaggcacatttgctgttcctatgggacggacgtcctagtgggagagagagtaagaagtaaatagagccacactacactttgtaatgaataccatgaaggaaatgaatggagtgctgtgtcacaaacaaaaaggcgaccctttcagtctgaggaggtgacacatatactgagacctggatgatgagaaagaactagctatgctttcaaagagctaggaaagaatgttctcagaagagagcaagtgcaaaagttccaaggtggggacaggctgggtgcatcctaggaaccatcagaaggtgttggggcaaaatgtcactagcagaaggaggtataggacgtgatgttgcagagataagcagggcccaaggatgcaaaccttataagctacaatgaggagtttgggtttcactcacagtgcagcggggagccattgaacctttttaagcagattagtgacacgatcggatttgccttttggaaaagatcactctgacagccaagaatggaaacggttcctttcaaacagttgcacagtggaaggatgaccctgggactcatacagtgtttctggacgcttttatagatactgcgagatgctgttttactgaagttgagattgtgttataagtatttctgactcatttagtgttgttttggggtttttagtctctttgcgtgccacaaagatgtctagcataaatctcataccatgaactcaggtgtgcaaaaaatataaatttcttttccatctatgtaacgtaagccaaaaacctgggagttatccctgagcttccctctttcctgtattcccaccgttcctggccaccgccccccgcagccatgtacgatgcattggcgaattctgacagttccttcaaagtatatcatgtattcactaacttctcttcatctctctaataccacccaaatctaatcattaatatcacctggataactgcagaaactcctcagtggtttctcaatcccaatcttgttacctataattaatcccaatcccaatcttttttacctataattaatcgttacctataattaattgcaatcccaatcttgttacctataattaatcgttacctataattaattgcaatcccaatcttgttacctataattaatttactttctacttcgcagccgtaataattttttaaagcttacattaggtcaaggggctcccctgcttaagaccctccaatgactttccatccaattagaagcaattctatgttacatccttagcttgtatcaccctttatcatctggcccttgttctctgtgtgacttcctttcttctttctcctccccatcacccactgtgctctggccacaacatcagctcttgggtcactgaaacacacaaagctccttcctcccttagaggctttgtgattcagctccttttgctgtttgcaaggccggctgcttcctgcaattcacatctcaacttagacgccacttcttctgaaaaatcttccccaactacccactgaaaagttgccgctcattcactgtccattatgtttaactctctcatggcacccatcactgagcaatgcttttcttgtgtccttgttgattttttctctcttccctttctaaggtctaagctccacaagagtagggatcttctccgtcgtggtcgccactgtgatttcagagcctagggatggaattcattcagtgcccagattgaatgcgtggattctctctgtctgtgggtggcaagggcatccactgagatggactaagggatctgaaatgatggctcaaagtctgaagagcttcagcatgggatgggaatagagagtaagggcagccagtaagatggcccatccagtccctaaggttgggaataggcagttggcagtggtccacaacgttgtatggtttttaccagcagctctgagtatccctggggtggagatggagaaggagatggtggatttgaactaagcgtgggattagtagaatcagtgaactagaagattatggaagaaagagagttaaggattctgggaagagagatgtccactgcagatccacagagcctgtaccaagtgctcaagaaaagcatgttgaatacatgaatgaaaatggtatctagattgggttggggaagatgtctagcataaagagggtcatcacctgggtgggaaaaagggagtttagaagtctaaggatgaaaaaaaaatagatgaggtcaagatacgtaaaatgttaggaagaattgaggcattgagatttcaaacatggagcagtttctctgatgatgaggaagaaagtggcctaaataaagaagaggttctaataagctgagtttttacaaattaaatgagcactttttttttctttttgagatagagtctcactctcttgtccaggctggaatgtagtggtgcattacggttcactgcagcctcgacatgctggactcaagcagtccagctcctacccaagttcacatctttctctgacccccaaataactgcatgcaccaccatgcctggctaatttttgtttttgtttttttgaatcagaatcttactctgttgcccaggctggagtgcaatggcgccatctcggctcactgcaacctctacctccagggttcaagtgattctcctgcctcagtctcgcgctcggctaatttttgtagtttttaatagagacagggtttcaccatgttgaccaggctggtcttgaactcctgacctcatgtgatccgttcgcctcggcctcctaaagtgctgggattacagacatgagccaccgcacctgacctaatttttgtatttttttgtagagacatggtctcactatgtttcccaggctgctcaagtactcataagctcaagcaatcatcctgccgtggcctcggaaagtgctaggattacaggtgtgagccaccgcacctgtcctaaattttatatatatatgctttcttttttcctttttttttttttttttgagacggtgtttctctcttgttgcccaggctggagtgcaatggcacaatctcagctcaccgcaacctccgcctcccaggttcaagtgattctcctgcctcagccttttcgagtggctggcattacaggcacgcgccaccacgcccagctaattttccacttttagtagagacggggtttctccatgttggtcaggctggtcttgaactcctgacctcaggtgatctgcctgcctcagcctcccaaagtgctgggattacaggtgtgagccaccacgcccggccatgatattcttaataagcaatgcattcacatgattcatcattaagattatattaaaaggataaacactgagaagtcctgctcctacccaagttcacgtctttctctgaccacttactgctactgctttccctatgtgaacacttttattcagttaatttgcgtctttccagtccccctgagctaatttaacattttttattcttgtccttattaactcaaaagttcatgtactacgcctgtttttgatcacttaacaaaacagacgagaggatgtttgatggaggattggaagttctggagagtcccatggaaaggattggggttggggggtagtgggtggagtcgtaggagaatgaatcactggggagcaatgagagaatagatcatatgtctccatggaaactgttataataattgagaactctgttccagactggagatatagcatcagataaatcatagatgaaaacaacagtaagtcatgaaagcaaagtagaataacaaacacctctatgatcctttaaaacagagtaatcctttgcaactctagtgttgccaactagggttgtaaattaatgcaggttttatatttgaattccaactttgaacattttgcagtctggttaggtatatagatcaatctccataaacagaagaacacagctgcagtgatttgctcttccccttcgaaagatgaaagtgatggggctttggggtaatctgtttccacctcccttaacccaggaaaacaaaacaaaacaaaacaaaacatgtttttaaaccctaatggccaggtgcggtggtttgcgcctgtaatcccagcactttgggaggccaaggtgggcagatcacaaagtcaggagttcgaggccagcctggccaatatggtgaaaccctgtctctactaaaaatacaaaaattagccgggcatggtggcaggcgcctgtattcccagctactcaggaggctgaggcaggagaatcgcttgaaccgaggaggcggaggttgcagtgagccgagatcgtgccactgcactccagcctgggtgacagagcaagacactgtctcaaacaacaacaacaacaacagccccactaataatttgtggggcaactagggaatggcacaagccttttggtaagccctgtaaaaatgaaacaaggcaggaagcaatggtgaaggacattgaatttcaaatgtgtaagcccgtttcaaaatctttcaaaagaagaaaactgtggagagtttgtttttttaaacaggcagaagtgtttacctggaagggctatcttaccaaagcagggcctgttggcatggctggcttactcggaggtagatgccttctaggacttttaatacagagcattcaaacgtgtcattcacgtttaaaaattattttatttctcaacttttattttagatacagagggtacatgcgcaggtttgtcacatgggtatattgtacccaggtagtgagcatagtacccaataggtggtttttcatttagtgcttaatggtgcttagaattttatccttaactgtctgtttttataatgccttgaaactttgagttttgccaacgtctttcaagaattgaactttgaatgattgctggagtcaaaattatgctgcatatatataaattgggcagatttgtaccgtccggattgatgatacaagcttaccttataaagtaaatacagcaaatacttgatcaagtatatacacagcacaaggataactctttatattataaacgtgattcctctaaccctaatgtgctgccataataaacatgcattaaatatttaatgaatgctaatactgtgtgtcttctgagatttcatatgtgctcatggtaatgatttgtatgatccacgtctttaaaaaatagtatgcaggaaagtttgaatggaggctttcttgttctcttatacccctgactcttgcctatggatggaactgagctaatgtacgtgagttgagatgggatcagggggttagaaaggagctgggggaggcagctggtgtgctatagtggacatagatctataaccataaagaagctgaaagaagcttcagcacagaagatctatgtaaaaatggtatttactggaaaacagaaatagcccaaatggtatattcataataaatacaaaaaaaaacgaagtgactctctcctctctctttctgtccctctctcatgcacgtgcatctatctatctatctatctatctatccatctgtctatctaatctatcatctatctacctatcatctttctgttatctatctacccatcatctatctatcatctatcatctatatctatcatctgtttatcatctatcatctatttacctattatctgtctatcttattatctatcatctgtctacgtatcatcaatcaatcaatcatctatctgtcgtcatagaaagattttcataacatatcaaataaaaataaaagcaaattatggaacattatgattggcaatataaaatgtgtatagaccaattccttttatgtaatatactcatggtccctgctttcattaaactttttcttcaacatttcattatgaaaatttaaaaaatggaaaagttgaaatgattgcataatgaacatctataacacccaccacctggattccacaagtaacatttgactgtatttgctttatcatgtatccatctgtctatccgtccatcaacgcttttttaatgcatttcaaagcaagttgcagacatccatacactttacatttgcagataactgcaaatgcactttacattcagcatgtataccatttaaccagaattcaatatttgcaatgattattttaaaggtaaaattacacacactgaaatgcagctatcttaagtatatcattctatgagttttgaaaaacgcatagtttttaaaatgcagtggaggtatacacattcatttaaaaaatcacacaggcatgaaagcaactgtgatgtttagtatgttccatgggcacctgcgggagtgggatttgccctggttgaagccagagaagtcttctgtgagaaagtggctcgagctatagctaaaggacgagttaagttaactatgcaaagaggggaaatagtaaatgaaaatctcagaatgtctctttgttcctggcccccacccccaaaataggcttggttaatctgtgtggctgacagggcacctaaacttttattagggtagattcatctgctgtaacaaatagacccccaaatatatactggctcagacacaatagaagtttaaaattttcattaaacttctaagtttaagacgtttaagacaggcgcgcctggccacacccactctctccatatggtgattggggacaaggtgtctttcgtcctgtatggctccattaatccctagagctttgtttttctctgcagtcagagggtggaggaggcacaagctgcttcttaaaagtctcagcttgggaagtggcaccaatcatttctgcctactctctattagagaaaatatagccacgtggccacacttcagtgcaaaggaggccgggagaacaatttgggtggatgacacgtcgtctcagccacattccctacttttcagtcctggctgcaatttttcacggtgacacacaaaagaccttctgacttttccctttagagctctcgatgtatcacactccacacacaaaaaacttcaagtgcctcttttctgtgacatttctttgtgttcaaatcatggagcacgccaggtgttagtggtgactttcttgaagctagcacgagccaggaataagtcaagtaggaagaagtcagcagcttatgaaattaaaaagaaaaagtgaagttactatagaaactaggtgcccaggtatcacattttttctcttttaaaaatcccatccagctctgttgctgtctatgaatctaagatgatctaaaatcagaagcagagaggtgagagacagaaccattaagcttccccatctagtgcttgacttccctaaaataatcccaggacactgaaccaatgacattaaatgcctgggtgtatcactaaggaggctgtggagggtctgttggtggccccttccactagggtacccctagaaacttggcatttgtgtgacactctccaagatgctggcatcaacttttgtagctcaaaattcagaccgtacaacagagttgactatagtcttggccaggttttccaaatattagtcatttatgcacctgttatgggtttttccttgccattacatgcctcctttattcgatcatatttttctttaaagtgactttaacttgacttccttttcttcttcttaacattgccctaagcaataatatatgtgaaatcacaagtttgatgtaccagttatacatttattttaatgtgtttggtttgatataccagttatatatttattttaatgtgttttaggaaaatatattaaaagaagagtaattttgttcttgtactagtacctgaaccacatttggtgaaaaactgtcataaaatcttacacttacacaatgtaagattgaggtgatttggcagctcgattaccatggtatttctaagaatgtaaagtcttttgttacaattcgtgtgcgtacctggaagttacaaaaagtctctgttcatccccctcctccatatcctttccttcaaataaggaatatgcgcaacactgcctgtatccttaaaaatctttcgtgtgatcttgacctccctctaccctcctttactcactaaatatatccagacagcaaagctactctttggagattttctaccttcatttcctccccacccactccttccttatccttttgtattatgtctcctccccttagcaactttcagaaacatctgtctcccaggttatcagcagtcttgtaactcatatctctccagatctgagcatgaggcatcctggcttgctcaggggagtagggcaggcatgaggggaagggaactggaaataagattggaatccatacattattctgggcagaagtcatcacctttacagtaacttcccactgaaaggcataactaaggattcattcattcaagaagtatttattgagcatctactatatgccaggtacccttgtaggtacagaggcaatgtctatgaacaaaacaaacaaatatatctgcctgccctcatgaaacttatattctagtggtagtgatggtgacgacgaagatgatgataacacctaacattttttgggtccttactatgtgccaggctctgttataagtgcttagtatgtattcattagctcacacttactctatgatgcagctactgttgtccccattttacagatgaggagagtgagatgcagaaagttggaataacttgctgaagtcacacagctagtaaatggcattaaacagatcagctttgatttagatgtgtatgatttggggctcttttttttttttctagagacagggtctcactctgtcacccaggctggagggcagtggtgcaatcatagctcactgcagccacgaactccttggctcaagtgatctgcctgcctcagcctcccaaagtgctggcattacaggcatgagccactgtgaccagctgattttgggatcttgattgcttgaaacttaacatgtaatttcctagttttaacagcgattccgtggaatgtcacaaacatattctaggaggttagtcatttttccctcttattttctcatctttccctctaagtgctaagcagagtttatggccaggtgcagtggctcacacctttaatctcagtgctttgggaggccaaggcaggaggatcacttgaacccaggagatggagcaacaaagggagaccccatctctataaaagcaaaaaacaaaaaaaaattgcatgccttattttcagtgtaagttgctgccattagacaaaccacatactcctagtgatggagggctctgggttttctgttcatcctcatcactctgtgcttattggctacctgtccatgtgtaaataacacatgtgccctgtgctcattggaaccgtgagtcatccgcagggattcctaagagggcccatgagaatggctttcactcctccagcctctgcccttctgacctcctccacaggcttcagccttatgggagtccccaagtcttggaagcatctctagtgagtgcagtgactccttagctggttccttttcaaccttcaacctccattttcttaacccttaccaactctactgcccagctgcacccactccaattccactcacaccctgcccattatcgccaacgtttctgagctcatgctcattgacaaggaccatgccatggatttgcatgcattatatcatattaattctcaccataatcctgcaaggtagtcactgataatcactctattatatcatatagaaattgtaaggcagagaggttaagtgacttctccaagaaggaggcgggaccttgaaagctggttttgtgatttcagttgcctcttgccatctcttctccactttggggtccacacatcttcccaaacccctagtttaaattttttttttttttttgacaagagtctcactctgtcacccaggctggagtgcagtgacgtgaccatggttcgctgcagcttcaacctcccaggctcaagcaatcctcccatctcagtctcccaagtagctgggactacaggcacatgccaccacacccagctaatttttttattgtttttgtagagacagggtcccactttgttgcccaggctggtctcgaactcctgggctcagggaatcctcctgccttgacctctcaaagtgctaggattataggagtgaaccaccatgcccagtccaaaccactactctttcctcttccttttttcctttctttcttccttccttccctttctctctttttgacttttttgaaacagcagttacaaaacgattacaagagctacctaatgaggccaggtgtggtggctcatggctataatcccagagcctctagaggccaagcctggaggattgcttgagctcaggagttcaagaccagcccagcctgagcaacatagcaagacctgatctctaaaaatgtgtttaaaaattagccagacacagctggatgcagtgggtcatacctgtaattgcagcactttgggaggctgaggcaggcagatcacgaggtcaggagtttgagaccagcctggccaacatagtgaaaccccatctctactaaaaatacaaataaaaattagccgggtgtggtggcgcatgcctgtaatcccagctactcaagaggctgaggcaggagaatcacctgaacctgggagtcagaggttgcagtgagtcgagatcatgtcactgcactccagcctgggcgacagagcgagactccgtctcaaaggaaaaaaaaaaaaaagccagacacactggcacacagttgtagtcctagctactctggaggctggggcaggaagagaggttgagcccaggagttcgaggctgaagtggctatgattacaccattgcactccagcctggacagcagagggacaccctgtctcttatatatttagaaagctgcataatgacatttgtgggtttctccttcttccatgaaaaaaaaagcaaaaaatggtatctcatgactgcattggtatgaagacaaatatattaatattacatattaaaacatgtacttccacctaggttcacttttttccttgtgatttaaaaaaaaaattaaagtgccttatgaaccttgaaaacagcatgggccctgagcactgtgcctggtgggttttgatggagaagtcagccctatgttccagctccagcatctcaatagcacctccctctgcagcctccaaacttttcttcccaaaggccagggtgcttaactaccatgctctgtgagcatgagagagcattccagagttccaggccccagacctcagggtcccttttttttttttttttttttttcctttttgagacagagtcttgctctgttgcccaggctggagtgcagtggggtgatcttgagtcactgcacctcccaggttcaagcaattctcctgcctcagcctcccgagtggctgggattacaaatgcctgccaccacgcccaagtaatttttatgtttttaatagagacagggtttcaccatgttggccaggctggtctcgaactcctggcctcaagtgatccgcctgcctcagcctcccaaagtgatgggattacaggcttgagccaccacacctggcctcacagcatcatctgctggagccaagcccggcaccagattttaacaggaagaaattgcctgaggagattaaaaggcagcttagttcatgccaggaacaaaggccttctctaaagtctgagcttctgttgtgggagtctctactaattttaatctcattagtggtatgtattcacacacagacatatacatacatacattagatgtggttatataatcctacagacaaaagcacttccctgtacttcagcctgctttgctatcttcctgcaccatatggtgagttcctttatcatatggttcacagatagctcaaagtgtttgctacctgtttccttaatcctcttccagagaacctttttgacatttgctgtctgatcttggattcctgccttctctttggttctatcgcaattatgtcacttccctgcccccaccaagccttcaacctttccttctttcatatgcaattctgattgcagcgtggttttttttttttttttgccaactcatcttcccagatcctcgtgaggcccttcttccaccttcccgaattttccaggtctctcctcaatgaagtgacttactgctcttccgcagcctctgccttcaattctcagaaggtagtatgttacaagacaagataaggttcatttttcgcaagaaaataaattatatcaaggaaaatgaaatgtcaggaatttaagttttacaaccttccatctgctgcaagtagattgtcaagccagagtgagtaaagcgggtatttgctgagaagacatggcttgtttctgtgtatctcaagacacccagaggcaagaagtgccacctgaatgagagagcttccagcagtctgataaccatggctccatctggggggttgtaggggggcccccagcctgtcatccctgcttctcgatgacatctctctgcagatacgcatcagcaccacctctctcagccttgttgatgcttctgaagtctccatgtctaattctcacatgtagaatatcctaggaatctaaaatcccgggaaagaaaaactgatgggccagtgtggaccagggatccctaggatccaattcactgtgaccggggaagcggttacttttccaaccatccatcaggaaagatgacaagaaaagcaaataggatgtgggcagttttcctatgagaaagaagaaaacgacgggcctgtctggcacacaggccaaagtgggagtttcctttaaatgtgtattattttttattttaatttttttattttgtttatttatttatttttgagatggagtctcactctgtcgcccaggctggattgcagtagcatgatctcggctcactgcaacctccacctcctgggttcaagcgattctccttcctcagcttcccgagtagctgggattatatgcgcatgccaccatgcccggctaattttttttttttttttgtatttttagtagagacggggtttcaccatgttggccaggctagtcttgaactcctgacctcaaatgatccatctgccttggcctcccaaagtgctgggattacaggtgtgagccactgtgcctggccttttattttaattttttagagacagcatctggctttgttgcctaggctggagtgcagtggcatgatcttagctcactgcagccccgaactcctgggctcaagcgatcctcctgcctcagcctcccgactagctgggactacaagtgcatgccatcgtgcctggctcatttttgttttttttctagagatgggatctcattatgtagaccaggctggtcttaaacttctggccaccagcgatcctcctgcctcagcctcccaaagcagtgggattacaagtgtgagtcacgtcgctgggccctgtgttttctctaaaatgttgcctgattctttgggaaaaatatcgcaaagataaatcaagtcctcttgtagaaggaccagatagagcccattaacatggaaactctgtctcaggtgatcattcatggctactggtccaattattgtgctatcatggtacctgccatcctctgcatatccatctcaactttatctctatgtattatttcagaaatttacagtcctggtaaagtgaatccctggttactaacagcataacccataatcttttctataatacaacaaacataatggcagaaatttgtggattgtaatcatccaacacccatgataaatattttggatgtacaaatgtggatggtacctatgattattcatgccgtagttgtttcaaacccccaccccaccccacagtttcaccttatgtactgacctcattgaacaccactgcggagattgataacatttttggagcactgggaactcatctgagtgttttataggcattgctcatttaatcttcaccatgggtcttgtgaagtgggtgctgttattatctgcatttttaaatctgtagataaagagacagagtctctattttgcagatgagggaatagaggctcagagaggtgagaagcttgcagtcctgaagcggtggaggcaggttcaaaccagggagcctggctgcagaatgtgttgccactcagctccatagtccccttgcatccagtgccccctactcctgctgtgctgaaacccgttctctattagcagtgctctgtaactccaacaacaaaggggggcagtgcttacaaggcagatcagattataaacaagctttcttcctgccacctaattgttgccatgaatgacaggactttaagggtttcatttcattctctttcagtagaagccatcaattattagtttattttcccagcaaccatttaaaaaagagtcaaattaaatctgcttttattttaactatccagctttgtcaaatataacataggattcaaagaaatttgactaagccatatatgtcaccaatgtttattttatttatgtattttttttggcatttctgttcttttgtgagtgtgagtggtgagaacacttgggatctcctcccttagcatatttcaagtatataacacagtattattaactgaattaccatgccataccttttaaattgctagtacttatttatcttgtaactgaaagtttgtaccctttaatcaacatctccccattttctctactcccagcccctagcaaccaccattctgctctctgtttctttaagtttgactattttagattccacatatgtgagatcatacagtatttgtctttttttttttttttttttttttttgagacacagtcttgctctgtctcccaggctagagtgcaatggcacaatctcggctcactgcaacctcacctcccaggctcaagcgattcttctgcctcagcctcctgagtagctgagattacaggcatgcaccactatgcccggctaaattttatatttttagtagagacagggtttcaccatgttgaccaggctggtctcaaacccctgacctgaggtgatccacctgtctcagcctccccaagtgctgggattacaggcgtgagccaccgtgcctggccccagtatttgtcttttggtgtctggcttattttgcttaggataaggataaggtgctccaagttcatgaacatttatttcagctcaaaagaaccgttcagttactggaattgatcaatatcaattctattggtaaaaatcaattctactggtatcaacaattagacgacacagcccagagtgtgaaaatagtagttctctcgcatttcttgttacaacccaattagacatttcttattagacccaaccacacatcctcatttaaataccagggccaggtatttcaggtttcaatctccttgttccactcctcccctttctagcagtcactgtgagtcatcccttctaggggtgtagtgacatttgcttaacaatagcaagtccacagaaaccagagatgactgggctaaatgcaccttcattctaaacttcgtttcacactttcatggctttctcagctagtgggcaaaaatgctacttgattaaattacaggtgtggcatggcctcattttaaaaggttgaaatcttaatgcaacctgtcaatctgacctctgaaatgaaaaattagcttatctatcacacagatccatgcttttatcatctataaagagatttttaaatacagaaaaccttacgtaataaatcaagaaatagccaagttgtatcatccgagttgatctatacgccggatatcactgctcttcttttcatctggccaacgtgaagactgtattcgaaaagtgctgcagtcctacctacatccacactattaattcccaagcatcttctccccattatatcactttccagtttttcctgaggtacgtcttcacttggcagagtctacccagttgccttctcctaaacagactgttagaagtctgaaatcatttttagactgctggcttcctctttactgctagaggcaagtgcatttgattccttcaaaccacatgacttcgcatcagactgatgtggccactgtcaaatgtaacatttaaacatatgtttgtgtggacatatgtgtttggaacatttcatccgaagtctgacacttaagaatacactttggaaaatcagaattagggccttcaagataaactagaatgtgataggacatcttcatttctggtcaaagttggaagtttgggagagcctcaaaagtgaagaattcgccaacaaccatggtgaatgcagtgtactgagttcttgtaaccacccggtgggatcttcttgcctgctccccagatagagccgatttctcaagaggggaattataatagggaaagagctttacacacaaagactcaaatcagcctccatgaatatttggaggctagaatttttccaagatagtttggcagggagaggaggtggctagggaatgggtgctgctgattggttggagatgcagtcataggggtgtggaaaatggtccttatgctctgtatccacttctgggtggggtcgcaggactggcttatgggttcatgtcggggctgtccagtagtcagaaagggaaaagactgaaagacatctcaaaaggccaatctgcagttctacaacagtgatgttatctgtgggagtaattgggaaagttgcaagtcttgtgacttctggaataatggctagtaatcctttatgtctacaccttagccgaattcaggctcctttcatcctcctaacttggcagtctttcattagttttacaaaggcagtttagtttgggggaagggctgttaccatgtaaactatacactaaatgtttcccaaatttagcttggcccaagtccagaaatgactaagggcagtttggaagtcaaaagcaagatgaggattggttagatcagatctcttccactgtcatcatttagttataatttttgcaaaggcgatttcattctttgctatatgttaagctgttaacatgccttatgtcatgaaatcatcatcatggccctactaactcttgttaatggactcttgtctatattttaccctgatatccaacctgctgtgagacctcttgcttttgtttgtttgtttttattttttgttttttgagacagagtctccctctgttgcccaggctggagtgcagaggtgagatctcgggtcactgcaacgtccacctcccaggttcaagtgattctcctgcctcagcctcccaagtagctgggattgcaagcatgcaccaccatgcctggctaatttttgtattttttagtagagatggggtttcaccatgttgacaaggctggtctcgaactcctggtctcaagtgatccacctgcctcagcctcccaaagtgctgggattacaggcgtgagccactgtgcccggccaagacctcctgtttggaatggctttcccctccattccaggcctctggttatcagagatgaggtagcttaagcccttcagtgcttaatccctggcccaggcagaaggagggctttggcaaatccgcatgctagaaaagatgagtttggaagggcctggaaaccagggtacatagttccttttcccttgagattttagaagttgacagacggtttgctggttttgtagggaaatcctatctgccacagagcatgtggattacccagggaggatcctggaggtcacgtgcccagtaccacctctaagcacagacagtatgaccttgcctttcactctgggctttgtgtaaggatctcccaggacatagatttcatagcgacattggtcgattgctctgattcactttctgcctttctctttcttgcatatggagaatgtgggaaagaatcccctatacacacccacaggagttagaacatccttcttatcctccataatcgtgccttcaaattaataattatggcttgctgtgtgttgggccctgagcttaacctgcattatgtcacttgatctcacaacaaccttctgagggagaaactgtcattattccccttttatggattggggaactgagactcagagaggttgagtaactcagccaagaacacacagcaaaccatatgatagagtcaggatttgagctcatgattccaaagtctgaacttgaaccttctatgactataattctaattagatataagcttccagatcatcagactctgtcgatgccataatctctttcttacatggcagagatggtcaggatacctgccacgtggtaaagacgtggatgcagaagttaacctccatttgattagcttcggtgcaccaagctgcacccaggtttctctcgaaatcctgctcctgagtgggtgagtgccccgggaagagcaggtggttggcgtttgctcagttttccagcccctgatcaccctgatggcctctagccagcttttctctctgtcctcctccagtgagggccaggcctggcacaggcagcctcccaatgtttagaaggttccgatttaattggtctagagtgtggcccaagcatcggcttctaaaacctccacagggagttctaatatgcagcagggagaagcagcagctcagtgcagcaggcaaggctcgtccacggaagggctgggggaaggaaggagatcatatttgccttaaaacttggagttgagctcatctgacctaccctctgcaggtcttcagggggactgggaagaatccatgcaggagatagccccagagatcaaggggatcctcaaagagatgggatcttaagatagagggagggtacactccttgcaacagatcagcaccctgaccctgtacccagcctcgtccacaaacctgctccctagtgctgggcatgggatacagagctaggggtcgtgtggtcccccggaggcctacagtatatacacatgagctgtaacttgcttgtctgtccctccccaagttgacctcagtttatcacaccttactgatgctcttctgccaatttagtgtttgaggaccctgtgagccctaaaggtctctttctcttattttattattttattttattatttcatttatttattttgagatggagtctcactctgtcatccagtctggtgtgcagtggcatgatctcggctcactgcaacctccacctccttggttcaagcgagtctcctgcctcagcctcccaagtagctgggattacagatgtgcaccaccacacctggctaatttttgtacttttagtagagacggggtttcaccatgttggccaggctgttcttgaactcctaacctcagatgatccacctgccgtggcctccaaggtgctgggactacaggcatgagtcaccgtgcccggccgagataggatcttaagacagagggagggtatagtccttgcaacagatgagtaccctgatcctatacccagtgtcatccacaagcctgctccctagcagggatgggagagggagctagggagggaggggcatgggagagggaactagggatcgtgtgatcccctggaggcctacagtatatacacatgagctgtaacttgcttgtctgtccctccccaagttgacctcagctcaccacaccttactgtgttgaggtataatttacagaagactcacttgtttgtttcatgtaatcttgaatgatgctcttctcccaatttagtgtgtggggacctaagagccctaaaggtctctttgtctattttagatgcaccatctgaattcaagttagaatcttttcccaatcactgtttgttagtcaagcttgcagactgtgacagtgctagatgttttggtctcttcttccttgcctcctcctcctccttttctgattctgttgcagggatgttattaagaacaccatccacagcacagtgtgttcaaacatccatgcaaaacatttctcttagacctaagttctagagaaagcttatttttctcctcaaaaaacgattttcattatagaaaatatgaattttgttatgttgcatatatttctgattgctttggtttccaggaagcagaaagagaaagtaggagagagagaaagagagagagagaaagagagagactgagaagaaaagagggagagaaaaaaaagaaaagagaacgaaggagagagggagatggcaaaggagggaaagagagagtatatatctataaagtatatatgcatacatgtacacatacacgtgtatttactatattctttttttctttttgagaccgagtctcactctgtcacccaggctggagtgcagtggcatgatgatctctcggctcactgcaacctccacctctcgggttcaagtgatactcctgcctcagcctcccaagtaactgggattacaggcgtgtgctatcatgcccagctaattcttttgtatttttagttgagacagggtttcaccatgttggccaggctggtctcgaaatcctgacctcaagtgatccaccctccttggcctcccaaagtgccgggattacaggcatgagccaccaagcccggccactacattcatttttaaccacctgtgttgaggtataatttacagaagattcacttgtttgtttcatgtaatcttgaatgatccctcaaattctttgtgaaatatgagttggacggagccttatgtaaattaaacaatgctgacacccaaggaactgaagatctttagtgaccttgatctgggagatttttaaagcaacttctcctactcatgaagtcctttcattcattgattcaacggatatgtattgagtgtcaactgtgtgctagatgttggggacatgacagtgggcagctcaaagaaaatgcctgccctcatggagcttccactcttgtgagggataaaaataaacagatagatattaatataatgcccgtgtggtaagtgctgtcaagaaaaacaaaggaggggaaggggatggaaagtgacaatggggcctatgagtttagagaaggtggtagggagggtgttggtgacagggtcacattggagtgacctgaacaagatgagggagcaaactgttgagtgtccctaggggaagagtcatgcaggcaggaagagcaaaaggcagtgattctgagaggtgagattgagtcccaagtacagtaggaggacagaggaaagccttaggaaggtggagtgacatgaacaaacttaagtttctaaagcatcgttcaggtgtatagagaatagaatggaccaggtgcagtggttcatgcctgtaatccagcactttgggaggccaaggtaggaggatctcctgaggccaggaattccagacaagctggggcaacagagtgagacctaatgtctaccaaaaaagagagaaaaagagaatagaatgtttatgagagcgagaagaggggaagcagaaaacagggtaggagacaactgcaggaaaccaggctaaggatcaaggtggctcagatcagcaaagaggttgaacttagtatatattttgaatgtagagctgacaaatcttgtgattgtactggatgagagatacaggagagaggaactgagggtgactggatttggctttggacttgtggcaagtgtatgttgaagttgagcagttgggaagcaagatcttgggtccctggctgtctctgcccttgcacactagtgtggccatttgcactgctccctcaggacaaagctcccgggccagttgaaaaccggaggttggtgctttgtacaaagctcaccatcagccccctttgttgtttggtgaaaagatgatgttgacgatcaccactgtaatgggtagaattgtgtcctcgtaaacaatgtatgttcaatttctaatgaaggttgcctcacttggacatagggtctttgcagttataagcaagttaagatgtggtcactctggattagggtgggcctgaatccaatggctggtgtcctcataagaagagggatatttggataccgacagaacacacagggaagaataccaggggaagacagaggcagagattggagtgatgcgcttaaaagccagggagtgccaacggtagctggcagccagcaggacctaggagggaggtgtggatggaacagatcctccctcagaatcttcagaaggaaccaaccctgccagcaccttgatttgggacttccagcctccagaactctgaaataataaattccttttgtgtgaagtcactcaggttttggctcttccttttggtcatgctaggaaactagtagaaccaccaggtattaaatatttataatttgccatgcacagtgctaagttaaggtgtgcactaagatactttatcccataaaactctctcagcagcaccaaaagcaaagtattgttggcatctccattttataagatgaggagaagattgaggttcagaaaacagtgaatttctcaaggtcgtacagcttgtatgtggcaaaacttggacacgtaccaggttttctaactctaaaagtccatgccctaaccattatgcaacgctgggccacagtcaggggccgagattccaggcacgctttgccattgggattcgccagtaaagttcatcaccacaaactttccagccaggaatccctgggctactttcctctgttttatttgctgtcatcagagttctgctatttatcacatctctcccagaagattcttgggggaacagatgtggcttggaatttgataagaacgtcacttcaacacatcctttcagtctgtttggaatcctcaccctggagagagagggacagctgaacaaacagcccacgccctctatgttggtattaaagtttctggaagctccagaaactgcttgagacaattaataagagatcatttccatttaaaggaacatttttgaacgtgggcatcaccagccagggcaatggctacttttctgctcttttcctctcccatggcaaaacttcacagcatatggccgggcgcggtggctcatgcctgtaatcccagcactttgggaggctgaggcgggcggatcacgaggtcaggagattgagaccatcctggctaacacgatgaaaccccgtctctactaaaaatacaaaaaattagccgggcatcgtggtgggcgcctgtagtcccagctactcgggaggctgaggcaggagaatggagtgaactcgggaggcggagcttgcagtgagccgagatcgcaccactgcactccagcctgggcaacagaggagactctgtctcaaaaaaaaaaaaaaaacttcacagcatatgtggaggcagaaaggtctgcccaagccacttgatggaagcagggccgtgtttgtcctgcttattgggtacatcaccagtgcctagcatcatgcctagaacaaaattcccaatagagcttgtagacctgatggaagaactggaatcgtgactgcagcatgaatgcacaccaagctcatctcgccaagcaaatgttagtggttgtataagaaatagaaaaaggaaatgactgttctctctgtggctatgtgcaaggtggataggaaaagaggaataggaccaggatctaaaactgaatttaaaatattccagcactgatttgctcaccactgaacacttggcacttagggcttgatgatgggtgtgtttaagggcatggatttaagggacaggtgactaggtgtcacttcctagtggaatacggacgagtcacctagctttgttaagccctcccttcttcatctgtaaaatagggatagcagcagtttccaccttacgtatttactgtgggaattaaataagataatgcatattggaagtaatcagtgggcatgtacatggttattgttataaagtccaaactgtcccaacgttgccctttttttccttggcacaaacactaggcctttgagtatcacaaattctttgtccagccaccctacttggtggctggatctctgtgattctattagagacaattgtctgctacatctcagagagatgggagtcagcatctgcaatttgatttctgaagcttaagtgctcatatccttataggaatcataggccaaggtttgtagatccagatcgtttaatcctaaggaagcactgttcttttccctttggctgaaatatgcctcctgtgtccccgccttgctagtcctattgatacttcaggtgtcagcttaaccatcacttcccgaagagcatcttttgctgacccactcagcgatgttaagtcttccatttaaacactccaagagcaatgtgtacttctgtttcaggggtctcattatgattgatgttaggtagttatttgtacaggagtgtaagcttcatgagggcaggaaccttgtcgttctgcattcctggtgcctatctcagtgtctgacacatcctagaccctaaattaatgttaactgaaagaattgtctagtcttctaggtgctggataaaactaggaaagttgatgcatttggaaggcccaatgaattccatctctgttgcctctctcagttgaagctttaaacaatattgttattattgattgaaaagagcatgcataaccaaacccaaggtggcagggaccactgctgaccaagctgggttgcaaattaaactgcagccatttttgatcatgtggttactcttcttttccctgatccttcttgaaacacttattctaaaacgagggtcagcagactattggaacccaggctactgcttatttttgtaaataaagttttattagaccatagccacactcattcacttgatccagaccgccctgcaaagcctataatatttcctgcttggccctttatagagaaagagggacttgataaatctgttctagttatctattgctatgtagcaagtcattccaaaacatagaagcttaaaacaacagccatcctatattatctgtcatggtttctgtgggtcaggagattgggaatgatcactggttggttgtggcttgaggtttttcctgcactggctggagcacctggggctgcctggtcatcaagcttatcaggtagtaccagggtttcttcatggggtcttgttccctggtctagcattgtgtcttggggtagaaaggaaagaaactgacagaagctacagcctcagaagtcttgcagggtctcttcaccacattctgttcattaaggcagccgcagtgcctgcccaggttcagagactctggctctgattggaggagtatcaaatatttgtagacatgttttaaaacctctataaagtatcacttccttcgtgctatggggacagctctcaaaatgtaactccaagagaggacagagagatttatatcgaaaatgaaagcttgattagaatattaagaagaaaaggaaagttttctctcatcctattaatgactgctgagaaagtgttaggaaaatcaggatggaaggattctgtcagctttacctactgacatctcctagccaccttattaaatgaatcaattttgataatatctggtgattataatcaacataggaagaatatgtttattaaaatgcagactcccaggtcacagcccagagctcctgaaggagagggagtgcttggaatctatatggtaagcaaagaccctcaagtgattctgacataggcaagaggcactgtcctttataaagactggaatttgccttgttttaggtcacatactgacatgatgctacttggcttcatgtattttaattattagtaagaatttgagctacctatgtaataattttgttttagggatctctaagatacataatccattcaaagtaatataaataaaaataactttattggaggaacataaaggtttcaaacagaaaatggctaagcctcatgagagattggaaactgaaagcaaggcctctgcttgttctcttaccttctttgtttttttccccctgcctcaaacatctattttattcctctttgcctgcacagtggtagaaaaggaccacgctaggctgagtgtggtggcttacgcctgtaatcccagcactttgggagacctagatgggcggatcactgaaggtctggagtttgagaacagctggggcaacatggtgaaaccccatttctactaaaaatacaaaaattaaccaggtgtggtggtggacgcctgtaatcccagctacttgggaggttgaggcaagagaattgcttgaactcgggaggaggtgaacgaagatcatgccactgcaccccagcctgggcaacagggtgagaatctgtctcaaaaacgaaaaacagaaaacaaaacaaaacaaaacaaaaaaggaccactctaggaagatctgtgtattctctgttgagggacccaggactgactcctcagagtaccctaattcaaattcttgggagggggaatccgattggcttggctcaggttgaggaacttacctctgatccaatcagctgtgaccagctgtatccactgcccaatcagaaggttcttctaataacacagagttggaagaagtgaaaggcatgctagggttttcatttccaaattaaactgcagtcattttttatcatgtggttactcttattttccctgatcttcttgaaacacttgttgcaaaacaagggtcagcaaactattggagcccaggctattgcttatttttgtaaataaagttttattagactacggccacactcattctcttgatccagaccgtcccgcaaagcctataatatttcctgtttggccctttatagagaaagtgtcctgactcctgctctagaattcagttcgcttctatgtctaaatttttgctatgccttatgcatgcccgttctgttttccgttaatcagtatagggcatgttgttgagggcagggcaagacactgggaatcttcacacacccctgtttattgatttttaaaactatctgtacaaatgcaatagtatctcctacgatgcggagcacatagcattgctgatttgcaagaagatttcaactgctacttgagattgttttaggtgccgtgtagttgcactatgaaataaaattaaatcacgttatgataaggttatttctgtgtctccttttactctttctaattacttgaacaagcaaatctcatttgatgacaatatgctctctaacaactttctaatacaattttttcctttaacaaggagaagatgcagagcctgactcagaaccttcagcagccagcagtatatagctagaatttactggcaccgctttgcttttatttatttttatgcttatcttccatttatgacttgtgatactggcttgccattaatagtggtgatataaagtttccttttcaaatttagttaagttgaaatgtgactagatttttaaaatgctaagcaaataacagtttaggtggcaggaagaaatgtgaaaaaacggatatgaatgattgaagtgcggaaatgcctgagctacagtaactgacatagttacaaagcagccctggtgcccagaggaggtagtggccgatttggtctgaatggaacctccagattagaggaggagataacagcccagtggaatctcagattttcaaagcagtgcaagagcatggaaggacgtcatagacagtgggagtcgaatgttcaaaggaaaagaaagaacaggatgtggtcatggaattgtttggctttcaagagccactgaagggctttcagcattcaagtggcacagtcagagctgcattttcagaacagtcattagctgaagcaagttaatctccctgagcctcagtgtgtttatctacgaaatgggggtaattgacacagatgtaggatgtccacccctgtccctggtgaagggggaaattcccagccattctgccctgtctctcttccatgtggaaggctaagatgtcctatcatgactgcatctgcactgaaggtgtctagggcccctccttctctcgttttggttgggggaatgggagatagttgcagatattcaggattgttggatggtgccttgaccggtggtgatgggtcagggagagtgtattagtccgttttcatgctgctgataaagacatacccgagactgtgtaatttatgaaaaagaggtttaatggacctggggaggcctcaatcatggtggaaggctaaagtcacgtcttacatggtagcagtcaagagagaatgagagctaagcgaaaggggaaaccccttataaaatcatccgatcttgtgagacttattcactaccactagaacagtaggcaggaaaccgctcccatgattcaattatctcccaccaggtccctcccacaacacgtggaaattacgggagctacaattcaagacgagatttgggtggggacacagccaaaccatatcagagggtgtccactgtcaaggacagctcagcaccaagcccttcttactgggctctggagtttctcagctgaaaactcttcttctttccatctccaattcctctgctcacttgtcttccagctaagtcacctccctgccccctccctgcacatgtcccggccccagctctctctggaatccaggagcaggaagtccctgtctccacctgactctacatcttaggaaagtgactcccttgagtcattgtttctgtgttagtaagcattgaggaaggaaaatacatcccttgggtaccagggagagaacagagggaggcaagaaataaactgaaggtgcccatcctagcacttggagccctgtcttgccatgcacgtaagcagagggtctgcaggagccactcagactggcagcttttcttttttattgtgctggggaagaaagaggttaaaaagagttctcttgctgtggaagtgtgtgacagggaccctcttcctaaggtgtcccaaatccctgcatctgcctggcctttgtcactgtggctgtgatgagagagaagatggtgaggacaggagataggaatgctgtgagctggcaagctcagctcggaagcttcagtgcatgggtgcatgatctggaagcttctgtgcatgagtttagccagaccttttgctgctgggataagagctgagtggggtgtgcagagctgccttcctgctgctaagcttattctatatgtcaccccttctagcctgagtcctctgttgcatcctctggtcctccagctgagttgagtgtagcatctaatttcctcaatcacctgaactctggccctgattggttcccttaccctcctgagccttaatttcctgcaatatgggattcacaatggcacctacttcctatgatgttatgcaatacaaatgagtaacaataagtgaaaacctggaattgtttggtcagtagaaaagtgttcaaaaatgtaatggtggttagtattgttgcctgcaaaatatctgacacagtgcatgcagtgaatacttcaatctgattctttcttcctccaggaagccttcctagaagtccccaaaccaggttaggactcttcgtaatggggttctgccttgtgcttcctacagggcttcttgagacaatctgctggtcattgttctgtctggcataatcacaaccaaagaatgttcaaagaatattcccccggttgggagagtgggagagggggtgacacgcagaaaataccgatgtgtctgtgagccacactggttaactggccctgaatatgaccacagcacagctcatagaaggaagccccaagacaacaggagaggctgttaaaatattaaattaatcatctctgtaattaatttgcaaaatatttcttcctctctggagttaagggtcagagaacgtgcttgtttctttattgctgtatccccagtgcttagcaggttcttagtgaacattaaatacttgaattaataaaggaacaagtgccctaattttagttttgtcagtcattcactcattctgtcatttaacaaacatttattgaacatgtactatgagccaggagctattgcaggctcttgagttacaccagtaaaccaaaacagcaaagatacttgccctcatggggcttaccttctagctaggcattgacacattgcctgttacctcagagggatcaatatacaatcatctcccctggaaccatcctctcttgattgagttcagctattcaaagtgcgaggtcagggctggatgcagaatcacccctgtaatcttagcactttgggaagccagggcaggtggattgcttgaggccaggataccagcctgggcaacatagtgagaccttgtctctacaaaaaataaaaaataaaaaaattagccggacatggtggcacttacctgtagccctagctacttgggaggctgaggcaggaggatcactgagcccaggatttcgagtccgcagtgagctatgatcatgttactaccctctaggctgcagtgagtcatgatcatgctattgcaatctaggctgggtggcagagcaagaccctgtgtctgaaaatataaaagtgtgaagtcaatagaaaacattacctgttgtttcagagtcaacagaaggcacctatacaaagctaagtgtggctacaaatgaacaccagctgctcataactggcccccagactccttccaactgccctgacatgcttgctctctttcccaggtcatgctttcagaacgaaaaggcacagatgagctctatgctgtgaagatcctgaagaaggacgttgtgatccaagatgatgacgtggagtgcactatggtggagaagcgggtgttggccctgcccgggaagccgcccttcctgacccagctccactcctgcttccagaccatggtaacttgtcccatggccctgggtattccacctccagggcttcaccaggctttggccaaagctatcttagcagcacccagcacagagatacctgcacccttccctttctagacacagaaagatgtaaggcccagggaagtcagctgagagttctgaggttgctactgagaaacgctctcccctgagacagatgctgtctcaacttagataaaggaattcaggcaactggttttataattaacagagcagggcctttctctgacagcaagcagtgacttggggacaggagctgggtgaaaaggttcacagcttgtggatctagatggttccattcagccctctagacctttggataaatgcacaagtacatctctgcaggttgcctgaggcctttgcatgggcctcattggagggaggatgttgcctgagaacacagccctcgaggactctcagggaaggtacacagtgtcctgggaaggagctagtgagttcagagccatggctgccaaggtgagaagggagcacttgtccatttgtccattttctgctcttgactgtgatttcaaccctatctgcaagagcaagagtccctgctttaagtaacctcttacctttccctgttcaaattagaccttggtttccatacccagggatggagaggccagagcccaaatgcaaaggggtacaaagttaattgatgccttttaggattctcagggccaatgacctggtgacttaagatgttttggggacttttcaagattaattttgactctatccagttctcaacttactgagtagagtgactgattttagagcccaacccatatatgagatgggacactacagtactttgcatctaatttgatgtctttagtgatttccctctcactttaattcttttcttttatctgttctattatctgctgaagatatcctgggctgtgtgacctgtagcattttcacagtctggatttcactgactgtacggtcttggggcacctcaacatgtttcctctgtcttctgtatttcgtgcaattggcagctggttctggaggcttggtcagactcagctaggatctctttggcaagaccatagatggtgacctgttctttcatctgaagtcgtataatggcttgttgtctctcatagtgaagttggcagcgactgatggttggtgcctagatctgttaactcattagggattgtaaaatggtgatatcctaattctatcatttatttttcatttactagtgagaatgcctttataaagaagggcctcccttcacctattacttagttccctagtggtatagttcctgtgagaaaggcaggataaatgcttgattctttctctttatttaatagttctcaagataataaattggttcactgttgtgctccaagggtggctaaagttggcttttttttttctaaatgggtctggctctgtctccccagctagagtgcagtggcatgatcatggctgactgcagcctcgatctcccatgctcaagtgatcttcccacctcaacctccctagtagctaggactacaggcacacaccaccacgcccagctaatttttgaacttttagtagagaccgggtttcaccatgttgtccaggctggtcttgaactcctggactcaagtgattcacctgcttcggcctcccaaggtgctgggattacaggcatgagtcaccatgcccggccaaagttggcttttaaaataaactgttttgagtggaagaagagacaatagaaagaaaaatattaagtgaatgataatttacatcatgcaatggagacttggcaaagaccaggaaaggggtacacctaaccttactagtccaaatctctagtcttaccatggggatttaaggcctaaaggtgttcaagtggtgatagagacaaggctgggatttaaacctctaggctcccctactcccttaccttctcccttttccattggttatccccagatggattcattgacatcatcaggcaaaggacagtctccgtccagtaaatcaactaagtaagaaagggaccttgtgcccagcatagaggctgagcagcagcagttttccattttagttggatatgttgagagtgggagaaatgaatcatgggtgactaatgttcattgtagtgtctttgtttgtggtttattattttaaaaatgattaaatagagtagatttgagattattcttttaatattgaaccaacctactcacctatatttcaatatgctttctggaattagagagtaggggctgggtgtacatggaaattttgcagaagtctgggtcccctccagggattgtcatgtgccagggaagagagactgagaaccaggagagcctagaacacaagagcccagtgggtttgggtcttgcatggtgacatgatttggctgtgtccccacccaaatctcatcttgaattgtagttcccataatccccatatgtcgtgggagggaccaagtgggaggtaattgaatcatgggggcggttacctccatgctagttatgatagtgagtgaattctcacaagatctgatggtttaagagggacttttaccccacttcgctctgcacttctccttgctgctgccacgtgaagaaagacacgtgtgcttccctttctgccatgattgtaagtttcctgaggcctctctagccatgctgaactccgagtcaattaaacccctttcctttataaattatcccatctcaggtatgtctaatggactaatgagaatggactaatacacatgggaatgaaggcctcccatgttggagaccaatgcaagtaattgaatcgtgggggcagtcacctccatgctagtcatgagagtgagtgaattctcacgagatctgatggttttatgagggacttttaccccatttcgctctgcacttctccttgctggtgccatgtgaaggacacgtttgcttccccttctgccgtgattctaagtttcctgaggcctctctagccgtgctgaactccaagtcaattaaacccctttcctttataaattaccgagtctcaggtatgtctaatggactaatgagaatggactaatacacatgggaatgaaggccttcccatgtggagaccaatgcagaatctccccaaccgacaagtccaaggatggaacagattgctttctcagttgttgagggtctgatgaagtctttaacctatctctagggattgtatcgattgaaagaaaaaagtgcttggagagacgcactcactgcaagcaagagaccctgagatgccaagtgcagttggctgaaggaagagcagatccccttccatctcacctgcactctgcgcatatgctcattgagtgaaatgctccaatttaaattattttttctcacttctttgtgggctaagcacatatattttaatgttgcataaattaaatttattttcaaagacttataataatgcctactatatgtgaggcacaaggcaaacaattttaagtctcttgacaacttagataggttctgtcatcattcccattgtgtagaccaggggactgaggccacacagctagtacatttcagggccaggatttgaacccaggcagtctggctttaaggagttttgcatttaattgctatgctctgagatctttttaaaaaaacatgtatatgtatatgtatatgtataagtatatgtatatgtatatgtatatgtatatgttgttgtgtatgtgtgtgtgtgtgtatgtgtatgtgtgtgtatgtgtatgtgtgtgtatatgtataagtatatgtatttttagagacagggtcttgctctgtggcccaggcttgagtgcagtgaaacaatcatagctcactgcagccttgggctcctgggctcaatagatcctcctgcctcggcctccctagtagctaggactacaagcatgcatcaccacgcccagttaatatttaaaaatattttgtagaaacagggtcttgctatgttacctaggctggtctcaatcttctaggctcaagcaatcctcttacctcggcctcccaaagtgctgggattacaagtatgagccaccacacccagcctgaagtcttttgagtgtggatcacccaaagaccactccacctgacacccctgggttagaatccctcctgcaggcctgtctccaggctccaccaggagcctgtgctctaatctagccatggtcacctctcacctgttcagtgaagccacactacctccacctcttagcttccctatctctgcataaaacttgatgttccatctgagcctctaccatgcatgggtcttcaacaacgttgcttcattccagcctcacaaaaatcttgcagtgaaagggattatctactctcccattttgcaggtgaaaggattgagaatcagggctgcatggtagttcttcctcgacacagcactgggtcattggctcattgagctcagagcccaagcttttgttagtacatcatgttgagttgccaccaaaatggccttgacaatgatgatacaaacaagaacaaaaagcagcagctaacagtaataggttgggcactctactcagcactctagctgtattatctcattttatcctcctgatacctctattggaaaggtactattactaactttaatttacagacaagaatgctgacattcagagaagttaagtaactggtgcactgtcacacagctgctaagtagtggagctaagatttgctctgcaagactctagaaccccaaacccggaagcctttgctaacctacctgtgccttaacttcacattcctggttttggcttatagaatattttcactttacagccaggcacagtggctcacacctgtaacaccagcactttgggaggtgtaggcaagtggattgcttgaatccaggaggtcaagaccatcctgggcaacatggcaagatcccatctctacaaaaaattagctaggagtgatgcacgcacccgtagtcccacctacccaggaggctgtggtgggagggtcaactgagcctgggaggtcaaggctgcagtgagccatgattgcatcactgcactccagcctgagctacagactgatactttgtctcaaaaaataaaataaaataaaataaaatataaaatattttcactcttacgatcacatctaatcttcacaaaagcactataagtattatggtccacatttctattcaatggaaactgacccccagaaagatgaaatggctcaagttccacaatcagtaagtggcagttccagggcttgagctcaggttttctaatagccctttgggtgttttttttttttttttttttaatactatggaagttactccgcttatcctacagggatattgcaaggattagataagattttatccatgggaatgattattaaaatttagggagcactgcatatacatgaggcaagccattgttatcatgactaaaatgagcaggaaggtgacacctctttctggggatgtccttgaaaatggtcatctggctcctgctcattttctagcattgcatggcctggatctgcagagcagggcttcagaggaggcagtggagctggaataggccatatccctaaaagggcattactgcctgtatacagagggtattactgcctgtatgctgcctgtatacagagggtactaatgcttattgattatttcaacaaagacttattcattgaaataattgtatcaggccccattgcatcaccatgatgaggtacaaaacagataaagtccctgtttctttggaatttacattctcttgggggagactgataataaactataataatgacacaaagtaaagaggatggagatggatggattggggcagagagatgctatttttgataggatcatcaaggaaggtctctctgataaggatgacatctgagcagagaccagggcaagcaagggagcggggcatgtggctatctgggggcagagtgttccaggcagcaggaagagtgagtgtgaatgcccgcggcatgagcatgctccgcgtgtttgaggaacagcgaggaggccggtgtcgccccggtggattgtcattttgtattttgtgacccagaattctttttgaatcagctacctttaaaaaaaaaagagacaaatccaatataacatgctgtaaatttgatgtttttctttctagagactcagaattttaaagataaaagattcttaataggctcttaaaaaatctcaaaagtggccaaaatactggataaaagtgaaagagacaaccagcaatgtacaaaaccattttttaaaaatcaatttttaaatgatgtaaattcgatttttaaaaacttatttaaaaaagcaaagttacatcagaaataatcttatattggaataaaaatatctttcaaacatatgcacagcacggtgttaacagaaaatgtaggatattaaatcctatttaagatattattttaagtgtgttaaaattgaatattcacatggaaaagaatcagaagggggcataaacaaatcaaaatattgatttgatttagggaggggtctgtggataagtgccttctttttgaacttacatcattgcagaagtagttataatatagttgtttaagttttttttaatgtaccacaagatggcaaagttaatatccaaatagatgcaaaagctcccagaagggggttgagttttcagagatttgctcattagatggtttaggcaaattgtcctagaagcacaaagggataataagcctgtactccacagtcaggtgaatctggatctgtgattgcttgctagatgacctctaggaagtcacttaacagctctgaatatggatttcatcatctttaaagtgggcataatcagggaggattgaaagagatggtgaataaaatataataaacatgaaatggaggttgccggcattattagagctggactggaggtgcaccttgctgcataggtacgaaagaattatgtttcttccattccttttgcagtttttctcagggacaattgtcagcccggcacattcatgcaatttcccaactgccagtgggcacaggcagttaagtttctttagcaaaacatctattttaactgttttcttttcaattgaacatatgcacctctttttttttttaaatagaattagattttatgagtcattgaaggacagaagttacttcctccccaaatttgctgccatggcccagcaataactcagttgcaaggcatgctgggaggaacgtcaattcagaatgcaagagaggacagggatggggtgaggatgattcccacatgtagagtggacccctgatggcccaagaatgagccccgagaatgtcccaggggtcctggtaactcgggctcagctctgggctggcagcagtacccaaggatatggttggacttaagggcattgctgcaggtggctctggctgttgtctcagtcagcagtgatcaagttgtaagaaacagaacaccccttcccctgccccccaccaaactggctccaatagctccaaaaaaacagagaagacttttttttttttttttttttttttgagacaggatctccctttgtcacccaggctggagtgcagtggtataatcatggcttactgcagcctggacctcctgggctcaagcgatccccctgcctcgacttccggagtagctgggaccacaggcatgcaccaccaagcctgactaattttttaaaatttttttgtagagatggggttgagacctatgttgctcaggctgctctcaaactcctaggctcaagtagtccccatacctcagcctcccaaagtgttggaattacaggcatgagccaccgcgcccagcctggagaggattgttgatgagaaattagttaatgcgtgcaatgtaccttattcaggtgatgggtgccctaaaagccctgacttgaccactatgcaatctatgcaggtaaccaaaaaaagaggattttattggaaagaaaccacccaaagacaaaggtgtacctgggcctcatgaggagctagaatctgtaatcctaaagcagtctagaatagatttctaggtttctttgtccttgctttctttgtttctcactgctcctggtaaacatgacttcgttagctccttgcagtttgcctatctggcaaattccctgcatttcagatcatagtcctgggaaagagaatctggttggttcagcttgggtcaggtgtttattcctggcccaatcagctggcaattggttgctactaactcactaggaaccttttaaaaggggttgtatctacagggagggaataattggtgctcatgccaggtgagaggcaccatcttgagtccaaggagactaactggattcaagcaggacatagttataggctagtggtacaaacatggcatcattgcctcccaggggaggaaactggtgagagcttggcaggtgttagtgctttagccaactaaagccatccaaggatcttgagtacaggaaatgaatcagaaatgcaacccaggcaaatagagctggggcaggtgggaatagacacagccttatgctctctgttttcttgatggtggcctttgcatattcattcaataatcaaagatctgtggaattccgaggaagaatagaggtagttctagcctttgaaaactttggcctctatgtggagggacaaggcttagaaagctgaaaacaaacaaacaaaaaagctagaggagcatcaattgcttgattctaacagtgattgcaaggctataaaatacagaggaagggaaagttgtgtgtgaacacatgtcattgagtgcacacttacttgggtaaggctttttgagtttgcatggacttgacatgcgtcatctgatgtatcttggcaacacccctatgaagaacaagctgtcattacccccttttgggaaggtagagactctaagtaactgacccaaagtctcagagcaagtatccagtataactgtgactagaacccaggactagctgataccagaaccagggctcttaaccacagcactacacagcctctctggagagaaacagatggttctgagcaataaagggatcagcttccagacgggatgaatccacagaccagcttggaaaatcattaaagatcattaaatagacaaattcttgcagcaacttcccttggagcatggtacatagagctgcccacgtggtcggttttctctgttcatggtatctgattaaaagtggcaagtgtccccctggcagtcacacaggcatcatgttacactccactttcagctgtcttaggggaagattgtctctttgaattcccttgcttcctctggagacctccaggtgaattctgcacctcccacctagtcatcattttaaatcagactatcctcatactcatgttccaaatttgggaaattctagccaaccattttgcataatgtagtgacagacagacatttagttttatttatttactgattatgagagattaaggagaaagggaattttaaattacctgaaggcacttgaagcttagagggcagcggtaatagtgtaatgaagaatcacaataacaatgacaattttgaagaagccctttaaagtcaagcagactagccagtttgaagagaaagatggtgagtttgcctttccgagcttttaattggagttgacggtggaacacccacgtagaaacgtcctgtagccagctggagctgactggagctcaggagagagggagaggatagaaatataagtcaagactcatcagcccagcgagatgagagttgaaattctgagctgtgacaagttcttcttggaaaattgagtaagtaggagagagccaatctggacttcaagtcgatacgcaagaaatactttttttgattttcatatattagagtccaacaaataagccctaatcaaaaaacactgagtgtggtgataaggaagattttgcaataatttcgtaggaggaatggggaacaaaggcaaatttaagggtgctatggaggggaataatatgtaagaattagaggcagtacgtgaggtccatttagttagccgaagcccccatagttcactctttatgcctctcatgcactttcttttatcgcattctattttatttatttatttacttttatttgaaacagggtctcactctgtcacccaggctggagtgcaatggtgcaatcactgctcattgcagccttgacctcctgggcacaagccgtcctctcacctgagcctcctgagtagctgagactacaggtgtgcgccaccatgcctggctaatttttttattttttgtagagccagggtcttgccatgttgcccaggctgacctggaacttctgggctcaaaagcaatccttccacctcagcctctcaaagtgctgggattgcaggcatgagcccctgtgcccagccacattctattttagattagggtttgaattagttgtatacttgttttaaccaagattctgaattccctgagggcaagcctgaaccttattcatcgttttcatccttttaatgcctgcctaatgccatgacttgcaaaaataagcgctcgatgaaagttctaaaactcacttctctgctccagattggctctggattgcctctgacaatattttccagattttgatgttgcttactgtggagtgggagatgaacctggtggtacatgaacacattgcatttatttttaaaataagtcatttaaaggattgatgtaccagagccagactggatattgcataaagatgatggactccagatatgcacttcttttctacagagaggatgaatttccatttatgactttagtatgaaatttaaaatttttaaaataattgtgtttaagttttttttaagtgagttaataaaaatacttttaaaataagtcaattttagtagaaaaggcagacaaacttagtaaagatttttttcttttctttctttctttttttttttttttttttttttgacacagggtctcactcttccccaggctggagtgcagtggcatgatctgggttcactgcaacctccacatcctgggatcaagccattcttgtgcctcagccttccgaatagctgacattagaggtgtgtgtcaccatacctggctaatttttgtatttttagtagagatagggtttctccatgttggccaggctggtctcaagctcttggccttaagtgatctgtccaccttaacctcccaaagggcttacaggtgggagccactgcacccggtccagatatgtacttgttttctatagaggggatgaatttccatttatgactttggtatgaagttaaaatattttaaaataattgtgtgtaagtttttttaacggagttaataaaaatatttttaaaaaataagtcaattttagtagaggaggcagagaaacttggtaaagatcttaaagctggttgggagacaagtcacgtttgggtggatggtcttaggcagtgcatcataatctggtcttaccctacctttccccttttttcttttatatgactccatgaattttactccccctctccagcaataatagccatcaaatcaggaacgtaagtgcttagttgtattttccacaatatacgttaaaacaaatacaaagccataaaggtgaaaccatcatacatccatggactacctaaaatgatctcctacccattttgggaaacacggccgtttggaaatttatctggcccctgtccctcgcctgggaatccttaacatctggcactgtggattatccacagaaacatctctggcaatagagttgctcctggcatagagtgggcatcattaagtgtttgttcagaaataaaaggacagtgagatgccaaccgtaacatttaatagcttaggcgctggtgtgttgaagccacatgctcagtacagttcaaagatgatagatcttagggtttccctgcatatggttagcggtagaaacataccacaaaacacgaccttacctacagtggagcgatcccctgatgtggggattccgactaatgagtctggggggcaagccgagttcttccaagcagaaagcaagcaagtgaaatctctctctcacttacttctctctctgtggccaatgccatctgctagctttaaaaataatttttaaaacaagtgttttggttctcttcaacgtgcagcaaagacagatgctatttttaggcttgttttctattaaaaaaaaaaaaaaagccaaagaaccaggggctgggtgtcggcagttctggcttactgtctgcattttgccaccaacttgtatgtgaccttttggcaaatctcctatgccttggaccctgagaatataagtgatcatttcacctccttttctcattagacatgttgagagggtgaagcagtattggtctgagaaataaaaaccattttctaaaaattagtcagtgtgggcaacatggcaaaaccctgtctctacaaaaaatacaaaaattagccaagtgtggttgtgtgaacctgtagtcccagctactggagaggctgagacaggaggattacttgagcctgggaggttgaggctgcagtgagcagagatcacgccattgtactccagactgggcgacagagtgagaccctgccacagaaaaaaaaaaacaaaaaaattggttaacttgtgctctcctgtaacctgccagcttctgtcttgatgtaccactaaatctccatgttccttctcttccatcctggactggaagctctttgaggggaggacacatccacacatccatacaatgtctagctcagaacctttcacacaagatgtacccactggaggcagcatcatgaggggttgagagtgtagagtctggaacccaatgcctaaggttcagaccctggctttgcagcagcttatcagctgagagaccactggcaagttacttaccctttctgagcttcaactttctcctctttagaagggagagaatgattatacttgtcacattgagttttgtagagggacaagtgagacaaaatatgtaaagcattcagctcatcacgtggtaagtacccaagaaagcttaatttcattattgttgttgttataattattaggcactcccacatttgataaatgcacatatgactgttacatataagataaagttctatgtgctgtatggaagatttttttaaatggtgaattaaatgcttgttatatggccagcatcatgttagacactctacacatgtgtccttgtttaatattctgtgggcaagtgaaaaatgtcccatctacaggtgaagagaaagcccaaaattagattaaataactgctcagtgttgcagttagtaagtagtgcaacaagacttcaaatactgtattgacttaaaaggtgaaatctttgcttcactttcccaccacctcttctcccggttttatagcccctcacaatagctttgcaacttttgacagcaagtcaccttttacgttgtgactcagccatagcaacatataaatataaccaaaacatatattccacaaaaagtacttagtggtgttctgtgcagcatgcactgataatttccatttcatcatttcattatttttctttcttcttctacttttttttttttttttttttttttttttttttttttgagacagtttcactctgttgcctgggctggagtgcagtggcaccaccatggctcactatagccttgaactcctgggctcaagcgatcctcttgcctcagcctcccgagtagctgggactacaggtgctcaccaccatgcctggctattttttttttttttttttttttggtagaggcagagtcttgctatgttccccaggctgttctcaaactcctagcctcaagtgatcttcctgtctcggccctgccaaagttctgggattacaggagccagccaccatgcctgacctcttttttctattatttttttttaagttgatcatgacccaccaaattgattcaatcatcaattaaagtgagatacaacttgagtttggaaaacacttgtctggcttcaatactcaggcagtattgccaggacatctcattttcatcacatttacagtttgcagccctgtgtatgtttcattccagcccctcagtcagtctgttagagattatcgcatatgttatcctcattttataaatgaagatatcaaggctcagggatgtaaaatggtcttgccaagcctccccagtagtcagaaaacgtggagtcagagctttgattccaaccttctgactgtatgaatgctgctttggagacccagtaactcctgctgcctcgaggatcacccatttattcacttaattaatgtatattgatggctcgctttggtcaggcatggtgctgggctgttggtacacagcggtaaacaaattttacatggctcctggatttgtggaacgttcagtcacatttcgcattagtccatttctttcagagtgagaccccgaacctttgtgttagcctacgtgaccttacatgatgcgtccctcagcaccaccctgggctcatctcctaccctgtcccccttcttctttcttctccaagcacatgaggtgtgctctagcctcagggccttcgcacagcctgtttctccgcctggtaagctctcactctcaatacctgcatagctgctttcgtcatctccttcaagtctttgctgaaggatcgccttctaaataagattatcctgaatactttattgaaactggaactcctttctcccatctcatccagctggtactcccaatcctccatactttgctctgtttttcccccgtggcactttttaatcttttagccttctatttttatttttatttatttatttattttttgagacagagtctcactctgttgcccaggctggagtgcagtggtgtgatcttggctcactgcaacctccacctcccaggttcaagcaactctgctgcaccagcctctcgagtagctgggactacaggcgcacaccatcatgcccagctaatttttgtatttatattttagtagagacagggtttcactatgttagccaggctggtctcgagctcctgacctcaggagatctgcccgcctcagtctcccaaagtgctgggattacaggcacgagccgctgtgcccggctatcttttaatattctatataatttatttattatgtttagcatttattgccttttctgtgtctacttgctagaatgaaagacaaaggccaggaatttttgttggttttgttcactgctctatcctcagcacccatctataacctggtacctagtaggactctgtaaatttgtttttacttgaatagatagatgaaataaataaccatcaagttcaaaatataattaacaaattatgatgtggtcagagattaaaaaaagaaaagaaaagaaaaaagcccacaggctttcatgaaagagtataacggcagacctaatttagattgggtgggttagaggaagtgacttttttaggctgagaacataagagggacttcagttcccaaattcgttagcgcagactctgccattgcaagccaaaggaacgtagcgtaaaggagagatttcacccaagcagaagtctctaagaagagataaagtgattcattcattcatttagcaaacaccctctgatggaaggagagaaacgagtcacatattggtgttgcccaagggccaaaacacacatctgacttatttaattccagcaacatcactgaggttctactattatctcctcttgacacacaaggaaacccaggtgttgaataacttctccaaatacatccagctattaagagacagagctggatttccaaatgaagtatctttggcaccaaagcttgtgccctttccctctctgggcacctgctatgtgctagttgtgctatcagaaacagggcttacacagccaacaagggcatagcccctgacttgaagaagttcacaatatcccttgaaagacatgctgaaaaacttccctgattaggacacagatttttttttgtccccagttcttttacttctggacatgccttcctagattactgtttttcaaaccttgataattcatctttttgtttttgatagccactatgttatctattggtgagtacctcaaaattcagtggcttaaaacaataagcatttattatctcagtttctgtggggcaggaatttgggaatgctttacctagttgatctggctctgggtctcaaaggaagctgcactcagattgccagctggaattttagtcatctgaagccttgtctcgagtgaaggatctgtttccaaggtgattctctcacaggactggagttggtgctggctgctggcaggaggcctcagttctttgccaaatgtaccttcccatagtactgcttgagcatcctcatggcatggcggcaggcttcccaaaaagcaagtgatctgagagagagcagggtggaagttgtaggtcttttacgcgctactcctggaagtcattcattgtcatttttgcagtatccaatgggttacacaggtcagtcctattcattaggggaaggtactacacaagaacataaataccaagagactgaaaaatcactgtgggcggggggagcatcataaaggctggctactacagctatctatcacctgtaacattatttacttaatattttccactttttgttaaaatcagccttatcctaaacaataatatcagttaagtcacaagattaatatgctaattgtattttccagcaaaaacaaatataaacttgtaattattattattattattatttttgaaatggagtctcactctgtcacccaagctggagtgcagtggcatgatcatggctcactgcaacatccccctcccgggttcaagtgagtctcctgcctcagcctcccgagtagctgggattacaggtgcctgccaccacgattcgctaatttttgtattttgttttttttcagtagagatggagttttgccctgttggccaggctggccttgaactcctgacctcaggtgatctgcccacctcagcctcccaaagtgctgggattacagctgtgagccaccatgcctggccaaagttgtaattattaatgaaaaaaattatctgtgtatcacctatgctcacttgcgtagttccagtgacacaaaccttacccttggggaaacaggaagcccagcaaacagggatctgtcagagagccctggtagttttcatcataaattccagctcttcccccactgtccatttggagccccagaagctacgggatgctaatgttgctgtttgctgtcctcttccaggaccgcctgtactttgtgatggagtacgtgaatgggggcgacctcatgtatcacatccagcaagtcggccggttcaaggagccccatgctgtgtaagtgagaactagtgctgtgctttctccttgggataaatgggtaggttagtggttcctttgagggtgtttttttgccaaagagggatctttaaacacctcgggcatctttttgaaaaaatatttagccagggaagaaaggtgttctgcttaatatgagatacttcttttttttctgacaccagctaagaacctgaagctcagacagacaccatggctcatacctgtaatctcagtgttttgggaggctgaggttggaggatcacttgagctcaggagttagaggccagcctgggcaccatgacgagatctcgtctctataaaaaataaaaaacttagctgggcatggtggcgcacagctgtagtctctcctaaaaataaaacaaaactcaaagctctaaaaccacagctatttatttatttctaattcatgtccctgactgcttagaaaggccctatatcttccttggggattatcattgtagattttatgtgtccatttgctaatatttattgagaacttactataagccaggccctaagtgcttaacaaacatcgtctcacttaaccttgagaataactctgggagggagatgctaccatccctgctttacaaacaaggaaatggagatgcaaggttttgaaagcttgcccaaaatcatggagctagtaagaagcagttcccaaattctgaccccggtttttctttgcccatgttctttatcttacaccactctccgtcttagatgccttcactccacgggggtgaaggatcaaggtgctcggtggcaatggtctgtggttcctgtgatggggagactgattctgggttgttggaaatgtgtttcctctgctgagtcaattccatccccttcggttcaaaaggcagctacagtctcttctttttagaacacagatttcatcatgtcattcccctgcttaggaacatggcaagttataggaattagcaatgataacctctcctggggagttttctaagatcttattgcctctccagagagcccccagagctcatctagaaccccaccttgtcatactagaggcttggtggctcctacccagttcagcttgccccctctcctcccacctggacaggttgtgagcactatgttctgataggatttgcattattcttgtgcttccaaatctagccatttgtatctcctggcatgactctaataggactagctttgcttttacttctaacatctaattgaccacaggctttaattccattgtcacacaagacatgtcaagacactttacatagttccccaaagccctgcccaacctttgtggcataactgggcttcccagttctcttgaaacctctttctttctgtgctgaccttcaataagaggttacactttagacagatgttgtttcttattccagctgcgccattcattcactatataacttgcccaagttaatctctctaaccctcagtttcctcatttgaggaatggggagatactagtaggacctaccttacaggattgttattaggattaagtcaggtaatgcctaaaatggtgctggggagatggtaaaccttcaacagatgttagctgctattgttaagataatttaacttgctatatagtctgaaagtataattctctcttttttgggggggtgggggacagggtctcactctgttgctcagactggaatgcattggtcctgaccatagctcactgcagccttgatcacctgggatcaagcgatcctcttgcctcagccttccgagtagctgggatcacaggcatgtgccaccacacccagttattttttttcttttatttttagtagagacaaggtctcactatgttgcccagctagtgaaactataatccttcatccagttcatcatatcccatgtccccttctccactatacaattgctgaacttctgcctacccccagtttgtccttaaggcaaccccatcaccctctaaaccaccctttgaatccatctgtactttcagcactttatgagctatatagctgaccatccatgggttctttaatgtcctacacctagttcaatattgtattgaattctgagcattgccaagcatatggtgtccttgagtttctccatcgctttttttttttttttaatttcagattttacgctgcagaaattgccatcggtctgttcttcttacagagtaagggcatcatttaccggtaagtgaacactgctgtactttccatctcttcatctccctcagctcctccctgccctgcctctttcttcagctgcttttaaaattagaatccgcggtgggggaggaatcctccagaactaacttgggcatgtgttctgccaggcagcatcgcccactgccctggcaaagtttgggcagctctatatggtggtagaaaatctcggtggactgtgtcaccaatgatggttcagagcctcaaacaggagactgtttgctctaagaggagactcacagagaggacctcagtacttctttctcttgcttgtggaccctacatttgaggagcaggcaaagaattttggctggcagaatgtgatggatcacattattatgaaacattttttatttatttatttttttctgctatgtaagtacaacttggaaatggatctctgagtggctgccctgaaagacaggattaagttcaggacttggcatttgctggtttttggaggagcaaatggatgatcatagctgcatgagtcataccattttatatttcatgcaaggcagacgattgcacccgaggctgctatttgtcagcaagtccagggcgtacaattctccttgtactacattgatgcaaatggcatagccagggcaggcttgggctggtttgttatgcaagagaggctgcaaggtatgaggcctccaaatagcatttggcatgggtgggggtctatttcaaagattatgaagaaccacaagagtctcttccattcatgtgtttgacacacatttatcaaatcctactatattctaggcactcttctgggtggtgggcatacagaagtgaataaaacagatgaaacccttgcccccgtggagtttatctttctcatggtgggagttagataagtgaatcataaaaacatagtctgccaagtagtgataagtactatggagataaatcaagcaggggagggtgctggtgtacactgggtgttggagggttctctctcattctgtagagagcatgatgatgagggcctggagagttaggggtgacttgagagtcctgggccttttgccttaactgcgggatatgggattaaaaggcatgagggggctgggcacagtagctagcacctgtaatcccaacgctttgggaggctgaggcaggaggggtgcttcaagctaggagctccagaccagcctaagcaacatagtgaggcccacatctctaaaaataaaataaaattagccaggtgtgatggtgcatacctatagacctagctactcaggaggctgaggtgggaggatcaattgagcccaggaattcaaggatgcaatgagctgtgatcatactactgcattccagcctgcgtgacacagcaagaccctgtctcaaaaaaaaaaaaaaaaaaaaaaggcatgttaagattagccctggtaagtacaaggcagatagcggaggccaggctatgggatgctggtaggatggagaaatgggaagtggggaccttgtcagaggctttcagagtcctggggcttttagtcacacctgaagtggtgatatggaatctatagggggaaggatgatcttattctgagggcacaaagtccccgccattcctactttctcctaatgatggagggaagaaggtcaagaagaggagtggttttacttggcatgtgggtgatcctagtgaaaatgtaaaaatagagagaagaagaagaatttagaagctgaggcaagaggatcacttgagcccaggagttcgaaactgcagtgagctatgattgtgccactgcactccagcctgggcaacagagcaagaccctgtctctaaaaaaagaagaatttaaattttaaatagtatgatcattctgcccatgcccatgtttgccctcaatgaacacgttcactatgtgtgcatgaaatggcacatggaaatcctctaattcccttagtttctcttttgactctcatagtgacaacatctttttgtgctgaatattattctggttttgaaaggtgcacatgaggctgggcgcagtggctcatgcctgtaaacccaacacatagggaggccgaggcaggcggattgcctgaggtcaggagttggtgaccagcctggctaacatggtgaaacctcatctctactaaaaaatacgaatattagctgggtgtggttgcacatgtctgtaatcccagccactcaggaggctgaggcaggagaattgcttgaacccgggaggcagaggttgcagtgagctgagatcaccccgttgcactccaacctgggcaacaagaatgaaactccatttcaaaaaaaaaaaaaaaaagtacacatgatccgccatatgacatgatccctaaattcaagccgatgacttcagctggtgcttaaccaaagagacaggcatcatgggtgatttttcactctacatgattttcaacttgggtgctgacattaggacctaactcctatgtgggatgtgcctctactaaaatagaaccaactgggttcttgagaagattaaatatggaactacaagtttattggaagaaaatccactcccattgtaggaaacaggagaggaaataattagtgttccggtcaattgagttgtgattcagggctagtttctaatcaatcaggaagccgcactgggatctgggatccatggatccggctcactggccaggcaggtggtaaaattaaaagattagcatttcaggtgctaagatgatacctattccaaagccccttttcctaaactaactacacactctccctttcatcttccactattaatatggtctttaaaggggtatttatcaatcttttaagccagtctgcatctgaacccttcttttgtgtatgtggaagaacagagtcaatcttctactataaataatgaaaatgacagatactcatttcacagcccacctgtagccagggcaggcacacaacccaagctctgacagttggtcatacttactcaagaccttgaatcagaaactagcggccaaggaagcagaaagcatagaatcaagagtgaccatagtaattatcagcaactactttccagaggcaagagaagagggtcttaatagcaataggcagagtccagcattagggcttcgtggaacaaggggtgatgtgtgtgtcccatggcagcttgggtggtggtgtcactggacaagccctgagttgcagttaggcattgtttcaggctgtatagactcttaatctggttcttcagtctcctcaaagattctatgagctccccaatatcctttgatgaattccttttcaggtaaaaatcatcatagttggtttttgttgctcaccatcgagaacgctgatggaaatagagttcttgaaattgatagtcaaatggaaatggtaaaaaataaattacttgacaaaagatgtatggttttatcatttcacagagattgatttcatagtggtaagatcttttaagatgttacaaatcactacctccttcatctaaatctctacttaattgaacagttcttaagtaaagaggatgaaggattatgttagacttaccatctttaaggaactggagatgttgggttgtggggtgggaagggaaaaagattcttcctatcaaacttagtgtctgatttactgaccactgtctctggaatgtgtgttggttttgcccttgatggttttctgaaaaatgaaaataatttctccatccaccttttgaagcagaaatgcggatttattacacagaacaaaagattagggtgtgatatcaaaacactgtatgtgacagtgaagatgacagaggtgccctccagcctcaggactgcctggctcttggcacctgaaacttcttttctataatagatgaagattttatcacttccctagtctacccagctgcctgcttctgagcatgtggtcgagctgaagggttgtcatttgtcactattagagaaatcacatatatcacatatagacctacctagtaagtttatgaaaagcaaattgctgcaaagcctgggttttctgagttccaaactttcacacaaatcatggtggcttgtagatgagcatgaaggctggatatgagcagcaccacggacagcgccaaaggcatggcgtgttgggattggcaaacatcagtgggcaagtgcaagtggacctccccatccctttgaataaggagaccccacagacacagataggagatgccaggatatagttttcagattgtattcttttagttggaaatgatgacagcaactcaattcaaagtaacttaggttaaaagaggcatttattggtgacataactgaaaaatccaggtgcagatctgactttaggcctggataaatgcagaggctcaagtgacgttatgagggcacattttatcaccctccctctaggctctgctttctctatattagattgcttcttttcatctggtgacccctggagtttctagacttccataataccacctgaacaaccccaatgtaaaatgcacttatccctttcctgattatgccagccaaagtgccagcactaatacttaacagctttgattggcccagattggatcacatgcccattcctgaatcaatcactgtgaccagcaggatggaatatttccattggctgggacaggcccacttgaccactgctggagccatgttacatggaagccatgttacacccatgttacatggaagaattgaaagagggtggttcttctaagaaatattagaatgctgtcatcacaaaacactagaatagacagaaccacagatgcccactacccaatcaagatgaccgaagggaaagatctgaattaaggaatagatccccctacctctcaggaaatcggacttccccatcttctattaggaccgatccatctctcagccttgctcactggtgcagaaatataaagcattgacattggagtaggtgtttagggaggaggaaagtgtgttgatattggagcaatcttgtgtgctaaagacctacaactgttccccaaaatatcaagctcttctcatcaacacagatgaaaataaaagagaatacagcacatatcctttaggttagagctcagatgtcaccgccttagacaggtcttttctgactgacaccctgcttaaagtgacttcctccaatcactatcttatgtcctctttattttcatcataccacttatcagaatctgtaataatcatgcttacagagtaattgttatctttttcccagcactgaaatttaatctgaagaacaggaggcttgcttatcttgtttactgctacatactatacctggctccaggcatagtgcctgtcacatagtaattgtgcaacattttttttttttcaagacggagtctcgctctgtcacccaggctggagtgcagtggcgtgatctcggctcactgcaacctctgcctcccaggttcaagctattctcctgcctcagcttcccgagtagctgggactacaggcgcccacgaccacgcccagctaatttttgtatttttactagagacggggtttcaccatattggccaggctggtcttgagctcctgaccttgtgatccacctgccttggcctcccgaagtgctggaatcgcaggcgtgagccaatgtgccctgccaaatgtattttgattcaaagaattgatggaaactcctgggtcatgtcctagaaggtggcccaagagatcagggaacacttagcattaaatatttctttcaatcagcttctttttttctttgtaatttttagagatattttaaaaaataataattttctgaaaaatgtatcttcttacaaaatataaggagtctttaagtggcaaaggaaaattcttggaattttcctggatccaagaagcgtcatggatgctctgccctttgcttaactttctgtggatctccgtcttttcagaagtgctgtctctttgtgtccttgtgagacacttggcacagttggctgtgtagaaaaagaaaagcacggaggcttgcggacctctttttatctccctgccagactgtaagctgttggaggtcaaaggctggtttctactgacctttgtgcccacacaacacctaacacagtgttttatgcataatgagtggctgttggttggcttgaaatgcatagcgtttaattaaatctctaaattcttgtgtctgccatagtgacctaaaacttgacaacgtgatgctcgattctgagggacacatcaagattgccgattttggcatgtgtaaggaaaacatctgggatggggtgacaaccaagacattctgtggcactccagactacatcgcccccgaggtgagagctgctgggcacacgttcacattgcggtgatgtaccctctgctccccagatggctgtgtgagagctgggaagggttgagggtggtaccttgcaagggaacctcggacagattcttattctatactctaaatcctccctttgagatcacacatgcaaattaatttagcacacatccagaagcccaagcccaaaatacatcaaggtttgggagaaaatttaaataaaacccaaaagaaccatccaacacacatcagtaaaattcttcgtcaaactgttgtggctcacggccatgtgataccgcctaattatgacattgaaatgtttgttgagagaaaaagagcatatcccctgggctggcatatgacatgggatctgtgtcctgtatatgtccctcagcaggaaaatggacaatagcccgtgatttatttatagcatgaaatactaccaggcaccaattcagaagagtgagttagatatatatgtagatgtgaaaagatcttcaagacacattgttagagaaaaaaatcaaggtacagaatgacaaatacaaggccaggtgtggcagctcgcgcctgtaatcccagcactttgggaggcagaggcaggtggatcacttgagcccaggagttccagaccagcctggccaacatggcgagacctcgtctctacaaaaaatacaaaaattagccgggtgtggtggcacatgcctgtagtcccagctacttgggaggctgaggtaagagaatcacctgagccccaggaggtccaggctgcagtgagccgtgattatgccactgcactccagcctgcctgggtgacacagtaagaccctgtctcaaaaaaaaaaaaaaaaaaaaaaaaaaaaagaagaagaatgacaaataacactatgatactatttatggatgaaacagaaatacacagaacactgttctgttttcaatgagtaaaagcatacaaaaatctggaagatttcaaactgattttataacactggttacctctgaggataagggaattgtaaagagaaatttagctatttctgtatactgctgacattttttacaaggtaaatgtatttgggtattacttgagtaataaagtaattctttaaaaataataaggctttactcggacccagtgaagttttccctatgtgatatgctttggtctattatcattttgttaattaattagataggacacaatccataacacaacttcctgataggccaggggttccataatctctggttctcaactctaacggcagtttagagtcgtgagggagcttttacaatgtaggatgcagctggggcatggtggctcactcctgtaatctcagcactttgggagcctgaggcaagaagatcgcttgagggtagaagtttgagaccagactggacaacatagtgagaccctaatctctacaaaaaaaattaaaaattcgccaggtgcactaggtcacccctgctgtcctgactactcaggaggctaaggtgggaggatcacttgagcccagcaggtagaggctgcagtaagcagtgatcatgccactgcaccccaccctgggcgactgagcgagactctgtctcaaaaaaagaaagaaagaaagaaagaaagtgtttccacacttttaaagtacttcaagtcttatttgatcctcatgacaagccaacaagttaatccttttacaaaggaaactagagcctgggatgtgacagcagttgccgaaggtgatgtggttagctcatgacaaagcctgacctgctgcttatccctcccatctgtgggctggaggggaggcaacttcaccagccacacagttgagggtttcttgtgcttgcctgaatcacgaccagcgaggaacttctgagaaccacagatcctgggcctccacctgcagagattctaatgggatgatgcttgggcatcccacattgtttcttgtgtgtgtgtgtgtgtgtgtgtgtgtgtgtgtgtgtgtgtgtgtgtgtgtgtttgagacagggtctcactctgtctactcactgcaagctctgcctcctggattcatgccattctcctgcctcagcctcccgagtagctgggactacaggtgcccatcaccacgcccagctaattttttttgtatttttttagtagagacggggtttcactgtgttagccaggatggtcgcgatctcctgacctcgtgatccgcccgcctcggcctcccaaagtggaaaacacgttcaatgagaagtgttctcctggaatgctttcccttccttgtcttgagggttacttctcagaatgcatttcattcattcataattgaccagtaaagttgtatacatttatcatgtgcaacatgttgttctgaaatatgcatacattgtggaatggctaagttgagttaattaacatatttattgtctcacatacttatttttttatggtaaaaacacttaaaaatccctcttagcaattttcaagaatacaatagattgttattaactatggttactgtgttacacgataagtctcttgaatttattcctgctacttaactgaaattttgtatcctgtaatcaacatctctgcatttctgattttggaatagaaatcaaagtgggagatagagatcaagaaacaaacattcactttatagccaagtttgctcaaataccctttttgagttaaacaagcaataactgaattataaaacattctaggattagttaacattttgagggcataatatgtgaaagccaccgagtatctcattcatcctcacataacttcatgatatagagattatagaagttaagtaacttctcctgtggtcagacagccaaccggtagacagcagtcaggattcaaagtcagactgcctaaccctcagacctcagcctttagcctttgctgtattacctcttaacctctgacatggttagttttacatccctgcatactgaaagatggacaatcacatagctcttctagacttttccatgttcttgcagtttgggaatatgaattaaaaacttcacaaccatatataccatatgatacaccaattctacatctaggagtttatcttaaggaaatacttggacagatgtccaaatgtctaattacaagaatatatgttacagcattggaagaaacctaatcaactggaaatttataagatagattttggtatatccattcaacggaatgctatgcacagataaaaattgattatgttcatatacaaatattaaattagcaaggaaaacttaagtgaataactggctttattaaagatctattgcccataatcccagtgctttgggaggccaagatgggagctttgcttgagtttgagatcagtctgggcaatatagagagaccccatccctacaaaaaattaaataattagcatggtggtgagcacctgtagtcccaactacacaggaggctgaggtgcgaggattgcttgagcccaggaggccaaggctgtgagctgtgagctatgatctcaccactgcactccagcctgggtgacaaaaagagacactatctcaaaaaaaaaagaaaagaaaaaaagaaaaaaaatcgtccaaatactaaagtgtttatgtaaagcacacacatacacacagagtttaatatgtattcagagaaaagagtatggaatgaagtagaccaaatattagtcataatttttctcttaataaaggattatgggtgattttcatgttattatctcagctgagctatcttttataaagaaatattaaaatagtgacaaatgttgttatctcttaaacgtttttatgtttaattatgttttaaaaacatgtaacgtaaaatttactattttaaccagttctaagtatacaatttagtagtgttaagtatatttacattattgtgtaaatgttgtaacttttacagaggagtaaagacagtttttccttttaaaaattccatgctcactgttttgaaaataataataacaatacaccttacttagtgcttcgaaaaggcaatgtgacagccacaggtgtttgcccagctgcaggtgcctctgcaaagcatgtctgtcattccctgaatagctaatataaagaaacagttcaggtgggcactggccttcttgtaaaagaagagtgaaatctgtctccagaagaaacatgaactgcaaacctccctgatagggtgccttctcttttctagataattgcttatcagccctatgggaagtccgtggattggtgggcatttggagtcctgctgtatgaaatgttggctgggcaggtaattgaattttaagtgatcgataagagaagtcctccctacccccatccacatggtttctttaggagaatgcatgtttggtaacagctcataaattggaacctctatgactttcccggccttggggtcatacaagtctgtggtcatttgaaagcctgggtgtgtggcttcactgtgggccccagggaggagggtctgccagttgaggggagctagggggagggttcaagcagggattcttctcctcccaccctcccctgtcatacaggcaccctttgaaggggaggatgaagatgaactcttccaatccatcatggaacacaacgtagcctatcccaagtctatgtccaaggaagctgtggccatctgcaaaggggtaagtgcatctcttaaagctgtgaccaggaccaccacataaaggcatgtgggctgtaccttgcccaagaacaccccaccaggggggaacacagcctgaactccacccttcactccatttgccaatatgagaaccctgatgtggagctgctacctcccggaggagagagagctttttttctgatttgcacagaagtgctgtagagagctgcctgcagctgcgtcttgctgctggctgggctgcagtctctgaaccagcacaggggaatgcttattgaatgaatgaggtagaaagcacagagattttgtcaaagagctggaagtcatgggaaagggcacaagaggtcttttgcacaactcaggctatcttgccctgctctgctgtatgtgtttagttaatactaagagcgtgcaacttttgttctaaaaaataccacgccgtgttgaggttaaggaattctctagataagcagactgaaattcaatgtactcaaaatcccactgtctcctctccccagacacacacacaaatggctaaaagggcatgcacgcttggacatctacggtttatgcacagggcacctgtgaagaaagcaggatgtgtgtttatggggaaggattgtttgttttgcatcttgtgttggaccagggcatactcacagtgacttctgtgagatcctaaagatcagcgaccctcacctttggagccatcaggataacccgaagtgccttaccagaatgcacatgcttctgccttaccccagagattaagtctgggtatgagtattttggaaaagtctccatttggcttgcagaccactgcctttaaaaatactgtccaaatgaagtgatttttcaactctgatggaagcctgaaagcaatagaattagacgcccagaaaatatgttctacacataatatactaataaaggatttgctctccctccacccagtggtacaggttagaacatggccgtgccttaatcagtgggttcccacctgtgtgtctgaataaaccagggctgccagtcctagatctgtgggatgcttgcagacttttcatgccctactttgttcttcctgaccccagccagatgctggatgcactgtcttgggtgaaggaaagctgggaaactcaggcaggccaatctgaggcttggcccagtttggaatagctgggccagcctctcagcctaaaagcgccttgtcacactgcctaaattcccactctcaatgaatcacctaaggtttgcacctcagctgcataggctaagatgcatgtatccctggggaaaccacctgtgaattagtctcaatcccgaacatctaaagtgaattgcttgaaaatattttctttgagggtgtgaggcagggagaaagaaagtgaagaatagagaggggagtcccagaggtgcattaggaacccaagcaaagcccataaagaaaaaaaaggcacacacgaaggcctccacaggcccccgtagacaagttattgaagggtgggggcgggtagagagaaggtggtacctggagcttttagtttgtttaataattaccagcatataaggatccagagatttctcaaaaacattcagctttcaggtttctcttgaaaaatcagatcttgccacattggcctgtcattcttacaaagcaccagtcagctggattggaaaccatggccctctgtagttggagcttgccctctgtaattctcagacgttctcatttggccaattctctccaagttcaaatcctggttcaggcattaattgccgcaggaccttggggaagttgtttgacggcatctgcagattggggataataatagcactccacattgggttctttgatgactaaacagctgaatactgtaaatcacttagaatagaggctggcactctgctccaagccccttggaagttattattactattactagtgctgacgctattgtgttatctgccaggttcctcttggcatttgagtttgcatcccctggaattgcaacttttaaagtaggggattttggagatcaagggaccctttgcaaatcttgacccttctactttctaggcacaaggtgtttttgttttgttttgttttgttttgttttgttttgttttgtcaatgtctcgctctgtcgcccaggctagagtgccgtggagtgatcatggctcactgcagccttgatctcccaggctcaagggatcctcctgcctctgcctcccaaagtgctgggattacaggcatgggccactgcacccagcctaggtgcaagatcttaagccacttcctttgcatctctgggcttctgtttattttaaaaaatggaatagtagtactcattgaaaagagtttttgagagcattaaatgagataacataagagaaagctccttgcatggtgtgggcacatagtaggtgtttaatacatccacagggtcctccccttcacacgcccgccctgcctggacagctgggggttctaaatgggtcatggaggaaagagcattttccaggtcagctgccttcagctcctgctccaattagcagtttccctggtagagccgttttctattaattcaggacccataaccttcatgattaactggggtgactctcttactattgagtttggggaccattattaattgagtgggctgagtccaatggggctcttccttcaaggagggtactccaaaaacgagtgatgctcaagcaaacagccaaatgcttcctctggaacagcgagccccaggggatacgtctgggaggtgatcagagattggaacagtgattaaatccagctgtctacatggcttcgggcacattagagcagagtgcgggaactgggcagagactccgaattaatgctggatgtttttgcagtaccttttctttgcttggcatcctcctgcttagacagaaattcagttgagcttttgaaaacagtcacctgtttaattgaagcagtgtcctttatatgtccattcccttaaaggcccgattttctactaaaaaaaaaaaattagtaaaaccttactcagatggctattcccactttgaacaaacttgaagcaaacagaagcccaaatagacaggaccttagggtgaaaaccagcagacactgaacagctgagactgaacataaagctataagagtcctgagccaggcagagctgttcaaagccttgccctgctccttagctgtttgaccttaggcagatgactttacttctctgcacccacatcctttacctggaaaatgggggataatagttgctgaggccttagagtattgttgcaaagtttaaagagtaatgggtaatggccgggaagcctttagcacggagcctgaacgcatatgatgttgtcatactcagtacacggaagccgttattgatgttattatcagtgtgaaccaaaacctcactgccctttctttcctcccatcctaatcttacacaaatgtcaagccttggctcaatttcctcaccctccataaacctctcctgacaaagccaggccacaaaaattcctgagaaaaccacgtgtgaaatgcactcccatttttcttaaaagcccaagttttagagctaggcagaggtggagtctgcacccagctcttactgactctaccacttcctctctggagtccttactgttcctcaacttctctgagtgttcattgcctttttattcaaatgggaaaaatagtatactcacctcattgggttattatgatgatcagggaagctcatgcatgtaaataaagaagtagcagctcggcgcggtggctcttgcctgtaatcccagcactttgggaggctgaggcaggcagatcatgaggtcaggagatcgagaccatcctggctaacatggtgaaaccccgtctctactaaaaatacaagaaaattattagctgggcatggtggtgggcgcctgtaatcccagctactcgggaggctgaggcaggagaatggcgtgaacccgggaggtggagcttgcagtgacccgagatcgcgcctctgcactccagcctgggtgacagagtgagactccgtctcaaaaaaaaaaaaaaaaaaaaagaagtagctagcttagaatgtaagtgctcagttaatttccccaccctggaggatacactttatatgacaagtacatgcttgtgtgtgagaccacaaattatcttgcgagggggcaacaggctgagtgactgtccaacagtgtaggaatgaatttctgggttcattccttccccatcatcagcaagtcctgggcagaagattctgccatcatgggcttctcaatgtgatgtcaactctggaaagcttttggacttgtatgcttctttctttttttttaattaatcaccaactcttctgtctttactccctgtgcatttgctcaagtcttgagatcagagatattttcatgctgctttggactcatttacaagaggaagcctgtctggtttcatcttggcgcatctattcatcttgttatttagcactcagagacccaaagatggagggttttgataattaagtaatttaaacggaacaccaaagaaacctcagcggctttgtgtgtaatgtatgatacaagggaaatgagctgggctaggttttgactatttaatgggctttcagaaagtaattacttgaaacttgggcccctttgactaatactttttcttctgttttgtcatttttgcaagtgctttactgagaaatgcaaatggtatctgaatgaatgtagcctttgcttttgtcaaactccagttttcttgttgtgggaggagggaagtttgaagatattgaaactgtcctaattaaatgcactggtaattgcacaaaacttattcttaaaccaaaatggataaatggatcatgtggcatttatttttttctttctgtttttttttttttggttgtttttttggttttgttttttttttttgagatggagtctctctctgtcgccagactgtagagtgcagtggcgcgatctcagctcactgcaacctccgcttcccgggttcaacaattctcctgcctcagcctcccaagtagctgggactacaggtgtgtgccaccatacccagctaatttttgtatttttagtagagacagggtttcaccatgttggccaggatggtctcaatctcttgaccttgtgattcgcccgcctaggcctcccaaagtgctgggattacaggtgtgagccactgtgcctggccctcatgtggcatttctaacttgaagttcacggccacattcaggcttcgttttgattaaccataacagatgattggcagtgggtcctattatcaggtcctctcctgcaaattcctggctgggattttttgctgggataaaaagcaaaaaacaaaaatgagttgagattcttcatttgcgctttctttcctaatgcattggagtaataatttctgagtgtcttacatttcctcttctgaaactcagcaaattcaatgtttttctttctctcgaagctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctgtaagtagcccattctctctgactgccgggtattcacacacaaggtattcttgcctgtgcctcgtgttttccaaatgctccctgaggggtagacgtcaatgtgtctactggaacatgggtgtatgtattcacacatatgcacaaaatcactggttactaagatggacattttccattggcccagcttagtctctataaagatggaaacgacgatgcctattgaatttttgtttcatcgattcaattattgtaactgtcttagctgacaactttctgagaatggttcttgggtgagcagagttcagatccatttttggactgtgataaaggatctaattttgccctcattctttctcttggttcaactgtgtcattttttcttcatactgacattgaaaaggtcatgttgtttatctcaacagtatttaaatttaattctgaaacatacactatgtctgagtcagtaaataagatggcagttcagcagccagctcccacccaaggcaaaacagagtgaagcagagactgaagtcctcttgaactgaagaccccctccgggagggtttgggtgtggagatggctttgacataagttttataatgcaagaataaaactctcacatttcccacagtccatgtaccaacaggaaggttttctatccccaaagactcagcaggaagtacttgtcggcatcaggaaagaagagtttacacctgaattaatcaaactgttattctgctgggaggatatttccttgtgaaattaaatagagggcagacttggtgactcaatgatgggttgtaaaactactgactgaggctgaagagtgaacataaacaccatcattgaaacctaacgttgtaagggtttgagtgttaagatgaagaagataataatggtagttattttgatactagtattgttattcatttcttgagcacttacgtgctaggcacgtaatgataatagttttgacatcagagggttgttatgatgcataaagcactttgtacaagcctggtacagaggaggcactcacagagagctgatcatggttttcgttagctgtgtcatacattaattaatgtcccggtgtagagtctttgaggggcagaatcctgctgctgctattccttaagataacatctgtgtgtacattggggtcgaagagggccccacatgtcatgagcagcatcacagcttttatgggaccatttggaaaaagatgaaaaggtaacctggaaaggaagagtgagctctttgttcaggaaacagggaactcagaggtgagatgcataactcatatggtttttgtggggttatttatgagatcttgaaatgtggacctccctttcctctcttggccagatgcacacgctcccatccccaccagcatagaacccagcggacatctgggggtcatgttatagctgtagtgcagtggtttgcaaagtgtgctgtctatcagtatgcagtatcagtatgcagtgtcagagccagcggtattgacatctcctgagcactttaggaatgaagttcttggtctccaccccagacctcctgaatcagacactctaggtgtggggcccagtgttctgtgtttaataggctctccaggtgacttgatgagctctcaaggttgagaatcactgctgtggagtttggcattaggagctcagccagggaagctaggcagagaccagagggaggtagcatggagaatcatctccttttttttctttttttaaagacagggtcttcttctgttacccaggttggagtgcagtagcgcgatcatagcttactgcaacctcgacctccagggctcatgcgatgctctcacctcagcctcctgagtagctgggactacaggagtgtaccaccatgtctgcctaattttttatttttatttttaaataaatggggtcttggccgggtgcggtgcctcacgcctataatctcagcactttgggaagccgaggtgggtggatcacctgagctcaggagttcgagatcagcctggccaacgtggtaaaaccccatctctactaaaaaagtacaaaaaatagctaggtgtgatggtgggtgcctataatcccagctatttgtgaggctgaggcaggagaatcacttgaaccgaggaggtggaggttgcagtgagctgagattgcgccactgcactccagcctgggcgacagagtgagactccgtctcaaataaataaataaataaataaataaataaataaataaataaataaatgtggtcttgccatgttgcccaggctagtctcaaattcctgggctcaagtgatcctccaaaaacctcagcctcccaaagtactaggattacaggtgtgagccactgcacccagccaagagaatcatctctttaagtggaagacactggtcctccttctagtcagggcatggggtgatggcttccagaagaggtcacagactcagatgcctacagaggccaagcagataatatgaatgagggaagagggctggtgagatagaagagaaagtgttggagatcgatgcaagccagagagcaggtgatctacctaacaggctcagctgatgttcacctcccgatggcctgccccgcaggatgcagcctcctcagggctgctccatcttcatggtatttggggctagaactcggtgctgtgggatgcagcagacctgtgagttgattgacagatcctgttacagtcagtgtagtatgtaggccctgtgtagtaagggcttagtgaaagggtgtataaagttaagatgtttatataaaatctcacaattttggctgggtatagtggctcacacccgtaatcccagcactttgggaggctgagccgggcagatcacctgaggtcaggagttcgagaccagcctggccaacatagtgaaaccccatctgtactaaaaatacaaaaattagctagatgcgatggcatgcacctgtagtcccaactacttgggaggctgaggatagagaatcgcttgaacctggaggcagaggttgcagtgagctgagattgtgccattgcactctagcctgggtgacagagcaagactccgtctcaaaaacaaacaaacaaacaaaaaaacaaaaaacaacaaaaaaaaaacctcacaatttcttttatatatcagaacaaatttttgaaaattaaacacagtttggggcaaataaaacacacccacacccatatgtatcccatgcattgttggtttatagcctcaggggtagtgatggttcaaagtcaggttgctatttagccagcatctgttagcaatggttatttacaaccagagtccattttgaccggttaaatattttgaatagccctgctaagcagtaatgaatataagaggtctagcctcgtgcctggctcatagaaagcactcaggaaaaggtagctgttattatcattgataatataaaaagattacaatacttagtcattatcaacgagatccctcaactgttctgcatttgatatgatttcccactgacctgtgtcttgaattcctccatgtgggtttaacaatgactttcaaagtacagtgatcaggctgtgctacatacttcaaagtgttctggtaccagctctaaaggagcaggtgctaccttcagtctccttagactgaattagaaataataataaatgatacattatccaggtacagtggctcatgcctgtaatccccacactttggaaggctgaggcaggcaaattgcttgagcccaggaatttgagaccagtctgggcaacatggcaaaaccccgtctctacaaaaaatacaaacgttggtgggcgtgatagcatccacctgtagtcccagctactcaggaggctgaggtgggaggatcttgatcctgggaggttgaggctgcagtgagccatgatcatgccactgcactctagcctgggcaacagagcaagaccctgtctcagaaaaaaaaaaaaagatacatcacctacccatttgatccagcctgcctgtatgccttttacattgcaaatgcattgcatgagagccctcctccccccaatcccaggattttatatttctccttcctcaccccttcttaactgtctgccacttccaaaaggcccatggtgagcgtgtgcagagttccatgtgccttgtgggatgtgaaaaggcatgcatgtatctgtcagcgtttctgattcatgcatgctattaaatagagtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcctggttgtgtgttgcttttgctttaaaacacccaaatggctctctgttgccccagtctcgtatctattgctccttggcatatatggcttttgaggtcttccagtgctagatctctgtcctcttcctagctttagctcctgactccaagaacagcattcctgggcttctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctactgtcccatcaagaaattcatcacaggctgtaataacatgttcaatctcatgcctgtctttttgactactttaagattgtgactttctctgtgtcaaatcccagtgcctagcatagggtttagcacattataggtgctcaggaattcttactgaatgagtgaatggccatagaacaagatgctgtaacacagtgtgctgtggaacataaaggagtcttttgggatatatattagagtgcatggtgtttttcttatgtacagcagggtatcgcaaataaattggttgttgtgtaagttactaccctatttataaaggactataatttggctgctgattttgcaaactgtcatggcatcgtgtggttttgcagtgtgtgctgggagagggtgctggtgaaggatctgaagaggcaatgcattgaatcacaggactttgggtagagagatctgcagcttcctgcagcctaaccttgcacagtccaatccagtgttacagatgccatgatgtagccctgcagagtgtcttaaattttaatgtgcatgcacgagtcacctgggtatctggctaaaattcttactcagccagtctgcggtggggtttcagattctgcatttctcacaagctcccaggggataggacactgtggggccagggactccacctttatgtagcaggggctagaactcagtgctgcagggtgcagcaggcctgtgagttgattggcagaacctgttgtagcagtgcagtaggtagaccctgtgtagtaaggactgtagtgaaggggtatatacagttaagtatagaatgttctggtgaagttattgttcagggcacacagcaggctgttgctggccagcatgtggtaggaggaaggtggtggtttgggtactaaagggcagactctgtcgctgagtgcatgatggagcagtggcttgggaagaagcgtgtgctggttctgtcctctggtggggatgttgtcagatattgagttatccattcagtgggtgatgaggttaggtaatgttctaggtgatggaaacatagcactaaaaataattaacatccctgccttcatggagcttatattctagggagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgcaggtgcctgagccaaggggttgagggagaaaggaaaagggggtgtgagatcagagaggccaaaggaaagcacaggccactgaaggatctttggcttttacaccaactcatgagccaagaaataacatgttctgactttgggtttttaaaggatccctctgagtgctgcagggacaagggtgaaatcagggagactggttgagactcttgccataatccaggcaaaaggtgataggagcttgggcaggttggggctgtttgagaacccccaagttggcatcctcaggtcctccccagttcctggcatcttgtaggcactcagtcattgtctcatggagacatgaaggcgctgatgaacatgagtccctgcagactgcccacatgattgctcctcaagtataaaacatggtagccaagagtttggtcccagtagcaataggatgaatgaatgaaatagatggtcaggaaagcttctgtgatacagagcgctggcttgcagggcatagagcaggaggacatggttgtgctcttggttggacttcctcctgtccatcctgttgcaaagaatgtagtgatatcggagggtgcagtggctgagggctgtacccagggagttgctttgtgtctgggtgatccagctcagaattttgctgacttgtagcaaaaggtgcattgagcctttggcatggatgagcatattttattgcagaagtggtagtacatggagctataatgtcacaggacaagatatgctaggtaatatgttcacattgaaatgcctaatggagagtttggtggcattcatgtattgtcacgaattggcttaatgaagtcctgtcactcttcctctgaaaggctcccatagtgtccataacacctaatgaagggcttactgtgaaaactgggtagggggatgagcccagggtacaaggattcagccgcctcagaagacaacccaggtagcagcatagaagcagtgaggtgaagaggaagagaaagctaagtaggcttcattagagtccttggagtcttttctgctttttatttatttgttttttcattgtttttaattaattgcccaggctggtgtcaaaatcctggcctcaagtgatcctcccacctctgcctctgaaagtgctgggggttacaggcgtgagccactgtgcctggcacctgtggagtcttaagcgctaaagtgtgtgtacaatgatctgcccagtagtaaacatggctctagtattcttttaaaatattatcaatcagatcatcaattgttctaaaatatggtcaaccagattgtcaagtgttctaaaatatgatgcatctgatcgtcaatgctctctgggcagggcttgaggagtacaacctgatgagaagcagacgttaagatcccctttcctccactcctgacattggagcaaccatccagtcctgtctagacatcactacaatgctcattccctccttccttccattctagcctgtgtcaggcctcactaactccaaacccacttgtatgacagactgattccaatcatttctgctcttgttaccgattcttatctgcactttacttaaagccccataattttgaggcatctggacagtaggaaaggctgaaaacctggcaagcttttatagcttgcaaaggtccttgtcctatgctctgttagtatcatttccaaaatactacttgggctatctgatcacatcccattgcccgtatcctctgagagtctaaatgctgaactgcttcagaaactaaatcatactcacaggacttggtttctcagcaattttatcatctgaaaacattgtttatgtagctgaggtcaaaagcttcaagtactgctttaatgagctgcgaatctgttcatgtgacattctcttccaaacccaattgccctttacactgtatgagtaagtgcctctgtgtgtgtgtgtctgaatgtgtgtgtttgatgtgctgacatttctgaattgaatccagaaagtgtaacctttgtatgtttgctgttaaaactccaaattcaagccttaagaaaaggatctaacacttactcaatgtgatttatttaagcacagaacctaactcccccaaagtatcaaatactcaagagaacaattcatttttgaaaattgtgatttaaaataattctcataaaacctttactgttcaaatatattagaaaatatattgcatttttgtctgcatcaggcactgttttaactgccttccatgaattgcctcatttaattctctcaaccctgtaaggtagggttatcaccacagtatagatgaggaactagagcttggaaaagttaaggcatttgcccaaggtccagcaactagaaagcagaggagccaggacttgatccctggactgtacactgcacaagacccttgtaaagattattagaagcacttggagcccctggtaaggtttgtgattgtgctaccaggagagtcatgataacaccatcgaatggtgtctgttacataatagaaaaagactgagtattcttacaattcaaatgatttaaatttattttaaaatattgcaacaaataagtagcatcttcacagcttttataattcgttgtcaggattttaaaagatgcaaatcttatttgttccttagggctttgattttgaggctgacaaagacggcatgcattgactaacctctgaaagaagggcatggcagcattgaaatgaggcagccgagacaggctcattaaggagtagaggtttccctgctcatttctggttgttcttttggggtatccactgtgtggagtttgcagagatcttaataaaaatatcaacctacatttatatactgacaaacaaatagccaagagccatttaggacacacagcttggagtctgtttatctctctccacctatctacacacccatggagaacccatttaaacttcagatcaaaccaggctccctttagatggttggaattgtcaggttcctgagccaggtgaagttcctaaatcagtttctgtcttagtccatgttgtgttgctatgactgaataccacagactagataatttataaagaaaagaaatttatttcttacagttctggaggctgggaagtccaagggtgaggggcttgcatctggtgagagacttcttgctgtgtcatcccatggcagaaggtgaagggcaagagagagtatgcgtgcatgtgtgtgcatatatatgcatatgcatacatgtgtgtgcacatgcaggggaaagatacggagccaaactcatcccttttattaggatcccactaccaagataatgttgttaagttctcatgaggtgccacctctcaacactgttgcattggagattcagtttctaacacatgaactttggcggggcaagtcaaccatagaacctaccagatacatgactttgagtcatgtactattatattattatttattattattattgttattttgatactggtccatggcccagggattggggatccctgccctaaatcgtgaggaagattgaggcccatgggtgccactggttggtagccgtcagcttcttaccacctaccggcacctccatagtcatcttgacctccttgcccagcttccatctctgtcttagcaaatatgttttccctcccccaactcatgtgagacttaccctcactcctgctctggactccagcctcttgatccttcatgcttatctcccctgtttagtctgtctacagcttctctctgtatcaacaaaactcctatggtttcaaataggaatctgatttaaactgacttttaagcaaaaaataatgatagttagtattcagatgtagatggatcatctacatctggtcccaaacaatgccagcagggaaacatttatctatatcccttaggattactttccccactgtgttgacttcattcttcattctcagaaggctttcttgggcacatagcaactcccaatttatgtcccattatctctgcaacttctaccaaagaaaagggcttcctttttataaaatcccagcagcctaggactcaatctttttggaagattattgggtcatatgcccatctctaagggaattgctcactgcaccagggggatggaatgtgctgattgaccgggcctgggtcaccagcccctcttagccagagagctggatctaatccagacattttgaaaaaagagaaggaatgtcctatctaaatcagacattttgaaagaagagaaggaatatctcctttaagaaaaaaaagccactgtcatggccgggtgtggtggctcacgcctataatcccagcactttgggaggctgaggcgggtggatcatgaggtcaggagatcgagaccatcttggctaacacggtgaaaccccatctccactaaaaaatacaaaaaattagctgggcgcggtggcgggcacctgtagtcccagctactcgggaggctgaggcaggagaatggcgtgaacccaggaggcggagcttgcagtgagctgagatagcgccactgcagtccagcctgggcaaaagagcgagactccgtctcaaaaaaaaaaaaaaagaaaaaaagaaaaataaagccactgtcactagaagaaaagacaatgcctgctggctgggcaaaaacagcagctgtcctttctgactctatcctggccttctcctttgtgcataaacctgctatgtctttttcatgttaaaaatcccctacctcaaacctgggaatcctccttactactactcttactactgctatgattactaccctaccttactttgcatacaaacacacttttgaaagagttgccagttcctgctatttccacttgatgacaatttattgtttcctcagtttggtgcaatctggcttctgctcccgccatcctattgatatttttctcattgagtcatcaatgacctgaaaactgcctcttctcataagcttgtctcatctttcttgacctcaccatattattaggtgctctaatcctttctcctttaaaaaaatgtgaaaaaataaaatattcaagcagcatcagaagctacaaagtgaaattaagattcccctcacccatggctcctagctaggcttcctggttctccttcccagagacacccattgcaaccaggttcttgtgtgaccttctagagaagatgtgttcaggcccagaaatagtctacatcacacacaaggatgttagcatgctgtgtacaatttctgtatcttgcattattcccctctgtcttggagattgtttcttatctgcttatctaactctacatcaccctttgaataacttcctagtttcctatataagtgagtttatctgtaggaaaagttcagagtgccttctttctttttaagcccctcttctccttcatttttatgacattgtgtgtctgtcttagtctgttttgtgctgctataagaatacctgaaactggggcctggtgcagtggctcatgcctgtaattccagcactttgggaggttaacatgggcagatcacttgagcttgagcccaggagtttgagaccagcttggggaacatggcaaaatctgtctttacacacacaaaaattacaaaaatcaaccaggtggggtggcacatgcctgtagtcccagctacttgggtgactaaggcaggattgcttgagcctgggaggtcaaggctgcagtgtcgtggtcacagcttgctgcagactcgacctcccaggcttaagcaatcctcctgctcgagtgacagagtgagaccctgtctcaaaaaaaaaaaagtggataacttacaatgaaaagaaatttatttggctcatggttctggagggtgggaagtacaagatcaggggctgtatctggggaggaccttcttgctgcatagtaacctgatagaaggcatcacatggcaagagaacacatgagggagggtaacttactttttaaataaattcactcccacaataataacatcaatccagtcacctccaaaagttcccacctctcaacactgttgcattggggattaagtgtccagcacaagaactttgggagaacacattcaaaccatatcaccacatttgctgatgttcttcctaccttcacagccactcccaatagaaattccaactccacaaagacttccagtgacagttgaatttggagggttgagaccagctcatgacccagaaaggaaaacagaaagcttactttttgttttgttacaagtgcagtctcttaaaaataaccacaaaatgcccccccaaatggcatatggaaaacagcacagagatggtgtgttaatctacctgaaatgtctttctaaggaagtgaggcttggatgggaacggaaatgcatccctttttcttcccagggtacacgtctttttctcacttcctctaactgggagccccagggcctggctttgtcttgtagcttcctgccgtgatgcaccaggctaagtgggaaggtttctgttctatgtctaaagtagcactggcaggtcctcattctgcttgtaattgggatgggaatatgggtaggaatttagggtttggcagagcgtacaggacctctttcaagccagagcacagccctgtcagacttactcactggacatgaatgggtcagtcagccctcagcagtaaccaccagctaccatgttaagtatttgatgtgaattttatcaagtcattctcgccacaccctacaagaaacttgagcttaggggacttagctaacttgcttgaaggttgtatagctgggaattgttggagccaggattggtacccaggttagcttaacttttaagtccgtgccacacaatcagatacatagtatgaggcaatgggatgtaatggaaagcccatgggctttggaattgaacagatgggctctggatcttggctctcctacttgaccctatatgaccctgaacaaactgttaactcttaaaattatctgttaagtagagataatccttttcctgcctatctcacagccttgtgggaatcaaagctataaaaagataggcaaatagaagggataattactatttgagggtgagtttacttgaagccaacaatgtgggtttaggatgaatggtgaagaatagataagaaaaaaaatgatattctgttgacatgggaagatgtttagagtgtatttcatctagtttcttttaaaaagcaagcaaaagaacagagtcatgattccacctttgtctaaaaactaaaaaacatccattcatctattcatccagccatctaggatacaaaccaagatgttaacataatacagagatttggggtggcgggattaagaaggattcttttgtgtgttttaaaattttttatggccaggcacagaggctcatgcctgtaatcctagcactttgggaggccaaggcgtgcagatcacgaggtcaggagttcgagaccagcctagccaacatagtgaaaccccgtctctactaaaaatacaaaaattagctgggcatggtgatgggtgcctgtagtcccagctacttgggaggctgaggcaggagaatcgcttgaacccgggaggtggaggttgcagtgagccgagatcgtgccactgcacaccagcctgggcgacaaagtgagacttcatctcaaaaaaaaaattattattataattccttttttttttttttttttttttagagacagggtcttactctgttacccaggctgaagtgaagtggaacagtcatagctcactgcagcctccagttcctgggctcaagggattccccgtgcctcagcctcttgaacagctgggaccacaggcatgcaccaccatgcctggccaatttttaaaaaattctttgtagagacaggttctctctatgttgcccaggctggtctcaaactcctgatctcaagtgatccttccacctgggcctcccaaagtgctggtattataggcatggcaccaccatgcctggcatcttggtgctttttaatagcttgtttgtttctgcgataaatgtaggagactgatagaagagtctggatctcttgtcaaatctaggatcaaatcgtggtcagatacttaaactaaacccattttctcattgcacagcaaggacttcatagagcttttggggggattaaaggaggtaaagcttgcaaaacacttaacacagtatctggctcatagttagtgcttaacatacactattatttgtccatttgattttttttcatccctgggttctagaaacgcagtggtgaataaaacagatgtgattttgctctcatgtggcttacagtctagatgagaacatagacaatcaacagagaatgaacatgtattaataattatagactgagatataccagattttatttctgttaaagaaatgaacaggatatcttgacagagaataacaggagggaagaatgagaatcctctttatttgaaggtggtctggaacagcttctctgacagggtgccatttaaactgagatctggaggaaatcaaaacactggatgttattttttaatgaaaattaagaaaagcaagagcaaaacaaaacagacttagtatcaaacacaaaagacccctctcctactgacttcctccctaaataaacataagagataaaagatccctgattgtaagggaccttcattattagcagaaaaaggagacttaaatctctctttttttctgccaaaacccagaccacaaatgactttttaaaatgatcaaatatgtatgcagctttgagcatctgattctccctggagtgggtccctcctgtattcggctgtgggaaactggaaggcataggaacgaccctgcatttcactggatgtgcacatgtgaaaaagaaagatgcgcttgtctttttgcctaggctatgtagcttggatgtcttttcatcgtgaccttctggtcttgttaacctgaaggtgtcctggtgtcttgatggaggctgggcaggtagctcccctgagccactagcctcatgttatcaaagtcggctaggcaacagacagcagggaggagccttatcctctcctccaccatcttaccttgtccatgccctctttttacctccatttcttctccaggctctttcctttcctcctccaaagaagcaatgtctctcttgcaggtcccactcaagtgagatgtcactccctccagacagagttcctggcccttcttgggttcctttcctctgtgctcaatggcagcacctgtcccatggtcccatgcagtggcctgtgtgtgcatctgtgtcctctgctagatcttaagctcaacggggacaagaacaggtaccctcttatgtatcgccagagtccagcatgctgctcggcagaggatctacaacagccaaatattagccttccttattatcccttagcaccaaaatacacgtcaaagcagccacttgttttagagtttttttgcttcattttgttttgagacagggtctcactctgtcacccaggctgaagtgcagaggcacgatcatagcttgctgcagtctaaacctcctgggctcaagtaatcctccaacttcagccttccaagtagctgggactacaggcatgtggcgtcatgccctgagaagttttaaatttttgtagagacagggtcttgctatgttgcccaggctggtctcacactcctagcctcaagcgatcctcctgctgccttagagtgttttactaagatgaagcatgttaaagtagcatcaggctaaccttaacaatttacccaaatactcccattctctttatttctatttttcaatttcttccatgataattgctgtctcatttaaaatagctttcacagcttcttttcttattacaaaataataataacaatacctgattgttatgtaaatttttaaaatataatcaagcataaaggggaaaaggaaaaaattaaaaccatctgtaattcttcgaatctccataagcctgtgtataaaatgtgtacagatattacgtatacatttgtgtatataatttatagaatgggaagatattgtacacactgttagtaattatataactatgtcatttaatattcttctacatcttcttttaatttttaagaatgttttgcatggtaatacatcaaatagatgtatcattatttatttaactgttttccctattggcccatagtagattcccaatttttctttcctctgacgattctttgatgaacaccctgtattttgatggggtaaatccaggagtatagaggacaggtcagggaaaacctcgtggaggaagtgacactgctctggagacagaaaggatgcacaggagatagctggatgagtggagaaggagtggaaggcaagtgttcctggcagaggaggcagcctgtgcaagggcctggagtcacctccaagagttcatgagtgttctaggaactggaaatacttcagtatggctggagggtgtctcagggggtgggggacacaggcagggaaggggccattgaccaagtgtccaggaacaggtcctaaatggccccttaagccatgctaaggagtgtgggctttgggcaatggggagctattgcagataagagcagggaaatggcatactccagtcagcgtctttaaaagatccctttagctggccatggtggtgtgcagctgtggtcccaagctactcacaaggccaaggcaagaggatcccttgagccttggaattcaaggtggcagtgagctatgatcacgccactgcaccccaacctgggtaagagagcaagaccttgtctcaaaaaacaaaacaaaacaaaacaaaaaagagatccctgtggcagtggtgaccaagccaactccacattcaacagcaagactctgttattaattcaatgaaacagaaattaaaagagaagagaaaaagaaaaagagcttacgtgtaacaggtcacagataagcttttcaaactgtctagattcttaaattcaggagcgtaattcaacaaatcaaccttcttactcctctccttaatcctgaaagaggtgcttgtggtttaaataacccagttggtttctggcccccattcctgttccaggagccccattgatgtaccctgatgacaagggagtcggattttctttttttttttaagctgagtgaggctgaagtgttcacccaagacaagccagagaggcaggtgcaatccatggtgcgtttttaattagatcccagccactgagctgcccatacttcaaggacacagcaggcaggaaactgatctgggctgtgtctcccaagggctgacgtctccatttagggagcgctcctgaagctaatggtcagtgacagctccatttgaaaaacacagaaacacttaacagggaggctgtgatctgccagccctgtaagctgctgattagcagggaaatcacgctccctctgtatcgcacccccttggttaatccctgttcttgtgtctcctctgtgctatctcacttaaagatttcattgttctctgaggcaggagggagtggggagagggagggggaggttgtggagctgccagaagctgtttcactgtctcccatcacagcctctggggaggcccaggcgaagaaacagccttctggtgtggatgggaaattgatggtttttaaagaaaaatggtccctgaagatgctctgtgtctcagcaaatgtgcttcctagactggctggcttgggttccaacacccaggccaaagaaaaacacgcacgggtctgccttatagtcacaccaggatgccataccagcagtccctgccaccatcacctctttgttgtctgctctgcctcccctttctacagtcctaagccaccattcctctcctgtggatgactgcggcagtctctccccgatgccacggccaccaatctagctccccaaacctctgcaatccccacactgcagctgaggggactccttgacgtgtcctctggaattttgaacttatcaaaaaggaaagcaaatactaaatttcccccctcaaataggatctcctcctcgtgttcctctcttactaaatagctcaggccaaaaatgccagggtcaccaacaatgcctctcttcctcacataccccacacccaatccatcagcaaatcttgtcaactctgaattcagaatataccccacatccgaatgcatctttccatccctccaccaatcaccttccttcaagcccccatcattcttaactggattatcataaccacctcctcactggttgtactgtttccactattgtcccccgctcatttaatctatccttgtacaccacaccagtgatcctgtttaaatgtaaatcagggccagtcttggtggctgacacctggaattccagaactttgggaggctgaggtgggaggatcacttgaggataggagttcgagaccagcctgggcaacatagcaagaccccacacacacaccctgtgtctacaaaaaaaaaaaaattagtcctgcgtggtggtgcacacctgtagtcctagctactcatgaggctaaagtgggaggattgcttgagcccaggagtttgaggctgcagtgagctgtgatcatgcctctgactcaagcatgggcaacagagcaagaccatgtctctaaaacaatgaaatattataaaaacaaaacatacgtcatcatatcattcagggctcaacattctccagcagtttctcatctagctgagatgaaaatccactgtccttacatggccatcaaggaccctgctctggctcgtggcccgctgtgtggccccttggtcactctgctctggccataccatactgacctcattgctgcttggtgactgtgccaggtgagctctgtcttggggcctttgcacttgcagctccctctgcctagcatgcctttcctcccgacatccaaagggcaccctctctcacttcactgaggtcttgctcaaaggccatttcctccaagctgaaaatggcatcactctcactccatcccctggactttcttcttcttttttttttttttgagacagagtctcattctgtcgcccaggctggagtgcagtggcttgatctccgctcactgcaacctctgcctcctgggctcaagtgatccccccaccacagtcctcctgagtagctgggaccacaggtgtgcaccaccacacccagctaatatttgtatttttggtagagacggggtttcaccatgttgcccaggctggtcatgaattcctgagctcaagtgatccaccatcctcggcctctcaaagtgctgggattataggcgtgagctaccctgcccggccttggctttatttttcttcacatcacttatctccctctggcactaaaacatatattcacatttacagttacagtctcgtttgttgcttctcttccccagtaaaatgtaagttccatgaagcatggattttgtatcattttctactagcacagagcctggcatgtagtgggtgctcagtaaatccgtcttgaatgagaaaatgaataaacaaatgaatgaatctggacaacaattctaaccacagtgagtttaccgaggggtcatccttctgtgggagcttccctccactggccagcagaaaagaccccaggtcttcatactatgtcagagagttctcattttctgagacctgaagccaagataacaaaaacagcagaaacaatttagcttggaatgacaaataggtttccttaagtctgacaagagtcttttaaaaattcaagactgtttccttagtatttaaaacttaaacaccatgcaaatgccctattataggaaacatacgctgtctgtctgtagggatttgtagtagaaaatgggaactaaataatacttggagccatgatgcgttgatcacatactcagtacctgttacttgcattctctcattttatcctcatatcacaaccccagtgtgataggaattaaaattgctcccattttacaaaagaggaaactgaaactttaaggaacttgcccagagttgcacagatagtgggtagcataatgccagggtttgaattcagtctacagactcacttttttttttttttttttgcgatggagtttcccttttgttgcccaggctggagtgcaatggtgccatctcagctcactgtaacctctgcctcctgggtttaagtgattctcctgcctcagcctcccgagtagctgggattacaggcacctgacaccacgcctggctaattttttgtatttttagtagagatgggatttcaccatgttggccaggctggtctcgaactcttgatctcaggtgatccacccgcctcggcttcccaaagttcagggattacaggcatgagccaccgcgcccggccccagactcacttttactcagataagaagtgagcaggaggcagaggctcttggagacctaagtcccttgcatgcacagcaaatacttctgcttccctcaacaaaaaggctttgaagaagagcgtgcacctcttgactttctcaatgtaccttcactcctccagcaactgaagttcagtggcagccctccatttctcatcagtatcaccccagttgccaattgcaatgatcctttttcggcaactctcctatttgacctctgaaagatattttagttataccaatgcccttcacctggggtttctcccagtccttagcttggctgatactgttctctcctggttctcctcctgctgtcctaagacactttaaggagcatttttatcatgggcaaatggaaataaaacacctatttcacagagtttttacatgaatgaaaaaggtcatatattcaaaaacacttggcaaatgtctgtttcattgaaagtgctcactggtttttattactcttgttatctctttccactccccatattctgtgctttaaaaaaaaaaaaaaaaaaaaggtttttcaagacctctctcctcctgtgcttttttttccttttttttttttttttttttttttttcctttttggagtcaaggtctcaatcactgcccaggctggagtgcagtggtacaatccctgctcactgcaacctctacctcgctggctcaagcaattctctcacctcagtttcctgagtagctgggactacaggcatgcaccaccatgcccagctaattttttaaagacagggttttgccatgttggtcaggctggtctcaaactcatgacctcaggtgatctgcccacctcggcctcccaaagtgctgggattacaggtgtgaaccaccacgcctggcccagaacctgtgcttctgactccctctggtcatcaccaggactctcattggcctctcaaagtcgttatccaaaatggaattaatcatctttctcagttttcacactttctctgtctcagttcatacaaccacagtctctgtcattcaaaccagagacttcatcatccccatccttgtcttcccgccggccccttccccacttcattagttagtcagccaccaggctgccaccgtacttgtatatttatttatttatttatttatttatttatttatttatttattttgagagagagtctcgctctgtcacccaggctggagtgcagtggcgcgatctcagccgactgcaacctccgcctcccgggttcaagctattctcctgcttcagcctcctgagtagctgggactacaggtgcccatcaccacgcctggctaatttttatatttttagtagagacggggtttcatcatgttggctaggatggtctcgatctcctgactttgtgatccacccgcctcctcctcccaaagtgctgggattacaggcgtgagccactgcgcccagtcactgtacttgtaaaaatggagccaggaacttgggctctgatgtcagatggacctggttcatcttgctctgctattggtttgctgagattatgaacaaattacatagtctccgtggtctcagttccgtcatctataaaatggagatcataataatgcccacttcatagggccattgggaagattaaataaggtaatgcaagtaaagaactttccagtaaacagcattttgcactggtatatagcaaatgcataataaatatcagcagtcataattgttattactcctactactattatactattaggttgtggttacctcgtagagatactgtgttgaaaacacatagagcttttgtgcaaatgggttttgctggcaaagaacaaggaaccccaaattagcggtttgccccttctcattaggtgggaattagcatgtacaggtgtgagcacccatgcatgcatgcacacatttgcagacatgtacatacacatatgtgttataactctgcctcagatgggggcctttttaatatagaaacaccagcaggatgggtgagaaatggcaatggttttctctctagaacctgattgcttcaccaaacaatggtttgtatttcctcccacatccctccttcctaattgaagagggaatggctgaatttacctcctggcaccttgcatttgatgttcagtgactgatccagctaaccaggggcctcgtggttgcccaggcgttgcaagcatcaaacccagatcttcactgggatcttcctccagtggctggagtttataaattgtattctgttgagttggaaaacatccactgctcctgattgagagctggaggacagcactttgaggggtctgctgctataaatactgggatctcccaggtgatgtataaatgggtcactactttgcatcttgcaccacctgaaacatctcaggtgccttaatcccatgttttccaacagatgagcttggctgacttctcggggtgggttggggggacatgccacatgcctctggccccaccatctcatgcctttgccatccatctcctgactggccagaaggacaccaggagcagctcatgagctacaaaaactgaaggtcgggaacccaaggtcgtgcaccaaaggtcatgagaattttgcattttatgttgctctcatttctgatcatttgaaacaacctctctgagtttctgaaagggaagggaatggagaaaagcacacccaattatgctaggttctgttttattttggcttttgtttttgttttttttcccacccaccacaagttcttttcttcccctctcatagtgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttgggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaaaagaagaagaaatactatttcaaggaaaactgctctttttgagaaacgtggacctaaactacaaagtgggaactgaggagggaactcaggagaaaggaactaactgcggagctttaatcttggccccagtgttcagccactcggaggggcgggggctgtggcccattcaggggctgctggtgggctgtagtggggtgggatgacctggccagagccaacgaggatactggagcccaaagtcaagtttagagaccagctgggaacgtgaatggggctcttgattttcttatcaaaatcaccactcctcccagcttggactaaatattctttctagcaagcagctttgtgagctccctgaagcccaaggaaacccttcggtgggagaaatttcatttctgtctgagaggattaaggcagcaggtgactccccctcctcgcctgccgtgtcctgctattctcaggcagctctaaggagaattcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaggaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaagaagaaaaagaaagaaggaaagaaagaaagagaaaggaaggaaggaaagaaggaaggaaaagaaggaaggaaggaaggaatatagtgttataaatactgcactcaacattttccaaattcttgccattatttttcaaaagtttaatagtttgcagaaatagatactcaagccaaagtctgttttagagaaactttccatggaaagtcagaatttctaccacttccttttctatccacatttccagtgcagaagaaactgagaaacagagctttttgaagagaggacagggccatagcaacaaggaccttcttgggggattaatgggaggtcagtagaattaataaccctccttggatgagtgctactgttttcacatggcttcagatgctatcaacctcaaagaaatgatctcaacagagaagcttattctctcccaacttctacggtaaaatccaggagtattttctctggggatctgcccacaggacaaagtccataaaagcaagtcctgtctggaccatgtggttatctgaagcattagccatcaccagcacaacaaacggggcagggctttccaaggtggggctggtcagaagggaatctttgataagaggcccacaggcagggaaagcgaaatagggttgatgagaccaggggagacctaaaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtttctggctcggggacaattataagttgcaaaaaggatagaggcatatcccaagtcttccttcattccacaaataattacaaacaacctactgtgtgccaggcactattcttagcactggaaatacactagtgaagaagcagatgaggaccctgtttattgtttctctccaagaaattctccaagaatattgtttcttggagagaaataataaataaacaagacaatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtactcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggtcttctagccacctgggctgctactgaatggttttctccaggacgctctacctaatgattatttctataacattaagcatggtaataagtagcttccaattcaattcatcctaaagccaaagaaaatacagcaacacacacacacacacacacacacacacacacacacacacacacacaccactttatggcaattcttaactgacattcaatgacttacttcttttcttagaaaatttccaccacatttctatccccaagccaacatacaatgtgaaatgaaagccagtgcgtggagtgcagctgctaaaaattttcagcacagggctctttctgactctgctcatgagatggtatcagccacccaatgactggcgtatcttggtcctgtgtctttcttcttacgctgtgttaatgtgtttactttccatttggcagagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagagggcttttctttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagctttgcagttactgtgaactattgtctcttggaggaagttttttgtttaagaattgatatgattaaactgaattaatatatgcaagctcttgtttatatgtcttttcttaaatagactatgttacagaggttacagactgaagatccagtttgtagccattagataagcttaattttactcacatggaattttacttaatcaaaaccattgtgaacatgacaaaataagatactttatataaattcctggacttttagattcccttgaaaaaagaaacaaaagactagcagctctgagcctgtatttccacatggaaataattctacagaactgagaaatgcttctcctttaaaagcagtgtatgttctcattttgccacagtctccaccaccccctattgtcttataccctccatccacttccctggctgctatagccacttgaggttgaaacctctgtcattcgtgagtcacaggtttgaggaccttaatattttcttgtgcccctaatcagggtatgtgtgcagccacccactcaatgtgattcgtgtttattaagctatgtatcaagcacaagatatgtaagattttattccagccatgacaaaagtcaggaaagaggctggtgtcagtgcagagagaatcctttgtttgttgtccatgaggatgttgctatttgtaaaacgacttacctttgacttatattctcctaatttagctaagcacctgccaaaaaaagaggggggggagtataagccattttttttttcaaccgcttgtccagggaggcccaagagaagagggagaaataagggagactgcttctaaaccctgctggcatgataaggacccgcactctctcagagcagagtggcacagtactgagtcactgggtgtcaatctaataccttcttctctgaatgaagtcatgcttctattttcttttcaaaagatatagtaatccaatctgtagcacatgcctttgtagctgctaaggctagtgggtagcagaaaagagcaaatgtgttcacactatgtacattatgactctctacagagtgtattcatctcttcccttcttgaaagagcctcagtaaatggagcattggaaagatacagtgaatccattgatcttacctagtgcactaatctttgcagaattttagaaagtctgccagttaaagttggctgaagcccatttaaacttcaggaagaaacagtgttctaggcatcacatttagaaaacaaaaatacctgggattctacagatgtttgaacatgcatcccatttaagacagtattatatagaagaggttaccattgctgcctcttattcctcctcattccatgccagcttctcaaactttccccctctgccagatataaacccatctttcatttaataaatattgagccccgactctgagccaagcacagttctggatactggtgttatagagaccaataagatagttcaggactccccacttgtagggacaacatggctgcagaaatcctggcctctaatccttctaggatcatgtccagtgagaaagagtgtgagctcctataaaagtattgtagtttattacagttgactcagcctggtcacatgtacattcttgagccaagcactgtgggtggagaggggagacaggtgaggtgctttaattggccaaacctgagttgtattagctagttattactgtgtaacaagttaccccaaaactttaaagcaataaacatttatgacctctcaatgtctgtggatcaggaatctgggtatggctgaggtggtataaagtctgtcatgaggatgtggccaagctattgcccagggttgcagtcacatgtgaaggttccactgggggaagatgggattcacttccaagcttactcacatggttgttggcaaccccaattcctcacttcataggtccctccatagggctgcctctggacatggcagctggcttctcctagggcacatgattcaagtgagagtgcccag

SEQ ID NO: 13419 - DNA, 5606 bp, Human
ttcacatatacatgcctcttatatcagggatgtgaaacagggtcttgaaaactgtctaaatctaaaacaatgctaatgcaggtttaaatttaataaaataaaatccaaaatctaacagccaagtcaaatctgtatgttttaacatttaaaatattttaaagacgtcttttcccaggattcaacatgtgaaatcttttctcagggatacacgtgtgcctagatcctcattgctttagttttttacagaggaatgaatataaaaagaaaatacttaaattttatccctcttacctctataatcatacataggcataattttttaacctaggctccagatagccatagaagaaccaaacactttctgcgtgtgtgagaataatcagagtgagattttttcacaagtacctgatgagggttgagacaggtagaaaaagtgagagatctctatttatttagcaataatagagaaagcatttaagagaataaagcaatggaaataagaaatttgtaaatttccttctgataactagaaatagaggatccagtttcttttggttaacctaaattttatttcattttattgttttattttattttattttattttattttgtgtaatcgtagtttcagagtgttagagctgaaaggaagaagtaggagaaacatgcaaagtaaaagtataacactttccttactaaaccgacatgggtttccaggtaggggcaggattcaggatgactgacagggcccttagggaacactgagaccctacgctgacctcataaatgcttgctacctttgctgttttaattacatcttttaatagcaggaagcagaactctgcacttcaaaagtttttcctcacctgaggagttaatttagtacaaggggaaaaagtacagggggatgggagaaaggcgatcacgttgggaagctatagagaaagaagagtaaattttagtaaaggaggtttaaacaaacaaaatataaagagaaataggaacttgaatcaaggaaatgattttaaaacgcagtattcttagtggactagaggaaaaaaataatctgagccaagtagaagaccttttcccctcctacccctactttctaagtcacagaggctttttgttcccccagacactcttgcagattagtccaggcagaaacagttagatgtccccagttaacctcctatttgacaccactgattaccccattgatagtcacactttgggttgtaagtgactttttatttatttgtatttttgactgcattaagaggtctctagttttttatctcttgtttcccaaaacctaataagtaactaatgcacagagcacattgatttgtatttattctatttttagacataatttattagcatgcatgagcaaattaagaaaaacaacaacaaatgaatgcatatatatgtatatgtatgtgtgtatatatacacatatatatatatatttttttttcttttcttaccagaaggttttaatccaaataaggagaagatatgcttagaactgaggtagagttttcatccattctgtcctgtaagtattttgcatattctggagacgcaggaagagatccatctacatatcccaaagctgaattatggtagacaaaactcttccacttttagtgcatcaacttcttatttgtgtaataagaaaattgggaaaacgatcttcaatatgcttaccaagctgtgattccaaatattacgtaaatacacttgcaaaggaggatgtttttagtagcaatttgtactgatggtatggggccaagagatatatcttagagggagggctgagggtttgaagtccaactcctaagccagtgccagaagagccaaggacaggtacggctgtcatcacttagacctcaccctgtggagccacaccctagggttggccaatctactcccaggagcagggagggcaggagccagggctgggcataaaagtcagggcagagccatctattgcttacatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggttggtatcaaggttacaagacaggtttaaggagaccaatagaaactgggcatgtggagacagagaagactcttgggtttctgataggcactgactctctctgcctattggtctattttcccacccttaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcagggtgagtctatgggacgcttgatgttttctttccccttcttttctatggttaagttcatgtcataggaaggggataagtaatagggtacagtttagaatgggaaacagacgaatgattgcatcagtgtggaagtctcaggatcgttttagtttcttttatttgctgttcataacaattgttttcttttgtttaattcttgctttctttttttttcttctccgcaatttttactattatacttaatgccttaacattgtgtataacaaaaggaaatatctctgagatacattaagtaacttaaaaaaaaactttacacagtctgcctagtacattactatttggaatatatgtgtgcttatttgcatattcataatctccctactttattttcttttatttttaattgatacataatcattatacatatttatgggttaaagtgtaatgttttaatatgtgtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatctctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaatgaagagctagttcaaaccttgggaaaatacactatatcttaaactccatgaaagaaggtgaggctgcaaacagctaatgcacattggcaacagcccctgatgcatatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacaggggtcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctgtcataggcccaccccaaatggaagtcccattcttcctcaggatgtttaagattagcattcaggaagagatcagaggtctgctggctcccttatcatgtcccttatggtgcttctggctctgcagttattagcatagtgttaccatcaaccaccttaacttcatttttcttattcaatacctaggtaggtagatgctagattctggaaataaaatatgagtctcaagtggtccttgtcctctctcccagtcaaattctgaatctagttggcaagattctgaaatcaaggcatataatcagtaataagtgatgatagaagggtatatagaagaattttattatatgagagggtgaaaccctcaaaatgaaatgaaatcagacccttgtcttacaccataaacaaaaataaatttgaatgggttaaagaattaaactaagacctaaaaccataaaaatttttaaagaaatcaaaagaagaaaattctaatattcacgttgcagccgttttttgaatttgatatgagaagcaaaggcaacaaaaggaaaaataaagaagtgaggctacatcaaactaaaaaatttccacacaaaaaacaaaacaatgaacaaatgaaaggtgaaccatgaaatggcatatttgcaaaccaaatatttcttaaatattttggttaatatccaaaatatataagaaacacagatgattcaataacaaacaaaaaattaaaaataggaaaataaaaaaattaaaaagaagaaaatcctgccatttatggcagaattgatgaacctggaggatgtaaaactaagaaaaataagcctgacacaaaaagacaaatactacacaaccttgctcatatgtgaaacataaaaaagtcactctcatggaaacagacagtagaggtatggtttccaggggttgggggtgggagaatcaggaaactattactcaaagggtataaaatttcagttatgtgggatgaataaattctagatatctaatgtacagcatcgtgactgtagttaattgtactgtaagtatatttaaaatttgcaaagagagtagatttttttttttttttagatggagttttgctcttgttgtccaggctggagtgcaatggcaagatcttggctcactgcaacctccgcctcctgggttcaagcaaatctcctgcctcagcctcccgagtagctgggattacaggcatgcgacaccatgcccagctaattttgtatttttagtagagacggggtttctccatgttggtcaggctgatccgcctgcctcggccacccaaagggctg

SEQ ID NO: 13420 - DNA, 47363 bp, Human
  misc_feature (1)...(47363): n = A,T,C or G
ggcgacatagcgagactccgactcaaaaaaagaatttcatgagataagtcaagttcttatcgctccactgcacttcagcctggcgacagagcaagactctgtctcgaagaaaaaaagaaaaaaacaatttcatgagataagtcaagttcttaacaagtcacttggctaagcatatatgtgcattagatggtttctattagttcttgtcatgtcacaccaaaaccacagagggcctagggatggagcctgggagcttaagcccccatatctgtcttcagaatcctagctcttaactaatcctgttagtttaacatgatcgttattaggcaaataacttcctcagtcttgtttattttaaaatatttcctgctattatgctggtttagaaataagccagcctaatctatgtgtgtatttcagaattatgggaaacagttctgaactggtcatgtaatgagatttttctctaaattcaaagaaagcaatattattgcaatatcaagcaacttagcttcctagctgaattttgcaattataccaatattttggttattggtggttctagtttagaaatattctatcattctgaacagtattaattctaaaactttcatatgagagttccaaagaaaagtttctatcctaaccattaattcagttagtatagcagctcttttattaagaagaacaagaaatataggaaacaaagcagctattagcagatgagcaaagagagcctatacaaggtggatccaggcaacaaaacagtgcaaagctctgctgtcaactctgggcagaagcgttttgtgttgcctttgttctgagtcaagaagtgatacccggcctctagggaaaacctagggaagggcatctctcaatgatgccatgacatgaaaacacctggaaacctgtttcccaaagtccaaatataggtgtgaatttcttgaacacctaatctcaaatgacatcaagcatgattcagcatacgtaatggtatcatgaatacataatgaagaagcaatgaattattgacagatgaaacagaactgccaccaaatgaaacgtagaacacaaatgccttatgcgtattttacacagcgcatgtattttatatggaatgtggggtcagcagatttattttctaaattccctcaagaagttaaagtctgagtgggtgctccctttttagctatctgtgacttccccatgcttattcctttttttttttttgagatggagtctcgctttgttgcccagggtggagtacagtggcgcaatctcggctcactgcaacttctgcctcctaggttcaagtgattctcttacctcagcctcctgagtagctttgattacaggtgcccgccactatgcccagctaatttttccatttttagtagagatggggtttcaccatgttgaccaggccgatctcaaactcctgacctcaggtgatctgcctacctcggcctcccaaagtgctgggattataagtgtgagccactgcgcctggccccccccatgcttatttctttgatgcttagtcatgtgctaaaactgggttttctatcagagcaacagtacccttaaaatatatatggtggccctaaatctatggggataaactcgatttaaatatatacaaagtttttgttttgtttttgttttcgttttttaagagatggggtctcactctattgcctaagttgaggggcagtggtgcgatcatagctcactacagcctcgaactcctgggctcaggcagtcccctcaccttagtctcccaaatagctggaactaccaagcctggcttaaatacgagtttttaaaataaagcatatagcatattctgtacagttcaggtacaggaaaaaaggttactgccacctgtgaaacaaatgtgaaaggctctgtctgcacatctatgaatcctcccaaaaggcatccttattgtacaccttcaacaaagattacaaaatatattttataatatatctttacagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcagtaagtaatctaatcctttcgggctactgataatcttgcttagagcagaattgtagtaatgtcatcactagctttggttaaatccagcttcagagaccagaaaaaggactgctttaaaatgatgatgatgatgacaataactattattatcgaaataatttccacaactaattcataaaacaaaggaaaaaattattctcaaattgttggaatggaaatcaggtttagataatagtaattcattccctagaataactaggtgagttcaatgcttattgaccattaatataattgaataaatatttatgaaatataaattgtctggttttgcattctttattgattaagcaggtattttagctcttctcttcctagaaattttgctaggcactgtgagtaatgtgatgagtaaaaagaaacatgattcctgtcttcatggagtttatatgtgtggagaagactgcattgcacaaattgataaaagataattggagaattgctatgacagagtggtacaggtcctgtgagagtttgtggtagaaggaattgaatttggaggcaaggctggataacccagggactcagggaaggtatccctacagtgtgaagactgtgatgtgttctgaagaaagatgttaaacagataaaagtgggttgtgggaaaatgaataatgtaggaggcaggtagacatgacagcatgtgtagagtccctgtggctttagagatggtgaatattctcaagcaactgaaagaaggtttgtgtgactggagctgagatggtaagggtaaggaatgtagctggagaagtaactcagaatcaggtcacacagggccatgtcgaatttttgtttttatcctaaaagcaataggaagacaatgaagtgggaagaatagaatgtgaagtgacaagatcagatttgcatttaaaaaaaaacccaatcactttgctgcaagcagaactgattgaattgagtcttgccaatctctggtgagtccagtgagagagtgattgggaaagggagtttctgtaagcctatgttatttcctctaagagctgacttattttatcatgaatgcatttgagatgttcaggcaggaaaatatcttcattaaggcattcttctatctttagcatgtagttagttatttcttaggttttcagtacaaaagattatggcaagccaagaagaataatttcagtgtgttcaatttaagcttagttataaaaaatttattccaccgtttggggttcaagtatttgtctattttgtgttattggtaaaatgatgaaagttatctgtgtatacaagcaataagtacaactgactagtatttaatttggtgtcatttcaaataaagaagtgtaaataaatatccattttgtcaggtttttattgattatctgattctcaattttacttatgttccattccagctaatgcaagaattaaaaagcaaagatatcagcaaaacattccgaaaaataattaacaagagggaagggattactgctattggaggaacttcaactatttccagtgagggcacacagcattcttattcaggtaactgacttctccaaatttgatcttttagtcactgattcattgattaagtgacatatttaatcagttctaagatgccactcattgtgattcataccgttattttatgtgccactgaggagaaaaaaatactgcagaccacagtataacatgccattgaatttgaaatacatctcagtttcacagatgtcaaaatgaaaaatcctagaatcattgaaatcaatgagttcctgctgtgtatcaggctcagtctacagaaacaagattataaacaacaaagtggaagttgtttatactccagcattagatgtatttaaaagtggcttttcaatggcttttcatcctgactgatgaggtggctttacttttagacctgagctaggaatgggggagaggcttctatcacaaggatttttctcttccattttctgagatctgagatacccgattcaccttttatctagtaaccaagtgactagagagcatagcacctgatttgcttgatctgattaaaccactggaccattgcccagtgggaaatgcagaagcatatcaacttttaagatgaggtgtcttccccgtgttaagttatctaagatgtctaagaacctttggccaagttctttttatttatatgaacataactagaactatgctttttggccttttgacaaaattacctgtaaccttttcccctctttcttcatttcagatctgaatctgttaattatcctcttgattctgtcccttcctaattggattttcctctagcgatacactcaaatttctctcatctattatatgtttttcctaactttttcccactagggaagcagccataaaggcaaaggtccataactgttaccttcactttttgaaaggtattcaccccttaacccagtttctgcctgtcaattctactgaagtggcttctttttaaagacaaaaaaaaattattaaggtataatacacattcagcaaagtgctataatcttaagtatatggctcaatgaatttttccatgtgtatatacattcatgtagctgccaaccagaacaagacatggaatcttttcatcacctgaagactccctcattcccctgatagtaactattcttccctagaggtaacctcttttctgatatttgtcaccataaatttttgtttacttattttttgaggtataagatacttgtagtaaagtgcatgaagtgtactttttttttttttttttttttgagatggcgtctcgctctgtcgtccaggctggagtgcagtggtgcgatctcggctcactgcaagctccacttcccaggttcacgtcattctcttgcctcagcctcctgagtagctgggactacaggtgcccgccaacacgcccagctaatgtttttgtatttttagtagagtcagggtttcaccgtgttagccaggatggtctcgatctcctgacctcatgatccacccgccttggcctcccaaagtgctgggattacaggcatgagccaccacaccaggctgaagtgtactattcttaagtatatggcttgatgatttcttttaacctatgaatacacctatataactattctctagaaaaatatatggaatatttaatggcttttataaaaaatagcagctttattgagatataattgacataccatggaatacatttttaaagtatacagttcagtagtttttagtgtattcatagttgtgcaattgtcatcactatttaatttcagaacactttcattacaccaaagaagaacactatattcattatcagtcactccccatttccctcttcccgaaggctctgcaaccattaaactgctttctatttctacaaatttgcctattctggaagtttcatataaatggtatcatactgtagtggcctttcatttgacaggcttcttcactggtgtaatattttcaaggcttatccatgttgtcacatatatcatacttcattcctttttttctgactgcagcctcgacctccagagttcaagggatcctcccacctcagcctcccaagtgcataaccatgcctcccaaatgtgtaccaccatgcccagctaatttttctatcttttgtagagatggggttttgctatgtcacccaggttgatcttgaactcctgggttcgagcgatctgcctgccttgggattacaggtgtgagccatggtacctggccccttcattcctttttattgctgaatattccattctatgggcaataccacattttgtttatcctttcatcaggtgatggacatttgggttgtttctagtgtttggctattataaataatgctatatgaacactcatgaatgcatttgtgtgtggacatatactttgaattctcgtaggcatatacttaggagtagaattgcttgaatttttgttaactctatgtttatcatttttaaagaactgccaaattgttttccaaagtggctgcacttgtgagggcgatctggctgcgacatctgtcaccccattgattgccagggttgatttggctgatctggctggctaggcaggtgtccccttcctccctcagtgctccatgtgagtccttcccgaagctgcgtgctcggttgaagaggacaaccatccccaatagaagaggactggtctttggtcaagggtatacgagtagctgcactcccctgctagaacttccaaacaagctctcaaggtccaaagtggctgcaccatcttacattcccaccagcaatgtatgagggctccagtttcttcaattctcaccaacacttgtttttgtccatttaaaaaattacagccatcctagtggttgtgatgtggtatctcattcctggttcctatacctgaaacatcctttctttccttgcctatattcacctattgaaaaactatatttcaaatagtacctcctctatgaagccttttcttgatcaccctaactaaaagtgattgcttctttttttaaattctgcaaacattgcatatatatttctggtggtgtgtgtatttcccttatatcacatttctttgtatatttgttttacaattacactaaaaaattcctcaatggcagatacagtattttagtgatctctgaattcctagactccaaatccttctaaggaggtgtgtatgaggaggcgagaagataaggcagattatgatatgtacaaagaggaaatattagtacatatttgtgtttttgttgacttgtgtgtgtatgtatgtgtggtggattaaattttgggggtacctgcaaaatattcccttgggaaaattacttaattctaggaactggggcaacaatggagaaggccaaatcattatgtgctaccctctgatggaaatggggattatttactttaaggatttataatcttaaatggtttttatatctacagaataataataaagttgtacaatgtttttactttaagttccttcctattttccccactgcataacccaacaaaattttctacttaagatcaatgtacccatactagaagccatgtgttgagaagttgttggatgaagatggccaaagatagtgctggtatctagatttgtgtcaattttttcttcgttttttgtttttttgagacaagagtcttgctctgttgcccaggctggagtgcagtggcgtgatctcggctcactgcaacctccgtctcccagattcaagcaattctccctgcctcagcctccagagtagctgggattacaggtgcctgccaccacacctggctaatttttgtattttttagtagagatggggttttgccatgttggccaggctggtctcaaactcctgacctcaggtgatctgcccacctcagcctcccaaagtgcagggattacaggcatgagccaccgcacccagccaatttgtgtcaattttttaatagttaaattccattgaaattgagctgttttattcatttgaataactcttgactgaattcagtatttctgttgtaagctaaaaatcacagctctctaaaccttttggggaggatgggatttattgccatggtatttgtttcttgtatttttttccttatttaattaacatatacatatttgacctccgatggtctgcttctgactcattagctttcagaagcaatacatatttggaaatatttttgaatcaaaccaaatatatattgtgctcatttaagatatataccttcatctctcctaatagatcagttttttgtttgtttttttgtttgttttttgtttttgtttttgagacagagccttgctctgtcaccaggctggagtgcagtggcgcgatctcggttcactgcaagctctgcctcctgggttcatgtcattctcctgcctcagcctcccaagtagctgggattacaggcccacgccaccatgcccagctaatttatttttgtttatttagtagagatgaggttttaacatgttggccaggatggtcttgctctcttgacctcgtgatctgcccgtctcagcctcccaaagtgctgggattacaggcgtgagccaccgtgctccccgtttttttttttgaaagggtctctctttgtggcttaggctaaagtgcagtggcaggatctccactcactgcaacctccaccccccggttcaagcgatcctgaagcctcagcctctcgagtagctgggactatgggcatgtgccattatgcctggctaatttttgtattttcaatagagacgggggtttctccatgttgctcaggctggtcttgaactcctgacctcaagtgatcagcccgccttggaagtgctttgggaagtgctgggattacaggcgtgagccaccacacccagccacctttcttcttttcttgaacccttttgtgttttagtagatttgtaataatggtcaattattatctttgagcagaaattaacaagtatgtttttgtagtgcaatagctatgtatgtttttatagtgcaataaagtttgtgaaatgagatttgcctaccaaggttttctcctttcagaggaagaaaaagtggcttttgttaactggataaacaaagccctggagaatgaccctgactgtaagcatcttatacccatgaatcccaatgatgatagtcttttcaagtcacttgcagatggcatccttctttggtgagttgaacttctggttaaggaagctgcgttcttgctgattacattgatgagcattccatgaaaactccaattcagctgtccatgtgctttggagtcagtagtaactagtggtgaactatctgacatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattttcctattcttgttttaaaggtaaaattctaaaatatagagacaaaatttatattaatttctctgaaaatgtctaaattattggtcttagatgaaatctctggcttcgtatctttctgcaacaacagtaattttaacagtgttgatactactttatgaaacttggcttcttggagaatttctttgttttaggctgcggaatactgatgatcattaagtgaaataaagacaaaactaacataaagaaaattcagggtgatgactgggcgtggtggctcatgcctgtaatctcagcactttgagaggctgaggcaggaggatcacttgaggtcaggagtttgagaccagccgggccaacatggtgaaaccccatctctactaaaaatacaaaaattagctgagaggtggcacacacctgtaatcccagctactcgggaggctgaggcaggagtatcacttgaacccaggaggtggaggttgcagtgagctgagatcacaccactgcattccagcctgggtgacagaggtagactccctcttaaaaaaaaaagaaaattcaggatggttaaaaaaaattaggagaaatgcttagattactattgcagtgagtgatggatttgttttaggaatgggaatatttcttggattttaagaattaagttccggcatgaattatagtttaattaattattattattattttttgagatgaggtctctctgttttacacaggctggcctcaaactcttgggctcagcctcccaagtagctgagattatatgcatgtgccaccatgcctggcttactgtttaatattttaaagtaatgaattgttattttcaaaatttatctattttggctgtttgcaataataaactaaaaaaatttcttggagtattaaactaaattattctcattttctctttagcaaaatgatcaacttatctgaaccagatacaattgatgaaagagccatcaataagaaaaagctcacgccattcactatttctgtaagtatttgccctttgcttattatcatgttactatgctgagaaatataagacctttattaatgaatgcttggacccagataaaacctttgatttaattgtaatgctattctcctataaaaacttttttttttggaatccttttttttatttttattttattttattattattatactttaagttttagggtacatgtgcacaatgtgcaggttagttacatatgtatacatgtgccatgctggtgtgctgcacccattaactcgtcatttagcattaggtatatctcctaaagctatcccttccccctccccccaccccacaacagtccccagagtgtgatgttccccttcctgtgtccatgtgttctcattgttcaattcccacctatgcgtgagaatatgtggtgtttggttttttgttcttgtaatagtttactgagactgatgatttccaatttcatccatgtccctacaaaggacatgaactcatcattttttatggctgcatagtattccatggtgtatatgtgccacattttcttaatccagtctatcattgttggacatttggggttggttccaagtctttgctattgtgaatactgctgcaataaacatacgtgtgcatgtgtctttatagcagcatgatttatagtcctttgggtatatacccagtaatgagatggctgggtcaaatggtatttctagttctagatccctgacgaatcgccacactgacttccacaatggttgaactagtttacagtcccaccaacagtgtaaaagtgttcctgtttctccacatcctctccagcacctgttgtttcctgactttttaatgatcgccattctaactggtgtaagatggtatctcattgtggttttgatttgcatttctctgatggccagtgatgatgagcattttttcatgtgttttttggctgcataaatgtcttcttttgagaagtgtcctgttcatgtccttcacccactttttgatggggttgtttgtttttttcttgtaaatttgtttgagttcattgtaggttctggatattagccctttgtcagacgagtaggttgcgaaaattttctcccattttgtaggttgccttttcactctgatggcagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcactatttattaaatagggaatcctttccccattgcttgtttttctccagtttgtcaaagatcagatagttgtagatatgcggcgttatttctgagggctctgttctgttccattgatctatatctctgttttggtaccagtaccatgctgttttggttactgcagccttgtagtatagtttgaagtcaggtagcgtgatgcctccagctttgttcttttggcttaggattgacttggcaatgcgggctcttttttggttccatatgaactttaaagtagttttttccaattctgtgaaaaaagtcattggtagcttgacggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttataaaaactgttttttaaagagatgagggtcttgctatgccacccaatatagatcactgtaacctcaaactcctgggatcaagtgatcctccaacctcagcttcctgagttgttagggctataagcatgtaccactatgccctgctaattttttaaagtttttgtggagatggggtcttgctgtgttgctcagtctggtcttgaactagtggcctcaagtgatcttcctgcttcagcctcccaaagtgctggaattataggcatgagccaccatgcctggccaaaactggatttttattaaataaaaattcagttggattttgtaatgaatgaaatgaagattcaaggtactttggatgcacttacttaagctgtagtattcagtttatattattgtaattgttgaattatttattaatgaacacctgtttgatgccagtgctcttattaggtggttgaaaaagaacactgcagttttatcatttcacaaaattttaaactaatctttttgtactaaattgttctgtagttggctcctccatacagatcttgtataagtccaggtatttatacttaccacactttccccctcaaaatctctagaacaatgagtggatattaatatttactgagtacttactgggtatcagtcactgttctaaacacattatgtaaattatcctcccagcaactttataataaggtatatactatgattttatagatgaggaaactgaggcactgacaggttatacagaggcagagccaggatgtgatcccagtcgtctagcgccagagctcatttcttaatcactgtgttacactgccactctcatgtggtggtagtaatagcaactatttaaggtgtggttacaatagtagctattaaaattcagctactgttaacctgtgtccttcatttggcaagtgcaatccttgatttcactaaaattgttgagtcttctatagaaagctagtcttctatagactattaccccctgcatattttggaagtgtgctatctaaaaataaaactgcatgatagcctctcagatccactctgtggctaccgcaaaatacttatagaatattttttctttattttctttaatgcactaaatataaatattaaagtaaaaccaagcaataaatgtatacgatagtaagaaatgctgtatttcagattgagtgaccaaaaaaaggtcatgtatatattctataaataagatagatgttaatattttcagtaatcatggatattagatgaagatcccagtacaacatgtgaacaataatctggcaattgcaactggaaataggcttcttcaagaatggtaatttctattagtgatatgcaacattattgacctattagcaagcaggggacaagaaagccatgtagtcaacatccaattctttacttctcaaagattacaggaaatgagggaacctgttagacagtccaagcctaaccatgtaccactgccctaagaaggcagggccacctctcttgtgtctcttgtgttgccaccagttgtttgtggttccctactctccctatctttccgcatcaacacgagtcttcaggaaggctgggcattcagggcagttgtccatggtaagaattgtatagcaacttctccatggggttctcctgttacttcttgttcttaagatgtttagaagtagcttagtgtggccgttccattccctactaactggtagggcaataatgttgtatttatcaagtagaaactaccatttacttgaaagaaacatgttgcaactccttattttctacccatttttaaagccaaattactttaagacatttgatatgcttgtaaagcaaacatctttgataaaattaacatcaaaagcggtttttctcctgtatgaccaacacaacccgttgataagacaaagctgagttaactgtttaatgcagtaagagaaaatacttgcaaagctttgttagtgtcttggtgctgggaaagtgagggcagcatctgagaattggaattgtggtttagggcaggtctttcaatatgagagggggcaagagggcaagattgggcaagattctcaatacagcagcccaagattggtggcaatagcaaggggaggattttaaggtgaggaggtcaaagaatcttagagtataaactgtcattgatgttttatttgaagagttaatgggtcttttaggtagcgcctgcagtgaaaaatcagaccttttgcctagggtcaagactcctggaagaataagatcatggtaatgaagacagagagtaaagtcatgccagtgaagacaagaggatagcacacaaggtcatattaatgtaggcagtaagatgtggttttgtttgtcattgtccaggctgagagtagtggtaggttttggttcttactagtattgcaatcaatttagcgaaattacacacttcttttggcccacagtaccatgctgtcaactgcatatgacatgggttattgtgaggttaatactattattggcttaattttcagtccagttctttcccctgctgatgcattctggggaatcacaactggagcaaacatcatttatgctcttggaagcaaagagaaaaatattagtggtcatgcctaaatcagcagaagctgtctcttgaaagttgcatagatttgatttaaggtaacttaaaaaacatttgaagcaggagtgttaattaaaaacacctgaagttattaaaaatcttagatttccacaaagtatttgtaatttgctgttaattttttcatgtttatgtttatttgtagttaattatgaggttataaaaatattgaaggcttctctggttctgctgcttctttcaggagaactatatttaaatgaacattgcttaatactactaccaaaataattcaaaatgctaattttaatcgccccagacgatcccccaaagatacagccatttatttacttggagctcaataaatcacttcagcacactgtaggaggaagctgctgaaatattcactatgctttgagaacctctatgctttgctgctgttgtgaccagcccattaaattgtcgctattactgctacaatatgagaatggcagtaatgcatggcgattaagaggatgggctctgggccaggtgcggtggctcacgcctgtaatcccagcactttgggaggccgaggcgggcagattacgaggtcaggagatctagaccatcctggctaacatggtgaaacgccatctctactaaaaacacgaaaaactggccgggcgtggtggcgggtgcctgtagtctcagctactcaggaggctgaggcaggagaatggcgtgagcccaggaggcggagcttgcagtgagccaagatagtgccattgcactccagcttgggtgacagagtgagactccgtctcaaaaaaaataaataaaaaagaggatgggctcgggagaccgctgggatcagaccccggcctttccactgtggaaactgtcagtgctgcagtttcctcatctgtaaaatccatcttaagagttactttaaaattatcttaaaacctaattgtacatcattttttaaagaagtgcttccaaatgagcactttacaaaaatatcatgttgagtttgaggtattggcagaacatccaggtagacataaccaagtacatatatagatacacagcttagagtggagactcagaggaggtctgggtggaaatagggatttgaaagtcattggcatataaagtaacagttaaaaccatgtgtttttttttttgagtagtggtattttcgttgtataaatattatgtttataaatctgaaatttggcagtccattgtttcttatagataatttttatagataagaccttagaaaggacttcctcatgtgtacttttttttttggcaattcaggaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaaggtaagatcattagaaatatttgctgttcattgacatgtacttgctatgggaagaatttacatttcgctgttttgccctcagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggtttatatttaaatgttcaaatttgtgacatgaaataaggatgtgcagtgtaaaaataaaaggggttcagacttaaatttgaattaaattcacaagaacacttgggatagaaaatgaaaatttgcattactgtgtgaagtagatcccccaattatattcacaaaatatatattttctaaaaaccagatatattggcttttaataagaactacaactgactgtgagaggaaagaggtgctagcctcaacagattaaaacacactttctcattttttatgcctgagatctgctagattataatgaggatgtcagtctgttcatttggactaataattatatctgtttactggtttaacactcttactcccactttgccaataaccagctaacaggaaatcagattatctgagggtacagagaatcagtaaataaaggggatcttaaggtatgtgccttaaccagggtagcttaaaacacttccctctctactgggagaatcttgtcaaggaaactataacaggcatttttgtctaatgacaactttcccttggttactgcctggatgggcattgccaagccgggtcgctgtgacttttttcttctctctgtttctttatgtcctcccccatcctgccccccaagagtaatcagtgctggctctaattcatgttccgtctttagctatataaccttcagtcaggttatctttttccataatggcctacaggacagtctctcaatttgaagtgacattttatttctctgctttcatctactatacactgttatatttgaaagtttatttgggagatttctcttattctgaaatctctgaaaattcagctaatcaaacatttattcagctctttctgaggggcattatgcccaggcgatgcaaagactcagctcttgagaagcttgccaattctactcagagacaaacatgtaccagagggatatttcagttatctattgctatatagcaaattatgcaaaatttgcttaaataatgattatttctcatcattttgtgggttgatgcatcttggctgggtggttcttctgcttcacatggttttggctgggattactaactcgattacattcagctgtcagttgggctcatctggaaagtacacaaaggcctcagtcacatgtctggtgcctcagtgctcctccacaaggcctctctacatggtgagctcaggcttcctcacagcatgatagtctcagatagttggacttcttatgtagaggttaactttaagagagaggaagcagaagctcttaagatttgggcgtggaagccccagaacatcactttcacagcattctcttagttaacgtgaatcataaggcctgtccaaattaaagaggacaggaaatagcttctgccttttggtgggaagagttaatgtatgcatggggaagaactatatatccatctttggagacaatgacattagatgatttaatagtgtgatcactgtttacttattaagataggcaaggggtgctgtgcactacagaagaggggttcttagttcatcctagagaatccagggaaggcatacgggagataatacttgacctgaatcttaactgatgttgatgcttgggtgtgtaaacagatggaaaagtaagggagggtatccaggtgcaggaaacagcattgctataaactctgaggtgtgaaacaggattgctttgaagctctgaagtgtgaaacagcatggtacattcaggaacctacaagtaattctttatttttaaagttattccattctttgagatagaggcaatttcttcagtttgagcacttgttttccctaaattcaatgatgattttattcgttttaaaaatgctatttcatatctttccttgaaggactcgagagcctattttcatctgcttaatcagattgcccctaaaggtggggaagatggacctgccattgccattgacctttcaggaattaatgtgagtgcaatttttaacttttaaaatatattgtggtaaaacagacgtagaaaatttaccatttttatcattttcagtgttcagttcagtggcattcagtacatttgcattgttgtgcagctatcaccattatccatctctacaaacttttcatcatcctgtagggaaattctgtactcattaaacaataactccccattttccccttcccccaggccctggtaactactgttctactttttgactatgaatttgaatttcagtagcaggtacagtcaaatttagagtacagttctctacaagcagcattccccagtagagccctcagccctccattaaagtttggtgctttgctctatggaagttttttccatgcccaaggctccaagcctccatgtcaagccaactggctatcatgacggaagaaagggaactgcgtaattgtgacctggagtatttgtggaatcaatcctacattcatgtttccctggtgcaaggcaattggaactcaccagggtgctcttttgactgtcagcatatgccaggaaaggaagcaacaacctgttgttagatttttaagcaatcaattatcagttttaccagcttatatttagaaatctacaaaataaaaatagatattcatggtgtaggaaggactgatacagattctgacctaccaagcatacttcctaggaatctcattcttttagcataagttataaataccagggatggttctatctaaatcaggatgtccagtcttttggcttccctgggccacattagaagaagaattgtcttgggccacacataaaatacactaacactaacaatagctgatgagctaaaaaaaaaaaaaaggtgcaaaaaaatctagtgttttaagaaagtttacaaatttgtgttgggccacattcaaagctgtcctgggccgcatgtgacccaccggccgtgggttggacaaacttgaattctaaacattaaaatttggtcagataatagactgtatgaaaatatatcacgtacttaaagtgcggcgtccgtaacatttggttttaaaggcaacttgagtcattactaattaattatatctcacattattataatgacatatttcagaaacacagtattgcaacgctctgtaaaatgtgcaaatcattttaagtaaaaaaattaggaacttaaacttatggaaaattttgaatatattcaagagaacagacttagtatactaaactatcaggtactcatccctcagtttcaacatctgccaattcatggtcaatcttatctcgtttattccctatttctctcctctcctatattattttgaagcaaatcctagacattacttcatggataaatatttcaatatatatttctaaaagacaaagacacttttaaaataaaaccacaataccttatcataccttaaaaaaattacaacaatctgtaacatcatcaaaatatctagtcaatgttgacatttccacttgcctcataaatgccatttttttcatagtttatttgaattaggatctaaaataaggtccacatgttgtctttatttgtttgtttttttttttttttagatggagtcttgctctgtcgcccaggctggagtgcagtgacacaatcttggctcatggcaacctccgcctcctgggctcaagtgattctcctacctccacttcctgagtagctgggattacaggtgcacaccaccacacctggttaatttttgtgtttttagtagagacggggtttcaccatgttggctaggctggtatcaaactcctgacctcaagtgatccgcctgcctctgcctcccaaagtgctgggattacaggcatgagccaccacgtccagccacatattgtcattttttgatgtctacaatggtaacttttctttgttaatttaataatctgttgctttctctgatttcatttatatgattaattattttgcaactctggtgcacagaattaggtaggttatctttggtcatgatatactcatatgggtctgtgcatacccatttttaaatttatttttgtgtgtggttgtttgttttgaaattgtaacaagcctcatgaactctcaatctaacaggaaaactaaaactttgacgtgacattttctgtacagttcttccctatcccacctcggttttcgcccagtgtggtaaccacagtcttgaatcttgtgttcattgttgttctgcttttctttttatgtagtttcccttcatccaaatgtatcccttacaaaattaaattcttcattttactttttaacttcctttaaagtttatcatgttatacttaaatttctagtacttctttttggccttgtatctctaagagttacccatattggatgtcattgtgtgaatatacaaattcattcatctactctcctgtttataggtatttgggttgtttcatttgtttccagggttttgcaattgtgaaaggtgcttttccctatgattttaatttttaaaatatgtatttcaacttgtttttcatcaagaagagccttctggaaatgtcactcagtgtacagtgggtatgataactatgcctgttatccagagggcactctactagctggtcttgaataagttatctatagtgcaaccagtaggagcttactgatacaatatttgaggattttgctgagtattttagcaaaaagggtaaaatataactcagttatcccagcaaggaaattcagagacttttttccttttaacttaaaaggcacgggggctgggcgtagtggctcacggctataatcccaccactttgggaggccgaggtgggcggatcaggagttcgaaaccagcctggccaacatggcaaaaccctgtctttactaaaaatacaaaaattagctgggcatagtggcatgtgtctgtaatcccagctactcaggggctgagggaggagaatcacttgaacctaagaggcagaggttgcagtgagccaagatcacgccactgcactccagcctggggaacagagcaagactctgtctctaaatacataaataaataaataaataaataaataaataaaggaatgggtaagttgacttggaattactacacattttgatcttattttgagttattatttgatatatttgtggaaaagtaattgcttataaacatgtataccaataaaaattatgccaattaaaacttcaattgtaaccatttttgttttattgtttaggagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccatgcctgcacaagccgaataataatgacatcgatatgaatttactggaaggtgcgttctttctgcctttaattgacttgctatatttatcttcttatggtattgtcttacttcactgtcagagataggggattgtggtgggaaatgcaatttagtgtgtgtaggtatgtgtatctattgaaaaattaaaattatggaaggtggttgctggttttggttaaaagagaatgctggggtaaatcttttatttctccataagaggttagtgaaaactatcatacatttaaaatattctcataaatgatcacataacagctctaccaccaacatggacaatgaattatctattagaataaaataattatttgtaggtgtttttctcctttgaaaggtccagtttgactctagtattgttctctttttaaggtttttagtgtacatgaaaaaaattacagtgttcgttatttgtcttttgtgtggtctatcgttatctgtctcataatatataatactttcctgttttgcttcatgaaatgcagatttgacccctcctaatgtaggtactgtatttagtacttttctatactctataaatatattcattctgaatgttctttttattagtaccatttattctttccatctgggttgatattttactttttgcattgttcatgctgtgttatttctctcttaatatgcccatagaatgaaacacaaataaaacttaattagaatagcagaacaaagctttgattttgtaaaatttctacctaatttgccttctataatgatgggatattgtagttgtaaacacattagaactcaattttgagaactggaattcatgatttgatgtaaaatctttatccttctcctgtgacaaaatgtcaagtaatctttgaaaggattcatttaggttctataacatattattttgtatcaattagctatgttatatttactgaacctcattgaagcttacagtatatgaatcataataacaaaacattctcaatacccagttcttactcatttgtttcccagcctttctttttttcccactctcatacataccaacacccacattagtatcagaacttaaagtaaaaacagtggcagtggtaatggcagttgttgaagggaaaggcagttgtcagaggaaggcgccaatcttaagatttttcttgctaattgccctggtttggagaaagcagggattcttcttggtggggagagtatgatgtgcggtattcacgatctcagtgttcattctctcacaaaactcacacttatcccttctttcccagtgagacagaatgagaaatcaatttcatgatctttttctgcttgactgccataaccaaagttccagtgtccttgtcacctcataattacagttttgtgattaatgaacgacgtttcagatttaacaaatatattcttcaaagaatatgagtaattcattcttcttgaaggtcccgtaaaataaaataaagattatattttctatgtagatatgtaactgagagggaaaatagacaaaaaatgtagatttttcagcgaagagaaatttagggtgagagattagaacttgaaaaaaaataagcaaaagcaacactgttaggttttatcagtctggaaaatttcaaaatccctctgtcagtagaaggcattgtttagagtggcatattaaaaatgatctgctttttatagtcactgaattcttgctaggtatcttttccaacttgctcgctttcttatttttcatgtttgaattctttttgctagtgttcagcatgcttttggaatttttcagtgtgaataggattgctaaatatttccattattatttactgtctattaagataacatgggaaatatttatcagtcatctttattatgtatgtcctcatacatctgccaaaaatgtatttgactttgactgtcattggattattttcctctgtaaatttgtgttttaatatatccttatgaaatttgaagcttgatcatatcacatcccaaattcatatgttagtatgtcctcattggcagagaattttctctctagggaattaaataaaacacaattaaatattaaacgctcacatcaaattgaaccagatatgtgggctacgtacagaaagatcatctcagaattcatttatgcttacagaaggtacacaggccataaactatcagactttgttcaaatcatagttccactatttaatctgaatgacctctgtgagccttggtttttttcatatataaaacaagactaataaacttaatttgaagagttacagagcaagctaaatgtgatcatgaatggaagaatacagtatgtgtttattaatggtcagggagggaggaggaaagcacttcatatgtcacagcacatttgagtgttaaatatatgttaactcctcttttccctcttagtaacctacttctaagatatttgttatttttattactattttttattatttgtagacgtcaaattgagcctgcaaatgaaaagaatgttttatagttctttcaatcttgtatatcagcaattaagattttacttcttgaaattgtatatcagatctagggggaaaaaaaggttttacttctaagattgctttagctgtctataatccagacaacattttccaatctggaacacatatatctttgtaatgctttaccatggctgttgcacaaatgcatagtgcctctagctttgagcatttatttaccaagacactttgaaatgttattagataaataaatgctcatttataaaatctattttactttccaggtatcaaaaattaaaataattatataatcagttgagaacaataggaagaaatatgaacccccgaagatagtttcagaactcaatcaaaatgcaagtttagttattttaaaatattattcactgcatcattaggttcaacagaatttggatattttaattaaaaattaaaccattatggcactattaatcttcataattttaagacatttagattttcctagatggaaataatgtaaaacttctgtaactattagaaacatatatatatatatctttatgatagatagagaaacaactgagaggtaaatccaaatcaaaggcatcaagttattgatcatagtatgtttatatttatgtcactttggggatagttcatagatttaatttgtacctgtttaataattcctacaaataaggctggcatggattctagaaatatttagtttagcttggttattcttaaaaaaagattctcatgtagactgtttattataaagtggtggtagcagatacaacagactgatcagttaccttttatgcagaccagagggaacaaaatttaagcaagaaattatagggctacataatagagcaataattaaagcagattctgggaaagctgttagataatggcattgaaatcacatgaaactacagtgggtagatgatttcctgaacagttggcacaaataacagaatcctttagatctgacaaggcttgcgttcctatcatgggtgtgcaggtttatactgtctttggcactcaatgtgaagatgactgttgcaatcgctctatacgaacgagcccctggaacgcagatgattatagatttatgtgccaaattgtcctgtgagtctcacatgggccaaaatctagagagtgacttgaacttgcctataacttagaagtgatgacaggtgtaaatgtttcagtttttcaggagtctgctgataagatgtaaactaggccattccactgtctaataactttgccgaagaacaaataatcatgatagttacttagaactatttgcagtcaggagatgactagaaggcagacagtggcagagccagcccacatccctgctcactttgtggtatactatgacccgcattttccttatagatgatgtaagcactgttacaaagggaatgctcagggaggtatggttaaataacagcacctgaaggagttatctccttgaggggatctttgaggtccaggaacttactatgatgaaatctgtctttctcttatcaacctgtattgggtctgtgttccttatgtattttcagtaatgataatctaaactaactcaggaagcctgtaaaatagttatattcccctcattgtgtgtttttatatttacctgtaatcccctctgcccttcattgtgtggtgtaaagtgtaggtctgtgtgctgagaaactttcctatgtaaaaccataatttgtacaaatttagaaacactgcaccgagaaaggtataacttttctatttgtgtttaatgtgctaatgttaccctgactgcgaaaacattttgtttttattaatgtttagtgaatcccttttgcatctaatcataattatagaccacagaagtgtatctgttatttctaggtagagaaacccatggctcagtactagttcacagacatcaaagggaatctagaaggagagatttagagcaaatggaggcttcctagatagtaggaaagaagggactttggcattaagagactttttttctccctttaaagaaactgtagtatctaaagaaccatggcaaggtaggtttgaccagtttgtacctgctagaatggtttaacatatagttcctggttccttttgtcctgagtcatcagtgtgagcttgtgtctactctaggagagagcaaggaagagagaacatttcggaactggatgaattccttgggagtcaacccatacattaatcatttgtacaggtaaatattttattgtgtttcagctttactgtcagggtccaacttttcaagtttcaaactgtaggcatgtttaaatggaacattttctcaagttgcaagaattttagccaatttttagagtttcaggatgctgggaattggcaatacaatggattttaaaagaaagctactattcaaaaaaggaataatagttatgtttttgatgatatacgtaaatcagtaaagataatccttttttatagttattgattgtaaaaataatttcaactttaacagattagagtaacagtaataactgataaattgttgttatatcagtatttttattatgtcatttttcatttatttttgccaaaaccttaattattccataatttttgtgtatatttttttctaatttgtaaaagtaacttgttttccttgaataattgttatagcttatctcattctttcttgtttaaaaaatgataacacattattgacattagtagggctaagaaaatattttactaaatcaactcctgggctaacgatgcatctttctaagtgtggatgagaggaaaccattcttctctctttattatacaatctaccagcctgccttgataaagtgcaaaataagccaacttcagctagttgtatttttttttagaaaaaagttctaattagctaaatgtattaataatttatatacccaagaaactccttaaacaagattatgattaactccttaaagaagattaatgtcacaacaggccaagttcactggttcactgaggatttatgatgttgtaatttctgctccttggtgtttattcacaatgttctttaaaattgaaaaccagtgttaccttattatggtaactggctttgatgtgatagacccatatttgtaaagctcttaaagagtgtgtaaatttcagctggatgaggagatatacgtcaattagaccagagctcctgttacagtagcagggaagttaaaacacaaatattgaaggtgaggagggattcactttttatggactgatttgaaagaatgtctataatatatagtcaagaaaaaagaataacaggtctagtatgatcccattttgtttacaatttgagtgtgtggatatttgtattcgaattttaaaagaaaatctagagaggtacatagcaaactctatgtagcctgggtagtaggagtagagaatagtaaggagacttacttatttatttatttatttatttatttatttatttatttatttatttgagatggagtttcactcttgttgcccaggctggagtgcaatggtgtgatctcggctcaccgcaacctctgcctccctgattcaagtgattctcctgcctcagcctcccaagtagctgggattacaggcatgtgccaccacgcccagctaattttgtatttttagtagagatggggtttctccatgttggtcaggctggacgcgaactcctgacctcaggtgatctgcctgcctcggcctcccaaagtgctgggattacaggcgtgggccaccgtgcccaagacttttacttttaatcttagtaacttaaacatgattgcatttttttggaccatgagcatgtacttttctataattaaagagtaagcttaaaaatagcagattaaatcgatttgttgatactcatgtaattatttcataaatgtcaggaacactagagttctatcactgacagtggagaaaagaattgaccaaaccttttagctaaagatatctgaagaatatctttattcaagaaataccagcatagggcttctgagcatatagtattttttcttgcaaaaagaactgttactttcagaaaattcttaaaagtaacataatcttggagaaccgtcagatgtagaagaacaataggtggacatctagttgacactggaaccatgtgtccatagaattgtgtctgcatcatattcctaaacccacccccaagaatttttaggttcctgcctatagtatagccagcccataccaaaacagctagattttcactgaaaattctcttctctaaaatgttatatatttcaagaactattagtcctagagtttttctatgaccagttcgttctagaactcatcttgaagtctctggaaatcatttaaactctctggacctcagttctatttgcaaaataataataataataataataataataataataataataataccatactagacaggaatgagaatgaattcatttaaagtaaaaaagaaaaatacatgaaacataagattccagaacctatagaaatacttcagtgatttttttttatacagaatgtttcatgtgcctaaagataatctattcagatcttaattaccttcatatcagactttctccctctatcacccagtactgggcccagctcccttcactgccatatggtttgtgctcagagaatgcaaagtaatttaatatgaaccttagcgaaacataacttattggacaagctgttggaggagaaaagccatataatatatcacaaagctagcaatttaaaaaatcaattgctattgctttatgtccttagcatacagcattgaaaatagactaaacagccatacgttaaccttctcaggagaacatatttttctgaatccaaagtagtaatatttttactttgagaattcctacttgttcataagttccttcctcttaaccctcattcccgaacacaaacagctgcctactgagtagctattgtgattttcctgtaattatgttttaagttaaaaaataatgtataaataatacaggaacttattcttactgtacaagttttaggaagtatgtaagtatatggaataaaataaaacattccacccttactctctcatactccccttttcctgacctctttctttacctaatagaggtaattgctattaactgtccttagcatatataggtacataaatacatttgactctaaatttttttaaataaatgagatcaaattgtatgaagtgttctgccattttctttttaaaatttgatatgtcttgcaaagcttttcatatcaatacatagagatctaccttatgtccaatggtggccaaggagtttatagtatagtttacttaacagctccctactgccaggcacttaagttgtttccaaatttataaatattgtggcaatgaatgtccttggatgtatacctttgtaaatatttatgtaaacattttggacagattcttagactggaagttctgggtcaaatgatatgtcctgtcattctttaagaattaaatgacttatgttcttaaagatataagtctatctccagtgtacttaataaaattaggtaatacccaacatttcctcctcctttatctgcttttccttcctgcttcagtgaccttgcagatgctttagtgatctttcagctctatgagatgatccgagtgccagtcaactggagccatgtcaacaaacctccttatcctgcccttggagggaacatgaagaaggtgaatgaaataatggccatggatatattgttattgttctgatatgaaacaaagaatttagagtttcatgaagttatacgtgctctgtccccacaattctgattcagaccaaaatgtgttaagcttaatagcctttttacaagtttgctttaataaatttgaagatgaaggcaatccctctagtcagacactttatataactattttcatctttatcaagtcatagtacttaatgttctttgagatgtcctgtaaatgtattctttttttacaattggtataacgttctgaatgtttattggttatccactcatttattcaacagatatttatcaattacctaatacctatacagtgttatgcaggatgtaaaaaaaaaaaaaaagtataaagcatggagttggtcctcaggaaagcctaaataaattagggaaatatgtgtgcaaacaactacaatatggtacatggtaaacaaaagtgaatattatgagttctagggaagaaagttgaagagctactgaaatagtaatagcaaaatgggaaagacacatgaatgaacaattcatagaaaaataatgatgaataatagaaatatgaaaaacttttcacccagaataaagaaatgcaatttaaaacaagaaactattgaactgcatccaatgtaagaggaagtattcatttgtataatccttctaaaaccagtttgtcaatacatattaatcttccaaaaaatcttttgacctaatttcacctttttccacctatcctgatgaaaaaatcagaaagacacaaagttgggtggcaaaatgctaatcatagcaatgtttatacagcacacaagaaaacaacctagttgttcagtaaagggttaataaaattgatacacccataagatgaagtaaaatgtgccattaaaaatagtgtttgacaggaacagaaaaccaaacactgcatgttctcactcataagtgggagttgaacaatgaggacacatggacacagggaggggaacatcacatacctggacctgtcaggggttggggggcaaggggagggagagtattaggacaaatacctaatgcatgcagggcttaaaacctagatgatgggggccaggtgcagtggctcacacctgtaatcccagcattttgggaggctaaggcaggtggatcatgaggtcaggaattcgaggccaggctggccaacatagtgaaagcccatctctactaaaaatacaaaaaattagccaggcgtagtggtgggtgcctgtaatcccagctactcgggaggctgaggcaggagaatggcttgaacccgggaggcagagtttgcagtgagccgagatgtgccattgcactccagcctgggtgagaaagcaaaactctgtctcaaaaaacaaaacaaaacaaaacaaaaacctagatgatgggttgatgggtgcagaaaaccaccatgacacatgtatacctatgttaactatcctgcatgttctgcacatgtataccagaacttaaagtataatcaaacaaacaaaaaatagtgttttagtaatagtggtatggaaatgagcaggacacaaaattatatatatacataatatgaatctaatttgttcaaaatacataacacatacagagatgtattcaaaagggacttttagttttccacatctatagaatgaaaatgtatttatagacactaattttaaagaaaaaaattttaaaagacttttaaagggaaatacatcataatattaaagtagttaaatgggtggtataattataaagagttactcgtatgtttcagcatttctagtcattggactgcctgcatttttaatttcatttgatttgcatataattcttttcatgggagtagaattcagaaaatttattgactaatttcatgtaagttttttctccaaaattttgaatgcaaaatgtaacaggaaaacagaaattaaccattcattatacctggaattttaatgtgaactacaaataaatacatatgtcacaaatgaatcatatgcagaatactttttcaacaaatacagaatgaaacataaagcctgaaataaattcaagatgtttaaaaaatgaagaagcagtactttcatgacacagtatcacagggaattattttatggaatttgggcaataatcaatacatgtcactttccttcgcttacaaagttcttaaagctgcaccattaaaatagcctttcttcttcattattattattattattttatttatttatttatttatttgagatggagtctcgctctgttgcccaggctggagtgcagtggcatgatctcggctaactgcaagctctgcctcccaggttcatgccattctcctgcctcagcctcctaagtagctgggactacaggcgcccgccaccacgctcggctaatttttttgtatttttagtacagacggggtttcaccgtgttagccaggatggtcttgtctcctgacctcgtgatccacccgccttggcctcccaaagtgctgggattacaggcgtgagccactgtgcccggccttctttacttttaagtatttcttttcacttgaacccttgtgtcccattatgtaactcttctcattgtctaaatgatctaagcttcatttttgtccaaagcatttaaagtacttggtaattgatatggtttggctgtgtccccacccaaatctcatcttgaattgtactcccatattcccatgtgttgtgggagggacccagtgggagataatttgaatcatgggggcagttcccccatactgttctcattgtagtgaataagacttaagagatctgatggttttatcaggggtttccgcttttgcatcttcctcattttctcttgctgccaccatgtaaatagtgccttttgcttcctgccatgattctatggccttcccagccatgtggaactataagtccaattaaacctctttttcttcccagtcttggatatgtctttatcagcagtgtgaaaacagactaatacagtaatcatttcttccattaactctgtgagactgcactccaagtttttcttgctttctttgtgctcattcttaccttgcataggttcttcatcttttagcctgagaactcagtatttccaaggcctggttcttgggccaaaggtcttaacttttatatttacaccctcagggagcagatctgtttttagtgttttaattgcaggttgagtatcccttatccaaaatgcttgggaccagacatatttcagatattggaatatttgcagtatactggttgagcatccttaagctgaaaatctgaaatgctccagttagcttttcttttgagtattgtgttggtgctcaaaaagttttagagtttggagtattttggatttttggattttcagattagggatgctcaacctgtactaccatacacatggattacctctaggaacctaatttctcattctttctctagtttggtacctctctagatctcttagaagtgttctgccaaatttggaaccaaatattgcccataaaagaatatatgctttcccttatgctagcacctatttccagtttctctttcaatgctggtcctatcaatatattcttaggcctctatactagcaaccctgaactcctttctcaccatcatctcccttaggaactttggtagaactgtaaagcagatggctcttcattgaaacacattttacacatgtgattactgcagtttgctataaaattctcccactgaactgggtgtccatggtaaatatgctggctttttactctcctgtacacagtgttaaataattcaagtgctaatgttattttccataaattaggaatctattctattttttaaagtctacattcttacagcatatatttcttttaagcgggctaagcctataatatgattccaaaaaatgttttggaatattatctctgcattaaaaaattcttttaaaaactttttagaagtagggtttcactatggtgcccaggctggagtgcatgctattcacaggcgtgattatagcacaatacagccttgaactcctgcccttaagtgatcctcctgcctcagcctaagtagctgggactacaggcatgtgccaccacacccagcttctccttggattttaaaaaaatgaatatatatcaaacattttattcaatttgtgaagttagccaggcagatgttacagcaggttccaaagatcttccatttttatttgtagtaaattgaactttgggaatttggattctcttttttaagaacaataaccatatatttgtacaaattcttttattgtattagctgtctcacatttcctgcaaatattttcttactattggggaaaatgtatctgtgtaccttaggttagactgttttgtaatggtaccttaactaactcgtggaagaaaattaagaaaagtagtgttctccttttaagtgtttattccaaaaagtacttagtgtaagcacttttgttcctactggtgatataagattatgagagcttataatttcactggagcaaaaagactcagatacataagaatttataagttctgatgtaagaaacacagcagtagatgatgcaggtaaaaaaccctattgactccaggatagataaaaaaaattattagagaaaggacctaactggacttatatcactggaaagaagtattgtggttggggagggtaaacaatttattaggtgtttatgtatcagattcttactttaggcagggcattgtgctgagagtggggacagtatgatatagatttgtgcacgtaaaaatttttgtcctttagaagaagcttatactctagttgttgaaaggaaacacatacaaggctaagtatagtagaagatggtgcataagcattacaaagtaagcattcttaggagttcaagcaaaggatagatcattattagctggtacagttaaggttaagcctttattgaagaaagtgggccaaaagctgaatttcagaggataagtaagatctgggtaaagaatatcggagatgaagttagattcttaataaaacaattactttcttttctatttttaaattttaaatctacacaaaacatcatctattacttctatgaaaggaaagcaggacacctaggtttttaggcacacatgtgccattaataagctatttcatcttggatagtcaagaattttttttttttttttttttttgagacggagtttttgctctgttgcccaggctagagggcaatggcgcgatcttggctcactgcaacctccacctcgcaggttcaagcgattctcctgcctcagcctcctgagtagatgggattacaggcacccgccaccacacctggctaacttttgtatttttagtagagatgaggtttcaccatgttggccaggctggtctcgaactcttgacctcaggtgatccacctgccttggcctcccaaagtgctaggattacaggcgtaagcgaccacgcccggcctggatagtcaagatttttagagtaggaagggatcttaaaactttccggccagttgttcctctatctaggttaacccactcagtgctttaatatcttcaactataaaatggaaataattatgtccttgctttccctgggttattattatgaaattggtcatataaatttaaggtgtcatcataattgtttttcagatggctgaactaggctggcctattctggagatatgtttttaaaaatctttttatacccaaacttttacttatttatagattgaaaactgtaactatgcagtggaacttgggaagaacaaggccaaattctccttggttggcattgctgggcaggacctaaatgaagggaattcaacacttaccctggcattggtatggcagctgatgagaaggtaaaggctgatatgttggtagcaacactgcctgtttcctccaacaagtaatctgaaccaaatttttagctatttttgaacaataatgaacacagaagaaatatacaatgcaaaatattttaatttttaaaggatttactgttgattatggtttttttgtaaattatattttatttaaaaatgggtcaatatccagaaacactatcacttttattaatgcctcttaaaaatggcttcataaggaattgctttaagttttaaaaataccatgtagtagtttttgtttctgattaatgaggtttgtaactttggaatgtaactgggtgcaaatgccagactaaaattagaaatatttattagaactgaactatttcttaagtatttatctaaacattgatataaattatgtgaaagcaaatttcacccttttcagtctcaaatatacatcttttctgttgcaggtacacattgaatgtgttatcggatcttggagagggtgaaaaagtaaatgatgaaattataattaaatgggtcaatcagactcttaaaagtgcaaacaaaaagacttctatttccagcttcaaggtaatcaagagtcctaaaaaaaatttttttttgtaggtataggaaggaattttttttttttttttttttttttttttttggagatggagtctcgctctgtcacccaggctggtgtgcagtggcgcgatcttggctcactgcaagctctgcctcccaggttcacaccattctcctgcctcagcctcctgagtagctgggactacaggtgcccgccaccacacccggctaattttttttttttttttgtatttttagtagacatggggtttcaccatgttagccaggatggtctcgctctcctgacctcgtgatccgcccgcctcagcctcccaaagtgttgggattacaggcatgagctaccacgcctggccaggaacgaatttttattggaaattacattggtttggtttagaaatatattaatgttgtatgtcagaaacatgatttatgagtttaggcatactaattatttggcctgtgtaaacttgaaatattcagttttaattactaaatttttgattggttgtccagttaagtataaatgtaggttaatattatctgactctggtaatctaatcttaaaaaataaacagaatagagctaaaaaaaatccagttatcaaatgaaaaagataagaagccattgtttatataggacctataatgttttgtgctccctagcagcagtctcagaattgtattgacatcatttccaaggcataacagagccagccaaaccgattcaagtgggaattgagaaaactggtaggaaaaaaaaaatcttgtcatctggcttcataatggcacttaacactcacttccaagcatttgtggatgattcataaagcactcaaaatgtaatctgtacatacatacccactaattttcatgcatttccattgtgttttgcttttgcatgcaagccgatgttagctacaaataagcatgtctgcttgtacacattcattcagtgagccttgtgtttgtgattttattatgtgtgaaaaactagcaataaatttgtggtttttttactgaaataaagtacaaagagatgaaacactaagctatcctaagagattatctacccatttttatttctctctttgccttcgctctatatgcttaacaacattgcaaagtgaaagaaatgtcagaaatttatcagttcaatcttctcatgtttgccaaaaactaagacccaaaacggttttaacaggacagctggatattggcagagacgttgcctgagtcctagttcaattgatttccacccccccttttctatcttggaagaaactaatgacattgagtttttgttactgcttgttttttttgaagtaattttcagtgcatgatttgtctctctgtgttttaaacataaaacacaaaaatataaaatagcaatggggattgtattataaaattctctaattggcagttattctttaaaattgttatgttgaaattatatgcatttgcacattatagaaaatattaaacatgtatatagttaatatgagaaaatatttaggagcaaattaatatttattgagctcctattaagtaacttttataagtaaagaaaaaggcataaagtataggaaattaatttggccctcagagtgttcaccatttattttaaagacaaagattgtataactgagaaggtaacaatactacagagtaataaaatccaagtaatgcaactaatattatggatgaaaagtctgatcatttccaattgaatggtcagtgaagagccgataaagacagctggatttgaacatcatagatggtgggaggatttgaattagtggagagaaagggggataacaaacttagaagggtccatcttgaataaaggcatgtctcagaaagttaggagaaataggacggttcctaagggatgttgcgcaagacataaattgggtcaagattgtagaggattttggcctaaataaaggatattgagtaaagggggtaataagaaaggcaattattttaggaataccaatctgaatgtagtgaacaggatggggagggagaatagtgtaactgcaaggacaatgcaaaagaatccaaggcagtactcaaggtgtgatgtaataagggggctggggctgggaatggaaatggtaagattagaaagctataagttattgcaaaagaagaactaggatttggcttcctgatctggggaagaagaagggagggaggagccaaaactcttcatgttttgggcatgggtaaccggaaaacagataacactaatagaaatgaggatgtcatgaggtacagctacttcctggaaaaggtgatgagttcagttttaagcttgaatttgaggtaattttaggaaaatgggggtggtgaaaggagatactaaaactggaaagacagacttggtgatcagttgaataaaagggttgagaaatgggagtgcataaaccttttaagggagagcaaccctagagaacagccgacctgagagtttggctctacttagaactgaggtggcagaaacatcgcgaaagtgcttggcattttgcatatgcttaatgataaaatctttaaagagagtgcaaatggttaagaaatgaggcagtgaatgctaaaacatagttgaggtgagggaggtatttttccaactacagaaggcattatgtttgaaggctataataagtggcactagcagaaaaattttaattataaacaaggtagcactataggaatttcagaaaagacaaatttaccctttttagccataaatttcccttgctaagaagacagagaaggtggtagatcagcaaataataatcataattaccatttattgagtccttcgtgtcactatgttaagcactttacacattgtttaattttctaaatactctgagcaaaaaggtgagcattagagaagttaagtaactgtctactgtcatacagcttttaagcagaacagctgggtttcatatccaggtctgtctacacacaaggtgaaagccaagctttggagttgtatggccctgggttgacttttggctgagctactgattagctgtgtagcatactgctcatttattccataaatattcaaagcttgccctgtgtcaggtgccttgctagtcgctgtggctacatagtgccctcaaagagctcactattcagggaaggtggcaaataagaaaacaagaatcacagtatggggtgtcagcaatactatataaatcagctaaggggggagtgtgggaccacatgagaagggcatctgttttacagaaaccttagcggtttaaactaacagcagggctacatctactgatgaataaaacagagcttacttctggctcagcatttagtatctgtgtgaccatgggcaagttattaatttctctattcttcagtttccccatatctaaaatggggaaattaataatccctctctactaagattgttgttagactacataagttaacaaaatgtaaagagcttaacagtacctagcacatattaagggctcaataaatggggcttaccacgctgttggcattgctaatatataaagggcatcatatgtggcaggacaggggactctgctgagcctcttagggaagtctggtgtccacatcactgtttttccagatttatttgtttattttatttatttatttttttgagactgagtcttgctctgtcacccagcctggagtgcagtggcgcgatctcagctcactccaacctctgcctcccagggtcaagcgattctcctgcctcagcctcccgagtagctgggactacaggcgcccgccatcacgcccaattaattttttgtacttttagtagagatggggtttcaccgtgttagccaggatggtctcaatctcctgacctcctgatctgcctgccttggcctcccaaagtgttgggattacaggcatgagccaccacgcccggcctttccacttttattttttaaaatgacagaaacagcagtggaatgaaatgttctaatacatatcaaatagagggaaaaatcattatcttgaaaatcaagctgtaggtaattctagattaagatattgaaattctttttgccgaagtcatttctttatgattaacttaaggaaataaaaggagaaataatggaaatgtatttatatactaacctaagggttttcactataacccctttccctttgcaaaagtaaaatgtctttcactgataatgtacaaatcagaggatttggaagacagggctattttcttggaaacaagaagataagagatctgatacaatctttagaaacttaaattcttcattaaactcagtagaagctttacgcaaggtaactcataagaaaatgggtgggaaaaatacttgtttcctaaatctaaatgaaatatttaaaataacacaaatatgtaaataaggaatcaaattatagcacaattaaataagtcacttgtattttaaaaaataatcatatacatatatgaaaggtaagcccatagaaattaaaatgcattctagaatgaaatattgtttttagaaagtataatacagtacacatttagagtcatctagaaagcttattaaaaatgtagattcccagcctcattcatagataacctgacattagtttgagtggggctagatttgcacttttaacaaataccccacatgattttcatgtaggtggtctgcagactgatttctcagaaacagaaaagatacaaaaagcagatccagattaccagcatcagatagacttaaaggacctaattatttttaccctctctctcttacccctgcccagagatctgtatcataaaatgaacattacccctggccaaagatctgtatcataaaatgaacattcctgcccaaaaatctgtatcataacatgaacataagaatataaatttttctaaaattaataaatgaggccgggcacagtggctcaggcctgtaatcccaccacggtgggaggccgaggcgggtggatcacgaggtcaggagatcacaaccatcctggctaacacggcgaaaccccatctctactaaaaatacaaaaatatcagccgggtgtggtggccggcgcctgtagtcccagctactcaggaggctgaggcaggagaatggcatgaacctgggaggcagagcttgcagtgagccaagatggcaacactgcacgccagcctgggcaacagagcgagactctgcgtcaaaaaaaaaaaaaaaaattaataaatgaagtggctcatagattgtggctcaaagaagctgttactcttcttcacatggcttcagattgttttattagatattgattaagaactgacatttggctagagcctatactagatgttttcacctataccacctcagtattcctaagaatcctatgacattctactttagagattaggaaagggtgctctggcttcaagtaacagaaacccaatttcaagtggtttaaaccaaaaggaaaggtgttgactacaataacagtaatccagaggtagggtagacttctggattggttgaaccaataattgaagaatgtcattcaggactcttttttttttttttttttcccatctctgctttgccatctaatgtgccagcttcaccctaaagctggttttccttttggtcataggatagttgctgcttgtgacagaggtttcattctctcattcacatccaggaggaggggttgctggctttccataacataggcccaaattaaattactgtggtaatagaatagcattcctctatttggcttagaccagtgttttgaaatcttaaaagaaaattatcctctaaggaatatttttagacctttttttccgtttttgtctctcccatgaaattttaatgcagagatacactgtatacctgtttatgcactgtatgctttatacataaacaaggttatcaccctacccctattgagaatgcttgacctagattaatttaggttcactcctggaactatgaatgtcagctttccttgaagctgatgtctgtgtgaaggaggtatggatatagagcaaaaatatgggttctacttgtatgaaagaagtaaagagtgtgtagattctgggtaggcaagcagtggtggccactattcaagctgagagagaaaacaaataatttgttcaagtactgataagtggtaaaaatcagttcagaccaggatgtctgatttcatctgcagtgcgctattcactataatttagttgtccatttttagcttgccttggtggtaacttaaaaatggagagactcttgggcattttagagtcagactgtcatgggttctgtatttactggttgtgtaaacaagtcatttgagctatcttaactttatattcttcatctttttttaaaaaagaattcctttactatcaagatgctagggtttaaaaggtggattaaataaactaaaacatgtaaaacaacaagacaatgtctttgtaagtgttagttccctttcactatttcatttttctttctgaaaaatattaagggaaggcttttggattcatggtctaagaaatatgtgagtagaatttataaaattgttaattaaaaattcatctattccctttcaaaagttttgtattttttacagaatggacactatagttagcatacttaggagctatcatgtccacaaaccttattcagatatggtgacaactctatattatatataaagattcaaggaaaagtatattttaaagggtttatttatgtgtgctggttgcagaaaagctgaacgttaggttaagtacaaagaatttgtagattgccttcagttatatgatcagaagagtctgaaaataatgaaaattaaaggtcagatgtttatgaatgttcatctatgctttattttctaggataaatctataagcacaagtttacctgtcctagatttaatagatgccattgcaccaaatgcagttcgtcaagaaatgatcaggagagaaaacttatctgatgaggacaagctgaacaatgctaagtaagcctttatggtttatattacaatacatggccctttaattctctaaaatccttataggaaaagttactatgcccttaaaattcatatttttaaatataacttatatgtgagtcttagatttaagactcacaaacttaaccttttcgtaaaactaatcttgtcaaaatatttcactcttttgttaaaatatgttaagtgaaaacacagtggataacaccaagatatttttcttgtctcttcaagatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacaacatgtgtaacacttttcagtctgtggatatctgatacattaagatttctttttataagtattcattttgaatgtgcatatagttatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagattaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatatagaaatgtgtttatatttatttcatttgaagaaaaatattcagccttgaaaattagtctagcataagcttattttccagaaaagaaaagaattcctaaatgagttagtaaaacaaaaaaaaaattgtgtctgatttctttgaagatgagggtagttcttttgttcttaaatatgaagaattattaaaaaccaactgtgtgattactacaatttagtttgtgctgaaataattcaggtgaatcaatccattcacaaatttatcatttattatgatccagatactatgctagacactggggattcatctgaaaaaaatacagatgaagtctcctgacctcatgtatcacat

SEQ ID NO: 13421 - DNA, 5494 bp, Human
ggattttttatattttgttctgtggtaagattcccatctcctacaacaaagactggcacatagtaagtgctcagtaaataattgctgaactgcattaaagcagaggagggacatgctctgatgtataattttaaaaagtggattggagggcaatacggattgaagggcaacacgacaacgcagaaagaccagggaagaggctctggatggagatgcccacacaaaaataatagggacttggaccaggatgttggctgtgcagatggagagaagtgattaaattcaagctatatttaggaggtagaactgtctgcttttgccgatgtattggatgtggagagggaggaagaagacattgctacagatgaattacaggttacaggcttcggctattagatggatgaggggcagactaagggacagatggggaggcagggaagaaaatcgggaacttcgttttggacatggtaaggttgagatgcctgagacacatgagagtgaaggtgagacgtaggcacttgggtatataaatcttgagctcagaggaatgtagtgtgttttctcctgccccgaaaagctgtggtatagcaatagtgaatcttatcatcagtggaatattatagtgataataattatagctgatacttaggggcctctaaacttcttccaggtgatgaaataaactgtctctgtgtattacttcatttaattctcacagcaactatctttggaatttatcacttttatctccatttcatagacaaggaaactgagtgttggaaggtgaagtgaattgcctaaagtcaccagttcagcaaatgggaaatgtaggacttgacaccaagactgtttggccccagaggctatgctctgaaccataatgacttcctgtcttccaaaaggcaggctcttggatccatatcttactgtgcttctaaattatcctgtgaccctgaaccttagtttgctcacctgggaaatgaagggaggtcctggttaggttcccttcagttctactctattgcagtatgctgatctcttttgtaaatctgtattaaatgagagtttgctatcggtgactttcagagatgacaccagagatgatgcccatgctgacgattcattctgatgtctatgaaaagggcaaatcctttaagagaagatgtagcataccagtgtttataatctgagtttcatttgattaagaggggaagctctttagaacaaatatcatttctgagcgagagaatgttcagcatctcagcctcatttgtatcatttgataaaagggccccactgagccaagtgtgaggatgatgcttgagccagacacatagacaccagacattcctctgatgtctgctccccaggcttggccacattgcctcccaccaaccccatctcaatgacacatccattacctgccatcagttggctctatggtgctgggaatgacagagtgtatctaccctggatttcagaaaggaccctcctggcttatcatggcaacaccctttggacactcgtttaaagagtccttctttgggccagtgttatccttttgggggcatctggtatggacggccaatttgaatctgactgggacatgctaatgagccattcatatgtgtgggatttgtttctgattcgattaagcttcagagagaggaaagaaacagccactgattagagacataaaaaaagaaatactttaagtgagtaagtggttcatcttcatataggaaagtataaattaaacatggtccaggagatgcgctttgaatagcagctggatagcacaagcatgtccacaaggagacggtgcctcacagcaattgaaagggacttaacccccaaaaagggctctgaatatgctgagtaaataggtgagcccagttagctgataaaaatgactctcagattagagatgggaaggtttttatttggattttagaaaattgctccccactccatcgccgccatattgtctgtgtgagcagaggggagagcggccacagccgctgccgcttccaccacagtgtgaagaaaacaggtctgaaacaaggtcttacccccaagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttcacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacgtgacaattatgatcagttggtgaggatagccaaggttctggggacagaagatttatatggctatattgacaaatacaacattgaattagatccacgtttcaatgatatcttgggcagacactctcgaaagcgatgggaacgctttgtccaccgtgaaaatcagcaccttgtcagccctgaggccttggatttcctggacaaactgctgcgatatgaccaccagtcacggcttactgcaagagaggccatggagcacccctatttctacactgttgtgaaggaccaggctcgaatgggttcatctagcatgccagggggcagtacacccgtcagcagcgccaatgtgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaacgtgtctgaaccgttgcttgtggatttatagtagttcagtcataaaaaaaaattataataggctgaaaaaaaaaaaagaaaatttctccccaaatccctatgacatttaagctcattgtcattctctggcagcaccagtgacagtaatgggggccagagatcttatttcaaaacaaagaagtgattacagtagatagcgcaggtgtcaatgggaccctgatttggaacttgctaatacttctgtctctgagtttggggcttctatagggttttggttccatagatatgcctggacttgaactagcttaccttcccagccttgtgcatcgggaagctgtgagggtcagatccttctagattttgtgtcccctgacaagggttggaagagtctggctgcagccctggcctcaccagctggctccctcttgcgtaagtggagttgccacagggcttctgtctgtggctttccaaggaacctggagctgtatgtcatcttcaaacctggacctttcctctaccaccctggctagcttcacccttggtttcctgccctctgctctggttctgagtttgaaccaaactctcacagcagcccgatgtgcaggagtccaaatgtcctgcctgccccttgcagctccctctctcaccccttggggctagatctgctccctgcatcctcagcctctagtggggtactgctttgaatgaactcatcagctggaattgggaagcggtcaccttccagacactccatctgtccctatacctggagctttctcatatgagccccacacaatagattgaacctctggaaactggtgcctgcagggaccatgcctctttggtcaccttgcctctttacatactggcagcatcacagactgaaacagcagctctcagaactgctggaaatagaggttacccaggaaatgtcctattttgctcacacagtcccctgaaggctggctgggaggctctcctgtgcagcttttctccaagtagtgacttggggactctgattgcttctcttgtgggttcagcatctttgaacttcaagttcaccctggcttaaacatccagcagatggtggggtggggagtagaagtgcacctaaggagacacactggatagtcacctgccttccccgggaagtggcagaggccatgtcctctctcatctcatcgatttgcaccctcctgactgcaaggggtgcagggaaatatggaggagcacccaggtgtcagtgagcaataggggtctctgccacacctttggagaccactctactcctggctcagtttcccaacccctgtatgtcagagcctgacgtcttcctttttccaacttgtcttgagtcccatctggcctgagtttgaacaatagtaatcaggcctgttggctgatatgagatttgaggtaaccacgaataagcccttcttggtcagaaccattaaagataacttctagtctcaatgaccacacatttgcaaagcagtcctcctggaatgtccttccctgaactcctgtggcccagtcattataggcagagcactgggtccaaggaaaagccaggccccctgtatgggatgggccagtttgctgagaatgacacattactgttgcccctctaacttgaccctgggtttcctgtgggtaagcagctgtttcagcaaatcccagattcctgcaaaacagccttttaagtttttcttcatggaaagcttccagacattccagcccagcttgtctctccttggaattctgcccaatgaatcctgctgcctctgatagttatgagggatccctttcaaacagaggaactgcttcaactgtttgttagggctaacccaaatgttcagaccccttcagggacaccttccaagaaaaagcatcatttttttttccaagcagcaattccacacagaggactcttcggaagtgttgattgcaagaagagggcttgggaaaccatatcctcagggagtgtttttctgcaggctctgatgaaaggaataagcattgtcagattttttaaatgttctcttacactaaaatacattaaaata

SEQ ID NO: 13422 - DNA, 6178 bp, Human
ctgagaatgatgcttagccaactgccagccaggaaagtcccacaaccagacggagctgaattctgccagtgacctgaatgagctggaaagtaaattcagcctcagagctgcaaaaaagattgcagccctgttgacacctggtgattttggcctcatgaaactcagcagagaatgaactgagccgtgttgtgccaaaattctgacctacggaactgtgagataataaatagatattttttaaagtcactaagtgtgtggtaatgtgttaggatagcagtagaaaactaatgcacagacgagttgaaccaacatctgtgtgtgagacttggcccacaggacaagctggtgcattttttactttctagcaactggagcagggtaagggcccaatgttataatatgaagaagaccagcttgcattttctaggtgcttacctcattttaggtgctgtgcacggtactttatgtgcatttcttaccttgttcttcacaacagccctacaaggatttatgcttttattgttattatccctgttttataggtgagggacctgattgaggctcacagaggttagctacctgggcaggtgtcacatggcttattaatggcagggctgggactcaaacccatgtctgtgggacatcatacccaagtctgtgcacataagtgctatacttcacagtgcaccacgaccccaattaaatatgaagctaatatgtttccatatacaaaattgctgatatttaaactcctgctaaacactcacaactaagaatgcctttcatcacataaagccctttaaccttgttttaatgcccttggaatactacaccactaggtgctgagcaaggagaaaaaaaatcaaatttggatggtcaaggaaataggagactcccacgccacccccgccccaccccccaggttctgcaagccaaagctcagagcacactcttacatttctcttcaaatccttggaggtctcacttgctctagattgtgtcaaagattgtgccccttccctgcaccaggcactcaattccaggggtggaagttgtgatggagacatttttataccttggacataaagatcaggagccaaaaggaatatcaggtggaacaaatgctattgcttacattttatctggaggtgggggtgcgggttgatgtgccaatttgctctcagttgcatgtacagaaattgtgacctcaaattcagccaatggaaagtctgagtatgaacattcacattgttcagacatttaacaaatatgaactgagcttccataatgtgatggggtttgcatgagaagctaatgatgcagtaatgaataaggtgagttccatactcatagatcttccaggctccattactccaggctaatgaaggaagcacagaaaagcaagcaatttcaggatagtataataagtgctgtagtggaggaggcactagatgcctagagcaaatatgggagagacgccataccgagattcagaagccagaagtagtgacccttgagctgtggcctcacggataagtaggagttggccaggtacagaggcggcagaggagaatagcccagccccaggggatgtcatgatgtagatctgatctgggagcctacctatgtccataaatacatctggagtataggaggcaaacaggctatcggttgagactgaggtcagaaagcctttctgctagttttttgaagagattgaacttaattataaggggacttggaaaccattgaaagaaaaggctgagcagtggcatggacggatgtgggtgctttagaaggacccctctggtggaagagccaagaattgatggaggggagtgagtggagcacagagactattgggacctgagagaggtggtagggggtagaaaggaagggtggggagatcagggatggggaaaagcagcgggattccagagctatctgaggaggaggggccacggggtttgttcgtctggtggagggagagaagggagcccaggatgacagacagccaggcctgatttggccaaatcatcatgcaaatattattctgggctgacaggcccaagttgcagtcagcagaggcaacacgggcttataatttgccatttgtgaacgtcctgaggactggagaatcagctaggaagcaaatcttccttctgctgcataagacagccaaaagcacctctgaggataggcatctcagggatttcagagcaggtaacgccttttggttgttttgaatatgctgacagaagaacaaaagctttcaggaaaacaaagcccaaccccttaatgaaacaggaaaggatatacagtttcaaatgcttgcttgctttccttgttttctgagaagaaagatgccttgcctgttgaaggtggcagatgcaggttgctctgtgggcctcgggaaggttcactgcagctgtcacctgcccaacccacgtgtcctgaggcactgtgacatcttgacaggtgtcctgactcttggccttgacatgtcctgtcacgcctgcctgtcagctgggactgggcttggggaagagcttgtgggcctggggcctggtagtacttgcttagttaaacatctgtggctgctatttccctgtcacaggctggcaagtcagaactactcagattcacttgcacagcaatggtccttcagtcttctgattatgtggctctgcaacagggagagggagatattcatgagcaagtgtgcaaaatgcatttaatgcctgctaatggtgtacagccatccattgctttggtctgcccagtgtctgtctccctatcttttgataccaggggccaagtttctctggggaattcctttcagtttttgcagttctgggacagttacccttcacccagcactatgtcaatatgggcacatgactcaagccagccaatcagagttcactttccctagacttggtcactcagagggagctatcccttaggccacagtgattggttcagaaatgggcacataatcaaactagaccaatgagtctcagttctgaaattttgagttaagattgcttggaaaaagaactgtttactctatggaaatagaagctggagtgatgaaatttggggtaccgggagcgacagggccatagtgagaagagaaccctacctgaaaatgaagtcagaaggaaaaggaaagtagacaagaatgatggagagagaggcagagacagatccctgaagacatcatttaagatcccgaattcacctgtgcccaaagccagactagtcctgaatgatttagttacaagaactaataaatgcctttttccataagtcagtttgaggccagatgaatagaaattgcatcccttattgagtcctggctcaagtcaatttagcaagcatttgttaagatccacggtgggagctatacctcagagctccagggagcacaggaggtgtgctacaatcacagccattgccagtattgttattattccatttattagacatttcagacactcctcagcactttacacacattatttcatttcaccctttgagcacatcctttaattaaaaattgttatctacactttacagggaaagaaacctagaccagagaagttaagaaatacatccaggggtgggtgcggtggcttacacctgtaatcccaacactttgcgaggccaaggtgggaggattgcttgagcctaggagttgaaggccagcctgggaaacatggcaaaatcctctctctattttcaaaaaatacaaaaattagccgggcatggtggtgtgtgcttgtagtcccagctacttaggaggctgaggtgggagaattacctgagcccaggaagcagagattccagtgagttgagatcatgccactgcattccagcctaggcgacagagtgagaccctgtctcaaaaaagaaagaaaaaaagaaatatgtctaatatagtaataatagtgacagaggatgtgagttatcgtctacacactggcaggcaaaagaggttacttcctcccatctcaaggacttggaagtaagggaaataagactgtacacccaagaaagcaaaatggaatagatcggagtagagatctgccaagttgccttacagagccaggacagcttccagccagccaggctagatctagctgcctgaatgtattgacagcaaaaaaaaaaacaaaatgaaaaagggtatgtcaggagaggtgtcagccaaccatggaggcaaaagcgggggagtgaaagaggaggatcttggggatgcccttcataccactatccaggagatgggtgtcatagccacggagcttcccagtggccaggccatctctagggggagatgagagggaaggtggggccaggaatccagcagtcactctttccatcaaagccaccatcctgctgtggaatagttccccagggcctcttagcctgatgcccttacatgactacttcaaccaacatccctagttttgaggatgccattcttctcttcatcgtgaccccttctactctcttttaaaattatttctaggcctcttcttccctagaggccgttgtctatgggaaggggactgtgcttgccacagttggacattccaggttctgcagtgatagtttcatatcattgtaaattcagctggccttcggagtctaacttggtttcccctgtgacttcctacaagaagagactgagttggtcagaagctaatgaatcttttggtctatacatctttcagagttctccttataagataatcacaaggtctctattttgtaatgctaaggagacaggagctggctactctggaggctgcctttttggagatgtacttcttctgtggcctgacaaggaaggtttcagagcctcccggactcaaggccaggcctgggtgatggcatagctaccatgtaaagtgcattctccaccaggaatggtggctcatgcttgttaatcccaatgctttgtgaggccaaggtgggaggattacttgagccaggagttcaagactagcctgggcaacatagtgagactcccagctctacaaaaaataaaaagtaaaaacaaaacaaaaaaaatagctggaagtgggggtgtactcctgtagtccaagctactcagaaggctgaggcaggaagatcacttgagaccaggagttcaaggctgcatgagctatgattgcaccactgcatttcagcctgggtgacagagtgagactttttcttctaaaaaaaattctttaaatcaaaactcagaaaaataaataaataaataaataaataaagtgcattccatggatatacctgtgccctggatgagaggggccaagcagctttgcagacagaaagaacaccacaaatttaaactggagtcccagcttcattactagctaagtggataagttttccaactctttaaggctcagtttcctcagataaaacatgaagaaaataataggatctgcctcccagagtggctagaagactaaaatggaaaagaaaagaatgcaaagggtttagcagggcacctgacgtggttgcactcattagctgttagtggctctcttcttgctgatatttttgcatcctgggatgaacacacatccctatccacatacttttctatgtatgatctaggcctgagtgttccatacagtgactcagaccctcaggaaggcagggagtcttggagaaagaaggcacctggccttataggtggcctggctgacccagcaactatccatagggtccagtctggaaatgtcaatgagggaaatgggccagggaggcttggttagaggggcatcacaagtcagcttcagccccacatgccataagggaatgcaagctcagtatagccatatctgtgccatttttcaatagaatccaagaatctagatttatttatgatagcaacttatttcaattcttttaaacactctgcaggcccaacaaccagcccaagtgcaggaaacaatcttggggctcctctaattttgatccataatctaagggctgggcagaaatacgtaggagttttctgagtttgggttcctggaagcagactcttctttgtactacatgacaaggatgtagtacaagctgtccttgggggatgtgttcccaggaaacatcaataaggcaatgggaaggcaagccaataaagggggagttgtca

SEQ ID NO: 13423 - DNA, 69909 bp, Human
cattttcatgacattctggaaaaggcaaaactatagagacagaaaacagatcaatggttgccatttgcaaacaatttctgttcacagaccacctctaggccatccttgtactgggtttccagggcagccaccagccctctctcctcagctccaggctcctttctgaacccttcctgggtttacatttagtagcatgctgcttgacacgggattggcccctgtttcatagacactgtgttaattttctctcctcgggtactgcttccaggacaagtacccgcattgatgctggcactgggaacgggacggatgataaagtgtgaggcactctgcccagtggcaactgacatgatttcataatttccccaggtccatccgcttcccgccagtgtgctcagatttgagcagtaggagtccgttgggagaaagatgggggaaaggaaccaaaaacaattaaggcagactctgtaagcttccacctcccacaccagaaaagtcccacagcagaagactgccgtggaaccttccctactgtagaggaaagtgctgactttaagcaatttctgcagtcacgccttcctcttctttcctttctccctctcattcattcactgacgccgcagcactgatcagcacagacacagaagatgcctccaagggaccaaagggaataaccgcggttctgaggtgtggggactgctgttgcagggaaatgtggaccgctcaggaggggctcctagcgcaggcgtcttgctccgcagacgcggttacagctgcgctttgcacggcctgcggaagtttgcaaatctagcaggtctgctctcccggcagcaggactcggcccgcggtcaggacagctcccatggacggagggcggccctccgaggcctttccctgcagccgggagggcggccgggctgggccgggccgggggtgggaagctggggcgcggcggccccgcccaggcagacccggggcgggagccggttcccatagggatcgcgggccgagccacgccgagccgagctgggcggaagaaggcgaggcgggagccaggcccgtccctgaccgccgcggcgccgtgagtcccgggcgggcaaggaggcgcgggccgtccctggccaacacgtggcaccgctccatgctgcgcggcgcggctgaggtgcacgtccgggcgcgggagggttttcccagtcccgggggcgtggggcgcggggcgcgggttggtctcctgcggccaagcctcgccgccgcctccgcggggagccgggaggtgtcttcttgccgcagggaaatgagacccgaaattagaaccggggaagcccttagccctccccgtactccagccagctcaggtgtcttagatcggatgaacgataacgttaaaaagatagcttatcttacagctcggctcgttttaggatggcaagttacattttaacttacagggtatttaacgggcgattaaaatcgggttactggaggcagctaactctaggctgttactcctgatcgcgttgccattgccgacacgggtacactcttcattccttaacatgtgctgttctgttctaggaccgtgacaaacactcatcgttgggtggggctctagtgcagtccgttggtgccgatattttataagcgacgttttcaaactatgtgaagatcctttcttttcttttctttctttctttttttttttttttttttttttgagacggaatctcgctctgtcgcccgggctggagtgcagtggcgcgatctcggctcactgcaacctgcgcctcccaggttcacgcgattctcctgcctcagtctcctgagtagctgggactacgggcgcccatcaccacacccgactaattttttgtatctttagtagagacggagtttcagtatgttggccagactggtctcgaactcctgacctcaggtgatctgcccgcctcagcctcccaaagtgctgggattacaggcgtgagccaccattctcggctgaagatccattttaagaagatttattcctctatgatggagaagtatgaaaaaattgggaaaattggagaaggatcctatggagttgttttcaaatgtagaaacagggacacgggtcagattgtggccatcaagaagtttctggaatcagaagatgaccctgtcataaagaaaattgcccttcgggaaatccgaatgctcaaggtaattgattcacttttccttttttttctttttcgagacagggtttcactctgtctcccaggctggagtgcagccatgtgatcatagctcacagcagcctggaactcctgggctcaagccatgcttctgcctcagcctcctgagtagctgggattacaggttctagccactgctccgggatccactttttctttaaagtgaatttttagggatgaaagaaataaagtgagtcatgttatgttaaaagaatgtcatgggacatggttatatcttacttcatagccttttgacttcagtgacacaaatgggatatctgtgcacaagtcactaattatataatgaactagaaagcagagacaaaagtgccaggtaaggtggcattcacttttagagatgctgtgggatatttatttttcttccccatagtttctctcccacctgtagacctgggttttcaaggaccatcacaatttgatagtataggaatgtaagacaattcaattttgctggcattgttgatttttaaacttctaaggtatttcctattggtatactcagtctattaagagaattaacatttacctgttttcaaactgctaggaagctcacagattctcattacacctcatatgtatttactgctgagcatcatcatgtcccgtttctaaaaagaagcgtttttcttaaagaagtgaaatgatcactttctaattttttttaacattttttagagatgggatctcgctatgttggccaggctggtctcgagctcctggccttaagtgatccttccaccttggcctcctaaagtggtgggattacaggcatgatccatcgagcctggcctgatcacttttcaaatgtttattagttaaccctaaaaataacatgatatcagaggggggaaaggtatttattacaagctgaaagtgtgtttttcgctaatggagagactactttacagaacttctgtgaaggtgaaatccaaatcgcaatgtgaaaggtgacatgtaatgaatatggtggaggtcaactttgtttcagttatggcctctctgttctgacctgtataactactatgtgacaagggaagagctacttgatgagagacagatgaatgaaacttccaggggatttactattattcttgcttctccattttctccagatcactctacaaatcttgtgcccatggataagtgtgtggggtcacttctagataaggaacctaaatggaaagtagcaagctttggataaattgaaatgggtgggtaacagggcaacttctctatttaggtttggaatgttcttaaccaacaggatattatctattgagaggagatgcttccaaagccccgcaggggagtgctcccatgggcaggggtgagacctgcagtgttttgaccatccccctgcccgggtcaccctacccttaccctctctgtacacagggagaggctgttgggcattttcacttcctcaggctttcccaggggaggaggtgatcattacatttcaaagggttcatttacctgaaagaaaatctgtttcttgcagaaagatactctttttctgattctgaagattacttttgtgaatgctcctttcaaatctctcactacactttatcaatactacattaacagtgatagctccccaaattcattgagttcttctgggatggagaccttgcctctgtagctctatatccccaaagcacactagttggcacatctaggcctccaaaaaatgtcattgttggattggaaaaaaaagttaacaaaataaactcttaacaaaggtggatgttgccaataaatggggaagtcaaatgtgttctcttatctgaatattgatatcctccaaaggatggggttgtgtacacatgagcctgatttcaaagcatgcagcaccccactctccaaattaagtgcacagatgtagacaccactgatctctatgaaatggtgggactagattataggtagagtctgttctttaaagctgtaacttttcagagttgtgtgatattcctaacacataatacgtactaggctgggcatggtggtgcgtgcctgtggtcctagctactaaggaaagaggccaaggcaagaggatggcttaagcccagcagttcaaggctatggtgagctatgattaggccactgtattctatctagcctgggtgacagtgagaccctgtcacttataaaataaagatacttaataaatatttgttgagtaggtgaattgagggtatggtaaatgaacattttattttctccatttatggattcagtaaatactcatagagccccagttgtgcctaaaacgatgtttatgcaaagttgtacaccctgtctttcagaagctcagctcttggaagggaggtaagttgaattgccctttggctctcaccccttatagactgggttcccagtgagcagggcatgtgtacccttgcctggtaagaactctttaggtgcttgttgaatggtgaaaataaagtgattggaggcatgtttgagctgaactttgaaatgtttagggaaacgtggaatgagagataaggcatttcaggcagacactctatcctaggaaaaggtgcataagtagaaagcaccctatattgagggaacacaggtaataacccagtgtcttagccaagatgcccagtgggtgctaacaggccagggagagaaggaagggggaagccagggtccggcaggatcaagtcatattctagatttcttctgaaagaagagcacataggaatctaatgattggatgagaaatcaagaacaatttcaaggtttttgactgattgactggaagaatgaggagattgttcactgtgatagagagacccaggtgcaaatgtgggggaaaggagatgaagagctctgttttggacaggttaagtttgagttgtgaacccaaggagacttgtaaagtaggcagttgactacacaagtctggcattcaggggaagtccaggttggagacagagttgggggacataagcatatcgatggtatttaaagctgtgggaccggaggaggtcaccatgtgggatggagggacaggtactaaaggtggaagcttggtgtacccagcctttgggggtcaggaagatgaaaaggaaccggcaagggaggcaagaagaggcgatctgcatggtaggaaaccccatagaacaatgttctttcattattattattattattattattattattattattatttcttttttggagacagtctcactctgctacccaggctggagtgcagtggcacaatctcagctcactgcaacctccgcctcccaggttcaagagattctcctgcctcagcctcccaagtagctgggatgagaggtgcctgccactacacctggccactttttgtatttttagtagagagagggtttcaccatgttggtcaggctggtctcaaactcctgacctcaaatgacccgcccaccttggcctcccaaagtgctaggattatgggcgtgagcccccgctcctggccatagtgttcttaaaagcttagtgaagaagattgttcaaaagtgaggggatgctctgtgtctccattagtagatttaggattagccattggctttgatcatgtgagggtctttggcgaccttgacaagagctgtgtgagtggagaggcaggaaggaaaccttcatcagcaagggattaagagagacgagaggaacaaagtggagataatgatatgggcaactgttttgaagagttttattacaaaaggaagacaaaaatggggcagaggtgttcgtaaagatgtgggctgaagacaggttttttttgtggttgtttttattatacgagtgagaagtacatttgtatgctaatggtgtaaataaatccagtagagaaaaaacttgatgttggaggagggagagaattgctggacccgtgaccttgagttactgccctgaaccataccaaacataaatatcattgcataaaaaaagacaatttaggccaggcatggtggctcacgcctgtaatcccagcactttgggaggctgagacgggcggatcacttgaggtcgggagcttgaggccaacatggccaacatggtgaaaccccatctgtattaaaaatacaaaaactaggcaagcgtggtgtcaggcacctgtaatcccagctacttgggagtctgagacaggagaatcgcttgaacccgggaggcagaggctccagtgaactgagatcgtgcccctgtgctccagcctgggcgacagagcaagactgctagattctttacatacactctccttaatctttctgtaacaggatccacagctggctctaagctatggggtggaacttcttctaccagggtattcaccgtcttctgatttgcatatgacacatggaccctacctgaattcaactcctttccataactcaggtttaaacatactaaggatttattggatgagaggtagggtggtcataacagaagtcagattacagagaaagacaaggtaacaggaagaaaatcacgttaaatcaagaagtcaggagctgggtgtggtggctcacgcttgtaatcccagtattttgggaggccaacgtgctgatctctcgagcccatgagttcaagaccagcaggggcaacgtggtgaaaccccatctctacaaaaaatagaaaaattagctgggcatggtggcatgcacctgtagtcccagctactcaggaagctgaggtgggaggatcacctgagttctgggagtcaaggctgcagtgagccgtgatttgtgccactgcattccagcctgggcaacagagtaagacactgtctcaaaaaaaaagaaaaatcaagaagtcaggcatgatgggctggagcatcacaggccctgtcgtggaaagtgggcagtggtctgcataaagcaggtggatgcacttgaactccatgcagcccctaggggaatatctgtgtgtccggcaaggggcaaggaaagggctatgtggttcaaaacaaatacaaaccatacaaatacaaagtaatacaaaccaaaacaaacaaatacaaaacaaatacaaaccatacaaatacaaagtaatacaaaccaaaacaaacaaatacaaaacaaatacaaaccatacaaatacaaagtaatacaaaccaaaacaaacaaatacaaaacaaatacaaaccatacaaatacaaagtaatacaatataataattgtattactaaggccccaagcccctatgctgctgaaccttctctctgtggaatgaaaatggtaagaagaggaaagaaagaatttctgccagcagtggcagaaaaagtagatgctcctagcggagttggaggtcaaggacaggacagtgtcactgtgggatccctgggcagacgttctacctatggcaggtggtatgggggcgttaaaatatattagaccagcattggtcaagggctgaaagcagcagctgggacattgtctatgacatgtctccctccagaaaacaagaaaaacaagtgagacaaagagaaggaatcatctactgctatgtggcaggtaggggcaagggacctagtaaatttggacaaactgccaagtatcattgttacttaggatgcacaaattacactaataacaaccttagaaggtagatatcgttacactaataacaaccttagaaggtagatattgttatcccattttacaaatggattcagtatggttaatgatttgccaaggcctcccggtcagtaagctggaatgcagacacagttctgtctgtccccaagttcatgccatgtggtttccccataccagaaccatccatcactttataccaaacaccatactctgaagtctcccaatgactggtcgtcagaatttatactgcccgttctcccgcagggccttagctgtgagatttgtggcttctgtggaggcctgagtgcagattctagctgaacagccgttctttccatatctcattccataaccctatggactattttagaaggctaaaatagccttctaaacctttgtacaaacctttgtaggtttgccacctacaaagatgagaataagtgtgaggggaaatgtccatttgaaaattaattataaatatcacaacgtaatgcagagattcataatgagaacaaggtcactcctaaagggtgaaaattggttcttggcaggtggcaaaaaaatctaacttttttattgtttaaagcacagatatacatatggttcatatacagatatatagtatatttgtgatattaaaatttcattggtaagtgattagaaaaaatgtgtaaaatgactctttgagggagagaaatgaaaaaaggtgcatggggtgtgggcgagtggcactgttgagtgtatcctaggtgccagaagtaggctctcatttgattttaattcatcgtgaatagtaacctgcagaatgtccagagcatcccttttttccctgctgtcccctttgatcagtagccttatagaagggacaggggcatggggacaggagctacagttagagacttcagttttcttttctctctctttttttttttttttttttgaagacagtctcactctgctgcccaggctggagtgcaatagcgcaatctcggctcactgcaacctctgcctcctgggttcaagcgattatcctgccttagcctcccccagtagataggactacaggggcgtgccaccacacccagctaatttttgtattttcagtagagacagggtttcactgtgttgtccgggctggtctcaaactcctgatctcatgatccgcctccctcggcctccctaagtacagggattacaggcatgagccaccacacccagctatggaacttcagtttctgatcatgcttgaagctgtggagtgaccttgggcaagctctggtgcttcctggagcctggcgtgccttatcgctatgatttatgtccctgtttggcattgctttgctgattttttgctgaggagggcagagggctcttgggccaaacatctaacagcggtcaagcagcctcaaggatgcaagagcaggatagtagagggtcaaagggagtaaacatagaagaggaaagcacagacagaaaggcagaaggtgggattttaacacagtgctgtggccaacggccaacggaggcgctggaggcaaaagctcttcacacagtcccccaagaggctcactgtcttcaaagagcagaccagaagtcctgctgggcacattaccatcatggtgacaggcacatgctttaagaagtaggactgtcaaggttgcctgttatccaaagcatttattaagtgcttaactgaatgtgctctgtgcagtgccacatccactaaatgctaagagtaccatgtaaatgctccctagcattagaatctaattagaactttcatagttggaagggcttctgctcttcaaatattagttgaaggagtgtttcctcactcagtaaaaacctcagccagctgcagtggctcatgcctgtgatcccagcactttggaaggctgaggcaggtggatcacgaggtcaggagtttgagaccagcctggccaacatccccgtctctactaaagatacaaaaaattagccaggtgtggtggcgggcacctgtaaccacagctacttgggaggctgaggcaggagaatcgcttgaacccgggaggtggaggtggcggtgagtcgagatagagccattgtgctccagcctgggcgacagggcaagactctgtctcaaaaaaacaaaacaaacaaacaaacacctcagtggaaaatcctgtgacatctttaagaatttcatcctgcttttgctaataggggtcattctaggctccctctcttcaaattgtttaattggcttgttgaggtgaattaataacatatgtctattaattgttttagctgagttcagcattttctgttatggattatggattaacaaacccaaatgtctgtggaatcacactgttaacataaatgagggaagcagtctgaatatagggcaagatggagaggtggagactggggcaaactggggtcctcatgtctgatctaaagtggacagctactgctcagtgccacagactgcaagcctaaggtgctgggttttcagtcttttttttttttgagatggagtcttggtcttgtcacccaggctggagtgtaatgatatgatctgggctcactgcaacctctgcctcccaggctcaagcgattctcctgcctcagcctcctgagtagctgggattacaggtgcccactaccatgcctaactaatttcttgtatttttagtagagacggggtttcaccatgttggacaggctggttgtgaactcctgacttcaggtgatccacctgcctcggcctcccaaagtgctgggattacaggcatgagtcaccgcatcaggcccaccacccccacccccattttttttttttttttttaagacagggtctcagtctgttgcccaggctggagtgcagtggggcaatgatggctcaccgcagcctcaatctccagggctcaggtgatcctcccacctcagcctcctgaatagctgggactacaggcatgcatcaccacactaggctaattctttgtattctttttttttttttctttttttctttttgagacggagtctcgctctgtcttccaggctggaatacagtggcgcgatcttggcttactgcaacctccacctcccagattcaagtgattctcctgcctcagtctcttgagcagctgggattataggtgcatgccaccacacctggctggtttttgtgtttttagtagagatggccaggctggtctcaaactcctgacctcggcctcccaaagtgctgggattacagacatgagccactgcgcccagccaattctttgtattctttgtagagatggggtttctccatgttgcccaggctggtctcaaactcctgtgctcaagcaatcctcctgcctcggtctcccaaggtactgggtttacaggcatgacccccaacatgtccagccagagtcttttttaaaaagccagaaatcagaattttatgtaaagtgtcctgggatttttcctacaaccttttattctgagaaaaaaatcaaaatatacagaagtggagagaatactgcaatgaatacctgcgtacccttcgctagattagttcatcaactgttagaattttgctgcatttcctttctgtctttttttcattctttttagcgacagagtctcactctgttgcccaggctacagtgcagtggcacagtcatggctcactgtattcttgaaatcctgggctcaagtgatccttctgcctcagcctcctgagttgctggtattacaggcgtgtgagccatagtgcctgactaatttatttattttttgtagagataggattttactatgttgcccgggctggtctcaaactcccagcctcaagcaatcctcccacctcagcctgccaaagccctgggattacatgtatgagccattgtgcctgtacttcctttatccctgtttctgcctctctctctctctttctttccccctctctcacacatacttttttggctgagccatctacctaaatatttagcataatctcctgaaacaaagatgttcttctgtataatcacattatgatttccatactcaataaatttatcattgactcaatactattatctaatatatagtctatgttcaaatttctcatattgttctaataatggttatagaactatatatataatgaaataactatatatataaatgtgtatagttatttttaaatccaggatctattcagtgactgtacattgccatgacttttttttttttttttttttgggacggagtcttgctctgttgcctaggttggagtgcagtggcgcaatctcaactcactgcaacctccaccccttgggctcaagcgattctcgtgcttcagcctcccgagtagctgggattacaggcacctgccaccgcgcctggctaatgtttgtatttttagtagagatggggtttcaccatcttggccgggctggtctttaactcctgaccttgtgatccacccgccttggcctcccaaagtgctgggattacaggtgtgagccaccacgcctggcccattgccatgactctttagtctcctttaatctgaaagagttttccaccttctttattctcttatttcatctttcatgaaactgacatttttgaaaagtccaggccatgctgttttgtggaatgtgcctcgacttagactaactggctgtttccaaatgatttgatacaggttaaatgttttcagtaagaacactgcatgggtgaagctgtgttcttcacactagctcccatcagtaagtgtatgatgtcatttttgtcccctaattggtactatcagttttaattcctctagttaagatgggtctgccatatttctcaattgtaaaaatgattttctcctttataattaataatctgtggggtgatattttgaaactgtggcgaccttgttccccaacaactttcacccaatggttcttttttttttttttttttttttttttttttttttttttgagacagagtcttgctctgtcacccaggcttaagtgcagtggtgcgatcttggctcactgcaacctccacctcctgggttgaagcaattctcctgcgtcagtctcctgagtggctggaatcacaggtgcctgccatcatgcctggctaatttttgcatttttagtagagacgggatttcatcatggtggccaaactggtttcgaactcttggcctcaagtgatccacccacctcggcctcctaaagtgctgggattacaggtgtgaaccgagccgccgtagccggcatcaaccaatggtgatgtaaaacagttattgtaaaatagttatttttctacaattctttctacactcattagttatcatttttctgtaaaaaaaaaaaaaaagaaagattttcttcccctctgcccccacccctccttttcatatcactgtggattcatggatttttaaaaattcaatatgttacacaccatcactgtcagtattctttctgactctcaattatcacacatttagcatttgcggctccttccatctaactcctgtgtcctgacagatgtccatccttctttgagcacttgcttactgtgtggcacagccaaatgtcccaggctcatcctgccccagccctgtatcagccatttctccagagacccctggttccttttagtgagaatgagatctcttgaccttaaaatgttgacaaataatttttaaaaattttaaacatcattcaggccaagtaaaacacatctgcagataatgtttgccatataagctgccagtttggggccttagggattggacagttttcattctctgcacatgttctcataagagactcacagagatctggcccattgatgttcattactaatgtatagatagatgctgggagtttatgtaaactggttgtcagtagcataggagacaaaacagagcattcccttgcccacaatgatagaaaccaaacaatcctcttatcattatctctccctattggttcaacaagtggggacctgttgaattttatttttacaagataatatactaactgcaaatagtaacaggctgttttgtttgtttattagaagatttttggttgagctcttgatgtgtttatctagaaagattatattccggctgtgtagtgaactcctaagtgacaaagctgccacacaaatactttcagaacaacagaagcagaaaccaacaagctggctcgttaccttcttaaagactcccagtttgcaaggagattaagcacataccaccatctgtcagtgttctgccgccactacacacaccctgccacacactgtagactctagaaaacaaatgtcacagagcaagaggaggcaggaaaagtgatttttgtaattcacattgataaaagacataatttatgctattgcttttttgccccttaaattatttttatttctaacctgtaaaatttctaggtggacagcattttgttgttgttgttgtttgtttgttttttttttttgagacagtctcactgtgttgctcaggctggagtgtagtggcacaatctcagctcactgcaacctcctcctccccgcaggttcaagcgattctcctgtctcagcctcctgagtagctgggattacaggcacacgtcaccatgtccagctaatttttgtatttttagtggaggtagggtttcaccatattggcccggctggtctcgaactcctgacctcaagtgatctgcccgccttggcctcccaaagtgctgagattataggcatgagccaccacgcccagccgacagtgtgtattacatatcgttattataagactccaaaccggccagacatggtggctcacacctgtaattccagcactttgggaggccgaggcagatggatcacgaggtcaggagatggagacctcctggctaacacggtgaaaccccgtctctactaaaaaatacaaaaaattagccaggcgtggtggcacacgcctgtagtcccagctactctggagactgaggcaggagaatggcgtgaacctgggaggtggagcttgcagtgagcagagatcgtgccactgcactccagcctgggcaacagagcgagactccgtctcaaaaaaaaaaaaaaacaaaaaactgtaaaccacactaaaaggtagtaattattggctgggcatggtggcttacgcctgtaatcctaacgctttgggaggccaaagcaggcaaatcgcttgagctcaggagttcaagaccagcctgggcaacaagtgaaactttgtctctacaaaaaatgtgaaaattacccaggtgtggtggtgtgcaccagtggtcccagctattcaggaggctgacatgggaggatcacctaagcctggaaggtcaaggctgcagtgagtgtgattgagtcactgcactcccacctgggtgacagagtgagaccctggccaaaaataaaaaaaaagagagagagaaagagagggaggaagggagggagggagggaaggaaggaaggaaggagtaatttttatacagaatgaatggaaacattcttaaaggggcaaggcttgtgtctttcactttaaatttttgaaaaaaaaaaatttttttttgagatggagtcttgctctgtcgcccaggctggagtgcagtggcacgatctcagctcactgcaagctccacctcccgggttcacgcaattcctacctcagcctcccgagtggctgggactacaggcgcccgctaccacgcctggctaatttttttgtatttttagtagagacggggttccaccgcgttagccaggatggtctcgatctcgtgacctcgtgatccgcctgcctcggcctcccacagtgctgggcattacaggcgtcagccaccgcgcccggccttgaaaaatgttttaatccacctttttacttggcagaattggtgttttaggccacaaatttcctttcaacaagcatattttcttgctaattattaactttctttattgcttattaaccttaaagtccctctagtgaaaacactcttgggtaaaattgcctggttgaaaatctttgaactccatctatttttttgtcgttgctggaataatgaaaggttaagaatttctaaactggccaggcacagtggctcactcctgtgattccagcgctttgggaggctgaagcagaaggatagcttgagcccaggagttccaggctgcagtgagctatgatcacaccactgccctttagccagggtgacagactgaaaccctttatctaaacaaacaaacaaacaaacaaacaaaaaaccacacagaatttctaaaccaacagatgttttcggccacacataaaaaccaatgaaataattgactttatcacagggttgctgcattaattcttggctgtgtcagtgccatttttcatttttgtcacaattgtactattccttctctcatagtactttccacgtactgtgttagtcagtaaaacaggtcaagcatccacggtgcacatcactggcctgtgctgggtcttgagaggaatgcagaagagacccgtgagccaggtgtgaggctttgttcctcatacatgtaagctgaaggagaggtaacagggcagcaacacagatgagttgggaaaaggagctacctctttgtcacttgcttgttccctccagacctgctcgagcctgattccagatgttttcttaggacagtggtcagtatatctctattatccagctcacagtgggcagctttgggttactcagtcacttgatgtcctacattcatgtgctcactctaccaagtcccaatgacatgccaggaactggacacatgtacacaactgggtatgccaagtcatatggcctgaatagtagggcagctttgacctgctgtgcaaagttccctctcgtcctgggtcctactcagtgttagcagccttctaaatcacttggtaaattaggcagagcagtgcgcaagggctgtacatgctgcctccaaaatccaaagacacccaccaggagcaatgcccttttttaaatggtaggggatacaaggtgcaacaatttgtcctttaaagaggatacagctgggcatggtggtgcccacctgtagtcacagctatttgggaggctgaggtgggaggatcacttgagctcaggagttgaaggctacagagagctatatagtgcactctagccactgcactccagccttgaggacagaacaaggctctgtcccaaaaaaaaaaaaaaaaaaaaaacaaaggaagtcacagcatgccccaggccattgaactcctagaataccacttatatgccattccccagagggttttcttccactctgtggtacacacatatcttaactggacagccagagtacttgccatttctgttcaccaggagatccagttaacatgatgtcatcaatacagtggagcagcatgatattcagtggaacgtcaagacaattaaggtccttgtggattatatggtgacagagtgctggagagttaacttaggcttcaggcaggacagtgagtgtgaactgctgtccatcccacacaaggtgaactgcttttgatctaacttactgattggtattggaaagaatacattcaagtcaatagttgcatgtcaagtgccagagcctgtgtatatcagttccaggaaagataccatatctggcccagctgctgcaattggaagtacagttgggttgagtttataggagtctaccaggtgagttgagggggttagcatgggcatcaccacctctgcattcctaagtctttgatggtggtactcatcactgcattttctcctgggatgcagttttgcttcggatttactattttgaccagggttgtgttgccagggaggaagagcagtttcaggagcttgtgtttggccctttctgccatattggctcttacttcacaggtcatagaaccaatgtgagggtatgcttagctgactgttaagcatacctatgccaattttgcatttctcaagtggaggaagttatctcaagaatggattcatggacctgttaagcccagtatgaaacggtgctctaacctgaggccatggtagcatttggggtccccacatatcagtgccagctcagaccttgtagccacagcccttgaaaggtctgagtattttcctttcccagttactctggtaaatagccacagatccctttgaaaagtgaggaatactcacagtggcattgcaggatcctccttcaaggtgactcagtcagcaacactttggactggaactgacttagatctagaaactgggcgaggagctgcaggtttccactctagctgttgacaccaaccttctgcttgctcagtttcttctggcaatgcaagtcgggtgacacatgagccagctgtccttctatctcacctataggaactccatggcattcctgtgcattattagcacagatttctgtgaaataaggtgttctggcttgcttctcatcatggtaattttatgtaccttgccactgtaagcacctggtctctgccactctggaatcttatcactttcatcagaaccagaaagcctagttccgtggtagcatctccagcctactgaggacaagcctgtctaccccacccacagaggacagcagtgatgagctcttgaagatgccactgggctcctttctgctccttactgcttcagtggagggagtatcctctgggccttccaaggaaacataatcaggtggtaggtcctgcagtcccacatcacacatcctttctaatatttccccctccttgagtccccaggccccttcctcaatactctgccaaggcacttccagcatgtctgccttacctactaaaagcccaaccttcaaagagctatgccagcagcacattttaagactgtctcctgtgtgctgtggctcacacctgtaatcccagcacttttggagactgaggcgggcagatcacttgaggtcaggagtttgttaccaaactggccaacatggcgaaatgctgtctctaccaaaaatacaaaaattagctgcgtgtgatggtgcgcacctgtagtcccagctactcggttggctgaggagacagaatctcttaagcccagaaggcggaggttgcagtgagccaagatcacaccactacactccagcctgggtgacagagtgaaactctgtctcaaaaaaaaaaaaaaagattgtcttgacaggcacagtgtctcacagtatcccacgtctgtaatcccaacactttgggatgcggaggtggcagaatcgcttgaggccaggagtttgagaccaacctgagcaagatggtaagaccctgtctccacaaaaaaaatttttttaattatccagccatggtcatgtgtgcctgtggtcccagccactggggaggctgaggcaggaggctcacttgagcctaggagttcaaggctgcagggagcgatgatcaagccactgcactccagcctggatgacagattatgaccctgtctctataaaaaataaaagtaaaatttaaaaaagaactgtcttcaggtgtccttgtcaagaattaagtcccaagttatgcgacagtgtagtgctctcatattaatgaatttccccttttccagccttacattttactactatcacggcccagccccttcaagacggctgctggtacctatgaggcaggtcttgtcattcttgagtgcagttatttcctcgcagagcaagaaccttattgccctactcaggcactgcaacaacctcatcctattataggtccgtgggccctagaaggaggtggggtagaatctaaggaggacaggcatccccctcctaaggaggcacctgcatcatgtgagggatttttaaggtctgcaggtaaaggaagcagctaacctacagcaatggaactgagtcgcttttcctagccctgaaggttcagggaaatttgagaatttcagattctcaggctctttctcgtagatgtccctatcctagatctcaggatgattctcttttctcaccatagccctgacttagacatgagagacctgttgaggctggatattgtcccctttgtagctctgctgccctttaagtcctgagattgattttttggcacagtctgtcctgtctgtaggagataaatgtctctgaatactgccagcaaggcctcctgactcccacagatgactgttcgtggctaacctgaccctgtcattttcttttttcttttttcagtgatttataggtgttaacaagagccagcttattcaatacttcccataatgaccattgccgcataccactcatgtgccactgcagtgccgaagcaagcttacaccccattcaaaaccagccctgacaaaaggcttagtgactgtgttgctacacctccctgggcttcctcccaccccacttatcatcagcagtggggtccttgttgccatctgctccatgattgatccagttccagaattccattctgaaggcctgctagctaaggccacttcaggtaccaatggtcttagactgtgcacctcccagaaagtaaagtctgagacaggaactgtgtgttaggagtttattttgggaagtgataccagagagcaggagtaggtgacaggggagaaaacaaggaaggaggaaacccaatgtaaccaggaacggggactcatcctgccaggcctctttaaggagcccaaggaacggaagagaggacactgaagcaccctgtcccccattggtccaaggctcccctatggagtgttaactcctgcaagtaccgaatcccagcagcatcccacacctcagcatcacacaaggcctgggcagaaagcaaaaaccaaggacagctggggtgaggctctgtcaggctacaggcgcacaaagctagctgctgcagtggtttcagcaaatcttcaattaaaagatgggctgaaagaatgggaaacaagacaaaagaggcgactaaaacactgacctccttgctgttctagaaacactccaggcagaatcccacataaaagcctttggaatgattgctcctactgcttggaacgttttcccaaacatccttaagacctttaccttcttcagatcttttttcatttatcatctcagtgagggcttccctcatttaaatttcaccattccaccacgctatgcccctatcgaccttgtttctttccataagacttatcaacatctgggtgcttgaatataagctcacgagagcagagatttttgtcagttttgttaagtatataatcccagatcttacagtagtgtccagcagagcagagggctcaatatagtgttcttaacaataatatatgacaagtgaatatatgaaaatggaaggattttaaaatattttttcatgtacttcctattttcacatattttaatgaacatttattttcatatattttttataaaattactcagtagcttgccttcttcactcagcaataacatcatggtcatcagccaatagataggcctctattaattgtactttcttaatacctgcataatatttattatttcctggtctgaatatagcacaatgtattcagccatcctcctctattacaggatgttcatgttgtttcatattttttgcctccacaggaagtgctggaatcctggtatggatatttttatgcaatgatgcttttatttatggaaagtatattctcagaagtggagtgctagtaagaggacgtgtctgtgtgtgttttcaataaattttatttttagaatagttttagattacggaaaaactagaagatagtagagttcccatataccctgctctcagttttatcttttagtaacatcttatattagcatggtatagttactataatcaatgaaccaatgctgatgcattatcattaactgaagtccatccatactttattcgcatttctttaattttttgttgaatttcctgtttctgttccagaatcccttctaggaaactacattacatttagtaatcatttagtaatcatttagaggaggctgtgtccgcagcctcctcttggctgtgacagtttctcagagtttacatgtttttgatgactctggcagttttcaggagtactggtcacatattttgtagaatgtccctctattggaatttgtctgttttttctcatgattagaccagggttatgggctagaagaccacgtcccatcccgtcaagtgtacatactatcaacatgacttaccgctattttttttttttgagatggagtctcgctctgttgcccaggctggagcgcagtggcaccatctcgactcactacaacctccgcctcccgggttcaagcgattctcctgcctcagcctcccaagtagctgggattacaggtgcctgccaccacacccggctaatttttgtatttttagtagagacggggtttcaccatgttggccaggctggtctcaaacacctgaccttgtgatctgcccgcctcagcgacttaccactattgatgttgaccttgatcacctggctgaggtagtgtcgtcaggtttctccactgtaaagtgacttttcttctgccattctattctatgctgtttggaaggaagtcactacgtgcagcgcactcctacagagggagaagttaggctcccgtccctgaaggtggagtatcaacataaattatttggaattctccaatataggagatgtatctactctcccactgacttatcttttatttatttgtttattcattcatccagtcaatcatttatttatattagtatggatttgtggatattatatccctttgatatacttccatcaatgtagggtttgctttggtttgggttttaacactttattattttctggcactgcaagatgctccatgttcatcttatatatttcctgcccaagttctagaattgggtatttctttttttaattttttttaataagttccgggatacatgtgcagaatgtgtgggtttgttccataggtatacatgtaccacagtggtttgctgcacctatcaacccatcatctaggttttaagccccacacacattaggtatttgtcctaatgctctccctcctcttgccctccaacccccaacaggacccagtgtgtgatgttcccctccctgtgtccatatgttctcattgttcaagttgagtatttctccatggatccctggttccttctattagagactagtatcaaaaaacgagatctaagcacttggtatacatattgctactaggatgtggttggttctaggccctttcagctgacagagcaaggtaatatatgtgtgtataccaacctgtgtacatacatatatctagagttatttctatatgtaatcatctgtatctttattaagctaaacaagagttcatactgatgtcttcaactataatctgtagacaaatgagatgggattagctcacaaatctaatgggtcattctagccttgtctccttgcttatctggaaacctgtatcagcttttcctctaccctctttggtgaggttgtttcatacatttgtaatatagttagattctttttgtcacagtctttgttctatcctaggattccccaacctcctacatgattttttaacactttgcatatcttaaggttcacacattgtgttgtaaagttctatgcattttgcccaatgcataatatcacatattcactattacagtatcatatagaatagtttcactgccctaataaatcctgtgtgtttcacctactcaaccctcccgacatcctctgaacccctgacacctgttattgtttttactgtctctgtagctttacctttccagaatgtcatagaattggaatagtacaatatgtagccttttcagactggcttctctcacttaacaatatgcatttaaactttatacctgtcttttatggcttgttagcttattttatcggtggatgatatcacgttatatgaatgtagcacaattttttcatcctttttcctataggaagacaacttggttgcttctagtttttggtgattatgaataaagctgttaaaaacatttgcttgtaggttttcatatggacatagttttcaaccatttgggtaaatacctaggagtgtgattactggctcatatggtatagatatgtttagctttgtaagaaactgccaaactgttttccaaagtggctgtctgatttagcacaccgaccagcagtgaatgagaggttctgttgctcagtatcctcaccagcatttggtattatcagctttttgggggattttagccattctaataggtgtgtaatggtatctcattgtggttgtaatttggaatttcctaatgacaaaagatgttaatcatcttttcatatgtttaaaatttcccatctgtattatatcttcttcagtgaggtatctgctcagatcttttgctcatttttttggtccgtttggttttaatgtaataaatattgccagtaactttcccaaaaaagttatagcagtttgcactctaattggccatgtgtgagaacacccctttccctatgcccttgtcagcactggatgctgccaatcttgcgtgtttgcctgctggttaggaaataaatggcatcacgttgtttctctaatttgactttctcttacaaccagtgagactgagcatcttttcatatgtccctttatcatttatatttcctcttctattacctattgatatattttgcccattttcccactgggtcgtctttttcttaacaatacataaataagacttctttgtaatattaggaatataaccctttgttgcaactttaacaaatatttcccaggcaattatttgtcttttggcgttgtttatagtgtttttttaacatagtgaattaatattgttaaaatgtccatactacccaaagcaatctacaggttcaatgcaatcttgatcaaaattccaatgttattttccattgaaatagaaaaaactatgctaatattcatatgtaaccacaaaatgtcccatatagctaaagctatcatgagaaaaatgaacaaagctggagccatcacactacctgatttcaaactattttataaaaatatagtaattagaacacaatggtactggcaaaaaaaaaaaattagacacattgaccagtggaacacaatggagagcccagaaatgaacccacacctgaatggtcaattgatctttgatagaagcatcaagaatacacagtgggaaaagcatagtcttttcaataaaagatgttgggaaaactggatgtccacatgcagaacaatgaaactggacccttatctcacacaatatacaaaaatcaacccaatagattaaagacttaaactgtaaaacttctagaagaaaacatagggggaaaattacacagcattggtctgggcagtgatttttttaaatttgactccaaaagcataggcaacaaaagcaaaaatggacaatttggattacatgaaactaaaaagtttctgcacagtaaagaaaacaacactgtaaagaaacaacctatggattaggagaaactatttgcaagccctactcctgataaggggttatatgtatccaaaatatataatgaactcgggccgggtgtggtggctcacgcctgtaatcccagtgctttgggaggctgaggcaggcagatcacctgaggtcaggagtttgagaccagtctggccaacatggcaaaactctgtctctactaaaaatacagaaattagccaggtgtggtggtgcacgcctgtaatcccaaatattcaggaggctgaggcacaagaattgtttgaacccagccaggaggcaagggttgcagtgagccgagatctctccactgcactccagcctgagcaacagagtgagactccgtctcaaaaacaaaacaaaacaaaacaaaaccaaaatacccaaaacatataatacactcaaacagctcaaaaactagatgttccccttccttggcctcccttggcctcccttggcctccctcctatgctcagtggtgtccaaagtccagaggggtccgaggcagcagggggctggcgtgtcagcatgtccctgagcatgcgcacacctggctgggtcatgacagtccctgggcttggccataactttgctctgaaatcggagtgggcaccaggagtggggagaggtcaggcagtaggagcaggcatggcacttctgagcctgcaggggttggggggcctcccaggtcccaagtgtgcagacatgcccgggtctgcagccatgactgggtgtctgcagctgcctgggagggtggggctcctgcccctccaacctgaggctcccatctgttcccagctcctgccagctccagggagcacacagccatggctgcgcctcccccactgcagccggcatcatggcagcagctgctccagatgggccactggtgccatcactgtctctaaaaaagggggaaaaaataagcctgggatctgaatggacatctctcaaaagaggacatacaaatggccaacagatatatggaaaaatgctcaacatttctaatcattaggaaaatgcaaatttaaaccacaatgatatatcatcacacacctgtcaggatggctgtgataaaaaagatgtaagataaatgttggcgaggatgtggagaaaaagaaacccttaaagttgttgatgggaatgtaaattatggaaaaatatatggagattcctcacaaaactaaaaatagaattaccatatgatccagcaatcccacttctgagtatttacccaaaagtgaaatttgaaatgtctgccctcctatgttcattgcaatactgttcacaatagccaaagtcataaaattaacctaagtggccatcagtggatgaatatataaagaaaatgtagtatatatacacaatacagtactattcagccttaaaaaaggagaaaattctgacatttgtgacaacatggatgaaattggggaacattatgctgctgagtaagccaggcacagaaagaaaaatgcacatgttctcacttatatgtggaatctgaaacaagtgaattcattgatatagtttggatatttgtctccacccaaatctcatgttgaattataatccccagtgctggagatggggtctggtggaaggtgtttagatcatgggggcagatccctcattacttggtgttgtcttcgtgatagtgagttctcgtgagatctggtcatttaaacaggtatgccccactgccaattccctctctctcccttgttcttggttttgccatgtgacatgcctgcccctccttcaccttttgccatgattgtaagcttcctgaggcctccctagaagctaagcagatgccagccccgtgtttcctgtaaagccggcagaaccatgagctaattaaacctcttttctctataaattacccagtctcaggtatttatagcaatgtgagaacagcctaatacattcttagaagcagagagtagaatggtggttacagaggctaggggatgaggagaatggagagatgatggttgaagggtacaaaatcttagacaagaggaataagtttcatttccaagatctgttgcacagcatggtgaatacagttgttaattatgtattgtacacttcaaaattgctgagagaggctgagtgcaggggctcacgcctgtaatcctagcactgtgggaagctgaggcaggtggctcacctgaggtcaggagcttgaggccaacctggccaacatagtgaaattttgtctttactaaaaatacaaaaactagccaggcatggtggcaggcacctgtaatcccagctacttgggaggctgaggcaggaaaatcacttgaacccaggaggcagaggttggagtgagccaagatcgtgccactgcactccagcctgggtgacagagcaagactctgtctcaaagaaaaaaaaaaaaattgctaaaagagtagatttcaaatgttcttaccacaaaaaaaaaggtaagtatttgaagtgatggatatatgttaattagctaggtttaattattccatattatagtcataaatcctaacattaatttgaaccccataaacatatataattagccaggcatggtggctcacgcctgtaatcccagcactttgggaggctggggtgggcggatcacttgaggtcaggagtttgagactagcctggccaacatggtgaaaccctgtctctactaaaaatacagaaattagttgggggtggtggctggtgcctgtaatcccagctactcaggaggctgaggcaggagaattgcttgaacccaggaggctgagattgcagtgagctgagatcgtgccactgcactccagcctgggcaatagagcaactatatatatatgtgtgtgtgtgtgtgtgtgtgtgtggcatgtgtgtatatatattatatataatatatgtatatatataattataaattgtatatttacaataagtttacaatttacaataaagctttaaaagaacaacaaaaaattaaatatacctctattgcttgtacgtttttctacttttgatagaaacatggacatattaaatatttcacttttaactctagtataagaaagtcaataatgcaagagtgatgataaagagcaactctcacttggcatcatgatcagggagcaatagggagtgggtgactgcggtgacctaaagcatacaagccttgtctaaagtgaacagctgctctcagccctagctcataagtgccacagagtctacaggcctagacctgctgatccccagcatttgcaagagactcttggtaaccaggattttaaagtaacatttcctggttaagggtagcggccgggcgtggtggctcacacctataatctcagcactttgggaggccgaggtgggcagataacttgaggtcaagagtttgagatcagcctggccaacatggtgaaaccctgtctctactaaaaatacaaaaattagccaggcatggtggtgcacacctgtattcccagctgcttgggaggctgaggcatgagaatcgcttgagccctggaggtggaggttgtggtgagccgagattgtgccactgcactccagcctgggtgacagagcgagactccatctaaaaaaaaaaaaaaaaaaaggttggcaactagcacaaaattcttcaaaatctcatgggctaaacaggccaagcaattgaccttagtagatggagggtctgagcttatcagaacagatgggtgcccaatgaagacagagggctgacgacacagagaggcagctgcccacgtaggatacgtagcattctcagctctgcagggaaaccaggtagggctctggctaaattcaacctcagaaaaatgaagtcctttttttaatgtcacagaaaatacttgacttggcaacataatatggaacatcagtatttgaaacacagagagaaggctgggtacagtggctcacgcccataatcccagcaatttgggaggctagggtgagaggatcgcttgagcccaggagtctgagatcagcctgggcaacatagtgagacactgtctctaaaaaaattttaaaaataaaaaaactagcttgttatgatggtgtgcacctgtagtcccagctactgaggaggctgagggaagaggatcacttgagcctggagtttgaggctgcagtgagccatgatcatgccactgcactccagcctgggtaacagagaaagaccctgtctcaaaaaataaaaaatagactaggcacagtgtctcacgcctgtaatcccagcattttgggaggacgaggtgggcggttggcttgagcccaggatttcaagatcggacagggcaacgtagcgaaaccctgtcactacacaaaattttaaaaattagctgggcatggttgtacacatttgtagtcccagctacttgagaggctgaggcaggaggatcacttgtgcctgggagttcgtggctgctgtgagctgtgattgcaccactgcattcccacctgggtgacagagtgagaccctgtttcaaaaaagtaataataatttgaaaatgaaaattttaaaaaacacaaagagaaaataaaaggaagactaaaataaaatagcagcagcaaaagtggaaacttttgtacaagagaaagtcaatctgagtccgagcaggcccgtgcttctagatagagcattaactgaaggacggtgatactggcctggtaaggagcaccaagagattcaagattagcccagcacagacgccccagacctgaggctttggcttcacagacttgtatataggaaggaattgtcattaaatgagccccaaacatctttgtggtatatatggtaatttaatctgttctgtctattaagtttacttgtatgtaccgtgaacatgttgggtaagcctgtaacagtttgtccatcatgttgcttagttcttctcatctaattcgtttgtacgtcccaaaagaactccattcagcattgaagcagaaacatccaaacccttgtgaatgcaaacattcacaatgttggggctatgatggacacctccagctattcgctgcagactggtttgaggatcagaggtgtccctttgagttctacccctgaggtcagtggagtcaatagagagagaggagtaaggtagtttgagatgttaagtccacataatctggcttctggtctcaccactgcaccgataccgtttccaataaggtcactcgaccccaacccagggaagcccaccaggcatctctcagccctctgtttccatctgacctttcagcagcatctgtcaacactgaccacttcctcctcccatgatgcccccatggcgcctgctctgctgtcttctctctcatcttaaggggctttcttccctttcccctttcgtgtttcctcctcatcaaccacacatctgggtgggagggttctttagacagctttctcatctcactctcgctccttcggggcaatctcctctctctgtctatggcttcgcttacacacatgcggactccctggcttttatcttcagctcagactctggctgacataacaactccactttggtgtctcagatccccaccaattcaatgagacaaagctagtgacttctttctcccagtcttactccccctctctgtgatggcatcaccatctgccccagtgtgtaaacctttgtgtcatttttgacagttccagtgtgtaaacctttgtgtcatttttgacacttccttctcccctgtccctcacctccagccgatcaccacatccggactattctgataacaaaatacatctcaagacaatgcttctcaccgactaccctgcctctgctctgctccaagtcaccacaatgtcagctatcaacagccacttcatccattttgcgtcctccaagccattctatatcctgttgctgtagtgagcttttaagagccccatggtatcatatcatgtcttgctgaaatccttccagtggcttcccattgcactaggatagagtgaattgcttagcgtggcctgcaaggccctgtaggatctgccttctgactggctggccttgattccacgagcttcacccaccagccacactgtctttcagttgctgaagtgacccaagttctctcctgactcagggccagtcactgcctggaaagctgccatctttgcctttaccaccacccctgcccttggtttggtcagacctttaccctctagactcggctcaaggtcacttcctcagggccagtttctctgagacagcctaatttcatagattatttttggcacttctttgtttaatgcctgagtcctctgtctctttcaccaatacctgatgcagagtaggtgcttatattagtcagggttctctagagggacagaaccaataggatagatgtatatatgaaggggagcttattaggagaattggctcacatgatcacaagatgaagtcccacaacaggccgtctgcaagctgagtcccaaaacctcaaaagtagggaagccatcagtgtagccttctgtctgtggctgaaggccggagagcccgtggcaaaccactgtgtaagtccaagagtccaaaagctgaagaacttggagtctaatgttcgagggcaggaagcatccagcacgggagaaagatgaaggccggaagactcagcaaatcaagtgcctgcattattctagctgtgctggcagctgattagatggtgcccgtccagattgagggtgggtctgtctctcctagtcctctgactcaaatgttaatctcctttggcaacaccctcacagacacagccagaaacagtactttgcatccttcaatccaatcaagttggcactcagtattaactatcacagggctctagggatatttgttgaatatatgaacacagctagacggggactggcttcataagggtgctatgccagaccacatatctgctgctctggagtattttcgggtcacctggaatcctggcaacccagtgaaagttaataatttattttaaaatattgataatttaatatttataacccctcattaggagttagtattaatgatcatctttctatattaaaattattctaaaaacaggttgagagataagttatcagctatttgcaattatttgaagatcatctcatggaggaagatgggagagacaagttacaccttcctgtgttgccagaggcactgtaagccctcaaaggaagcaatttggcaatatatatcacaagccttaaattgtctataggctccttaaagctggccataatatggtaaaaatactgtcatactcctggccaaggggtaaatattcacaatccttttggaaagcaatttgactctatctagttagagccacatttctggggctctagatggtgcccagttaacttcaggtcattctcagttaatgaatcattaacttaatggccacttcctcaaagagattttccctgaaccacacctcaccctcaaaccaggtacactttacctcatttttataacatttatcatagctataattacttctccaacatctgtctccttgcctaggttctaagctccaggccggtaggggcagtacttgctttatttgtctctatatccttagggctaacacagtgccatatgcaccttaagatatataaataattgttgaataaaatgaatagagaaaaatcattctaaataaaaatagatttaacccaaaggtaacaatatcaataattaacctttacagagaggttaatatttacctgaccctgttgtatgtgcctgtgtgtaattggcagtacagcccttgcgcttcttactcttacagatggaaaactgaggcctacagaacttacctaatttggtccaagtgaggcaaccagctaataagttgcttatcaaaatcttatttataatagcaaaaaattggaaagaacctacatgttatttgaatatttaatacatgcagttatcagaacctcagttttgtttccttttttaaaataaatttatttatttatttagagacagagttttgctctgttgccctggctggagtgcagtggcacaatctgggctcactgcaacctctgcctcctgggttcaagtgattctcatgcctcagtctcccgagtagctgggattacaggtgcgtgccgccacgcccagctaatttttgtagttttagtagagacagagtttcacaatgttgcccaggctggtcttgaactcctaaactcaggcatccgcctgccttggcctcccaaagtgctgggattacaggcatgagtcaccaagcccagctaagaactttggttttcaaaagatgtatagtaacgtagcaaggtgggtgcaatataacagttactggtcccattcagacaaatggatatggctgtgacagtgtcctttactggcacagtgctactccttgcttgggtgcccagatcatagctcttgcggtacataccagctgtgtcagggtggagcagaggaagctgaatagagaaagtaacatctggaggtggggcatgctttagagacaggaaactgaacacatcctgaaatgaaagggagtgtgagccttctaggaagtgagagaaattcagtgggtccagaaggaagttataagtgttggggctggagaggtaagcagaggccaaatggagaggacctttgggccttgtcctggggcagcagtgtcctgctgtgatcactgcatgtttggacgtggcaagtgggaggcaccaggcttggcatccagagaaggtcgggggatttgtttgggtagaattgatgcatttctacttttgttagaagagccagctggagacatgaggactaaatatggaatgtggaaaatggaaagagaattctaagattcaaagtcttggcctcaatgtcacatcctgtcaagggagcaaatagtgtgaaaatgaaagtaaagcctaaggatgattatttttcagtctgaaagaaaacttctgctttctgcgaattctatcataaagttagtatttagccccttttaacctggttgtttactctctggttgagacatcttagtcaatccaattcagaggtttaagacagtagtcagttctatcctactatgtttggagaatgttagttcaggctaagggttttcaggtatgataacaaatgtggcattttatagcttggagtgccctcagttctaagatccaaacgtgtctggaattggtgggttcttggtctcactgacttcaagaatgaagccacagactctcgcggtgagtgttacacttcttaaaggcggcgtgtccggagtttgttccttctgatgttcggatgtgttgagtttcttccttctggtgggtttgtggtctccctggctcaagagtgaagctgcagaccttcgcagtgagtgttacagctcttaaggcagtgtgtttggagttgttctttcctcccagtgggttcgtggtctccctggcttcaagagtgaagctgcagccctttgccataagtgttacagcagtgcggacccaaagcgtgagcagcagcaagatttattgcaaagagtgaaagaacaaagcttccacagtgtgaatggtgcccagggtaggttgccactgctgggtcgggcagcctgcttttattctcttatctggccctacccacatcctgctgattggtccattttacagagagccaattggtctgttttacagagaggtgattggtccgttttgacagggtgctgattggtgcatttacaatccctgagctagacacaaaagttctccacgtccccactagattagccagatacagagtgtggacacaaaggttctctaagtcctaaccagagtagctagatacagagtgtcgattggtgcattcacaaaccctgagctagacacagggtgctgattggtgtatttacaatcccttagctacacataaaggttctccaagtccccaccagagtaactagttacagagtgccagttggtgcattcacaaaccctgagctagacccagggtgctgattggtgtgtttacaaaccttgaacaagatacagagtgccgattggtgtatttacaatcccttagctagacataaaggttctccaagtccccaccagactcaggagcccagctggcctcacccagtggatcccacaccaggccacaggtggagctgcctgccagtcccatgccgtgcgcccgcactcctcagtccttgggtggtcgatgggaccgggtgctgcggaccagggggcggttctgatcgtggaggctcggccgcgcaggagcccacggtgggggtgggggggtggggaggggaggctcaggcatggcaggctgcaggtcctgagccctgccctgcagggaggcacctaaggcccggccagaagtcgagcacagcagctgctggcccaggtgctaagcccctcactgcccggggcttgtgggccagggggccgctagagtgccgggccccccaagcccatgcccacccggaactcgccggttcccgcctgcgcctctccctccacacctccctgcaagctgagggagccggctccggccttggcctgcccagaaaggggctcccacagtgcagcggcgggctgaagggctcctcaagtgccgccaaagtgggagcccagatagagaaggcgccgagagcgagcgaggactgccagggctgccagcatgctgtcacctctcacaaaggtgattaatgggctgctctgtttcaatgatggtggtgcgtcctccaaaattcatgttgaaacttcacccccagtgcaactgtattaagaggtgtggccgctgggaggcagagccctcatgaatgggattagcacccgtataaagagctcaaggttgaggggggtgctctcttgcccttctgccttttgccatgtgaggacacagcaacaaggtgccattttggaagcagagagcatgcctccgcagacaccagtgccagcaccttgatcttggatttcccagcatgcggaactgtaagaaaaaaagttctgttctttataaattacccagtctcaggtattttgttatagcagcacaaatggactaataagacatgagctttagaaatatcttgaattttttatacttattcatcaagtataatatctggagcaggaatttcacatcttgaaaatacagagggattttacagagaaaatgaggaaagaaaaaagaactttcttctttagtatctccttgtgggctgcttttattttgtcactgcccatacaaatgtgctgtagcatgcagttcaagaacttcaattttcctccttttaccttttatcactgatggagtagcctgcttgtctatgattaatacctctggatacacagtgaatcacctggggaatgtaggtgaaacaaaacaaaacatatgcctggctcattcctacaaccaaaagaattgaaagtagagtctcaaaaacatatttgtacattcatgctcacagcagcattattcacgatagctaaaaggtggaagcaagccatgtccatagatcaaaagatgaatggataaacaaaatgtggtatattcatacaatgcgatattattcatgctcaaccttgctaccacttgggtgagccttgaggacataacgttaagtgaactaagccaatcacacacacacacacacacacacacacacacacacacacacaaacacacacacgtctatcattccacctgtaggaggtacctagtcaaaaatctgaaagtggaggctgggcgcggtggctcatggccgggttcatggctcaagcctataattccagcactttgggaggagaggcaggtggatcacctgaggtcaggagttcgagaccagcctgaccaacatggcgaaaccctgtctctactcaaagtacaaaaattagctgggcatggtggtgtgcacctgtagtctcagctattcaggaagctgaggcaagagaatcacttgaatctgggaggtggaggttgcagtgagctgagatctcaccactgcactccagcctgggcaatagagtgagactccgtctcaaaaaataaataaaataaataaataaaaagtggaatggtatttggcagggactggggggaggaaggattggggagttaatgggcatagactttcagttttgcaagtgaaaagagttctggtgataggtggtggtgatggttgcacaatatgatttcacttaatagcactgagctgtacacttaaaatgattaagatgatatattttgtgttgtatgtatttcaccacagttctaaaaatcagggcggaaagttaatgcgataaaacaacatttgattgtaaaattcttatggaaaattatctggtggcactatcaaagaatatttggaaaaagaggagcgatctgccaagtgttaaatcgtacaacagtaggtaaaagggactgtaattgtgatctgatagtgaatgggcactgcagaagggactccatgattgatatgttttcctgtgacttttttttgtctttcttagtgtaagtctcttattttcttctgcagaaaaaaagagaccagtgcctagctgtagtgcttctgatagcattatgtccagaaagggccaggaagctaggtacaagatttatctctgccaaagctaacattcagtcctgggctttttttttttttttttttaatctagacacacattttcaggcatatcagattggagagtaaataacgatggaatgcctgttatgtacacggcctggtgctagaagtacaacaacacaattttgataaacaaaagaacacagaccctgatgccgtcgttcgtatattctattgaatttatctattgtagctattgataccagaagacttcaaacaattaactgaacaataattactaagtaagaattacatattatttattaattactcagtaattctgaaagagtcatacttcagggggccttttagacatacaaggcactgaaccagtgtgaggagattaatggagaccctaggaagggacatttgatctgaatcttgaaagctgagtttgtattaccatctcccctctctcttcattcttttttattttctggccttcttatacctctctttgccctcaccaaccacctgtgttataatcatctttgacttacaagctactgacaaatagcttgttaagaggggtaagatgatactgtttacagcctccttcaatctaagaatgaaattcttaaaggacaaacaacttactttttattggatcaagattagagaaagctgtctttcacaagtcaaatttagtaacttgtttttttgtgttttcagcaactcaagcatcccaaccttgttaacctcctggaagtcttcaggaggaaacggaggcttcacctggtgtttgaatattgtgaccacacagttctccatgagttggacagataccaaagagggtgagtgatccatcccttacaagcaaaacaaagacacactgggatttgtgagcgaaaagtggcaatgactctttttaagactaggtaaggccgggtgcagtggctcatgccagtaatcccagcactttgggaggcctagacgggtggatcatctgaggtcaggacttcaagaccagcctggccaacatagtgaaaccccatctctactaaaaatacaaaaattagctgggcgtggtggcgggtgcctgtaatctcagccagtcgggaggctgaggcaggagaatcgcttgaacttgggaggcggaggttgcagtgagccaagattgcaccattgcactccagcctgggcaacagggtgagactctgtctcaaaaaaaaaaaaaaaaaaaaagactagttaaaaacagccagtgtttgtacaacatactctgctgccaaggtggacagcagaaagattacaaaaaatgttacaaaaggataaaaaaaatagtcactttaatgaagaaaccagcagaagcatcattagattgaacttgatttctttggtactttatctctgcatagaagtgatctcagtctctaagaaaaggaaggatattagttagtctatgcctgaccagggaggtagaagggcttggagattgaaaggaagattccaaaggcaatggctactaggaagtttgagactaaaacaaacatggtatttcactgggagcaatccgggtgtctactctgctgtattactcaggatttctttggtttcaagtgacaaaaacccaactgaagcaagcgtaggtgaaaaacaattgtgttgtggctgtaactgagaagggtgggagtgactccgggggctccgctgatcttaccacacagctctctctagcatatgcaacatctttgtgtgcattggaagaagacttggtgagcacacagaggccttgtccaagaaaaagaaaaaaggaggagggggtcccttcctgaagttgagggcagcctcttgcagggtgagaggactggattccagctcccacccactcctcagctgggtgttttcaggcagggcaacgtaggtagtggctgttctttctcactctctcccagccctaattcttcttcattgtgccttgcaaataagcttcccttatatggtggatttgggagggcatgtgggtggcatgggctggaagtttggaagggaaaagtacaaaatagaaagcatggccacaggcttatatcaatctatatagctgttctagaagaaaggaattctagaagaaggtagcatctgcacattaagtctagtggaactccgattggctcagctcaggtgacgcaactatccctggggcctattactgttgctagagaaagaggacggaatgattagcaggtcctgggagatattattcaaagagagcttcatggtgaaggtggccttggagttgaaaggggaggagactttagataagttgaccagggatgaaaaatatcccatcctttccttttttggctgtgttctcgggagcccaactttggctggggacaatatgaagagtggattatagattagagccacagaatggtgtcccatcccatggactgtgaatggctcccattcacacttcagtggctggaggctgaggctcctccaacaactctttcaagtctttgccaggggcttgctctgccacgtggtgatggttatatatgatctgccgtgacctccaggcaaatggaatggaagcggcttgtggtttgttagtgaccacagcacagacttttcatatttcagaatgttaatttacatagccagagagagccaagaggacagacacctcccttcagaaagtcatcgatacagagaaattatgttttcaaaggagaaaacatttcatatgttgatatttgatcttttgacagcttgcaagtgacacttcaattaaacttgttaatataagttactcatggctatgtggtaccagagggatgttacagggaatttgattaatcatgttgagtggcttgggaacactgatttgtgggagtcaaaagcaatgaaagtcagctctttttttggcatatagtttgaacagaataaaaagggtgattacagtttgaaagcagatttttaaaaactccactggccaaaatatgttatatatgttccaggaaacagaaaatgctttaatatgggagttgcagaaaacagaaagacctgtagataaatgtgtgattaattacaagcaacctcatttccaaatggtaaaatgctatgatttgccaaatataagatttattaaggaaatcttaaggaaatcaaatataagatttacttaaggaaatcagcccccgacaggcctcagtatgtgttgttccccttcctgtgtccatgtgttctcattgttcagctcccacttataagtgagaacatgtggtgtttggttttctgttcctgcgttagattgctgaggataacagcttccagctccatcctgtccctgcaaaggacatgatctcattcatttttatggctgcatagtattccatggtgtgtatataccacattttctttttccagtctatcatcgtatgaaaactttttaatttagagacatcatactataaaataaaattttgtaagcacattcacagtaaaggtgagttagcattatccgtgtgaccttgggcaaattgcttacaggtgtcttcacctgtaaaaatgagagtttaggactaggtaaagtttcaggggacttctagctgtataatgctatgaattgataatcaagtaccttaggggtcagaagacttcggttatctttcagtttcatatttgatctattagacaatatcaacaaagcataagctactgatgctggtgttgccaggttgggttaccagcctgcttggtgccaggtggggtccccttaggttagtatacttaccctcagaatgtcctgtgatcacttcttatatttctaagtacagatttcttaaaatacaaagttgagcatgccaccctctacatagaatcctttaatagctccccaaagcttactggtatggggaaatccccccagcatgagatacaagatcttactcactctaccaccccactccccaccagtttgcccataatacatgacccatcctaccaaattccttgcattctaggttcaggacatgctgtttgctcagcaaacgtgggtttccttactttctctattctacctggaagactcctgctgtccttcctacatctcacatatgactcctttatgatgcctgccagcaccctggcctctataacatcttctgggattgtttatttacatatcccatttgcccagtaaaatgcacaatcctcaagggcaagagctgggccttcctcacctgtggattctcagtgtcttctagctgcatatttggcacttggtacatactcagtacttgtagaatgactgaattagcaaaccaataaattgatagttacaaaatgattttaaagaagaataatcataacaaggtttggattttcaatttaaaggttactttgatttaaaatttctaaagcctaatattgtcaaaagagattatgaagtactctgctggagcaacctgtccagaaggcaatttggcaatcaatgtgtggaattaaaagtcttagaggcattatcttaaacccagcaagtctactttgaacaatttaccataagaaaatatttgaatatatgtgcaaaaacttaattacaaaagtatttattgttatgggatatttttaagtattgtttataaagaaaaaattgcaatcaactgaaatatccaacaatagataattagttacgtaaattataataaagttttatgatagaatacagtggacccattaagaataaagcttatgttaacagataaaacatatattgacataggaaaaagttcatgaatagttgtcaaatgaaaaaaaattatactataataaaaatacatattatttcattttcatagaatttatatgtagatgggaaaaaagacaagtaatctgaatattactagtgatgagttatgattgttattgatatttttcattttatttgtgcttttatatttttcatgtttattattatagtaatgttttaatgtttaattattaaaaataattcttgccaaatcagactcaaagacttctcatttgaacctgaaatggacactaattcatcttcttattaacatgcttgtaacttctggtactcccttggaaagcttttggagaagatccaacttcatgttgctactaacacaagcaagtttataccatgagatatgtatcctgttacagtaacatgaatacatgtcaattataattcccagtgcttaggtttatgtttttataattgtccccaatcacaaccattccttgtcttatacagaatttaaaaaactttgtatctattattctatagatgattggtctccctgtgtcaaagttttacaaataactggtttggatgttttctcctcatttttctgcctacctatatgttcagccagacataagacttcattgattctttcctgcacagatttaattaccaccagttccttctctgaataacatagtttgttcaaagaacatctcctgggtaatgtacattactgcaagttttcagtttctgacagtgaaattccagaaatgttctctctcttttttagattaaaaatgatatgttgtttgttgcaaatttttaaagcaacacagacattgaaatgaagggctgggggtggttgctcacacctgcaatcccagcactttgggaggccgaggtaggcggatcacttaaggtcaggagttcaagaccagcctggccaacatggtgaaaccccgtctctactaaaaatacaaaaattagccgggcattgtggtgggcgcctgtaatcccagctactcgggaggctgaggcaggagaatcacttgcacccgggaggcggaggtggcagtaagctgagatagtgccactgcagtccagcctgggtgacaagagcaaaactccatctcaaaaaaaaaaaaaagaaaaaattgaaataaataaaatcaatagctttacatactgttctgcatttattttgtttttatttagttaaataaattagttaatattagaaacagggtcttgttgctatgctgctcaggctaaacttgaactcctgggctcaagcgatcctcctgttccagcctcctgagtagctgggactacaggtgtgcccaaccacaccaggctgcatttttttttaaatgtactctggagctttctccctatctatacatatctacctttatattttaaaaatggctgtatagaattccattgtatgaatataccatgatttcttagttcaatctcctattgataaatatttagattgtttccagttattttctattactaaccatgctacagtgaaaaaccattttcgtaaatatttctttaggatcttagtaatatattctttttttacaagagtttggccagacccccagcccttcccatctttgtgatagccttgtgtagaaatgaagtcttaatgaatgccaactgtttgatgatctgtgtcacaaatgttagacaagcagcagtggaaaggatgacttctgtaattgagaatgctggaaagggatacatgttatttcttcatcatctccgaagaatttcacatttctgaagaatttttaaaaatcggtttgatgtcttcactttcatatggtagtcgtttacatttctgtctgtctgattttgttattaggacattagggtcacaatacagcctcccctaaaaacttggagagacagagattgctttctgaaagttattttgtgaaacgaacacataatgcatcagggcggaggtatgtaaagcaaccttagacagaatggcttctaggcttgttagatttgactgactctatgttttatctaatgataaattattcctaaagtcgagatggatgcagttaagcaatctcagtttaacagcaatgaagagtcaaattgcctactttccctcatccaaattctttgctcatcattctgattataacttgactttctttatgaaattgtctacaaagaaagcatgagctagtactcagaatttgggtatgggtgaatacgttggcactctagttttatatgacaggctagttaatttgtttaatgttcacttgcccctttgaaatggatactgtcttggtatgctgacaaaattgagtgtctgtgtctgcaagcctgaagacggcaaaggcagccaagcttttccaaacgaagcaccacattctctgtgttctgtgatgagatggctgtttttcccctcaattctattcttcgcttaatattcttttctatgtattttctatatatgttgcattataatttttagatctattgtcaatgactgtaaaatattacattaagtttattatgtctcaccattcctctctggttgaatactgaggtcattttcagtgtttggtttgataatgattctggtataaaattttcctacaaatagatttttcttcttttgtaattttcctttagaagttctcaaattggtacttttgagttgtaaattttgccagacagaaccaatttactttctcaccaaagatatggatttatatatatatattttttcttataattgtgctaccttaggctctattattaaaatatttgatgtatgaattctatcaaacatataaggaagaaataatagtaaccctacccaaactctttcagaaaatatgagaaggaacatttcccaaatcattttatgaggccactatatgctgatgccaaaaccagacagacatttctagaaaagaaaatgacagatgaatattcctcaagaatttaggtaaaaaatccttagcaaaattattagcaaatcaaatccagcagtataatgtaatgtaaaagagtgattaatatatctcaaaatatcaatttttagacatcaaagcctttctattgtgagagatgaaaatttagctccctgaaatcactatctcctctgcttcctgttctaatcctccaaaatagttacattaatgttcactgttcccattattgtgcctatgtaaatattacttatagctgagcattgtaccatactatggcttccttttgtactttttcctcaaattaacacttgccttgttttaaaatttgcttgacattctttaatcttgttgctaattccctcccctgacctttttttttttttttttgagacaaggcctcactctgtcacccaggctggagtgcagtggcccaatcatagctcactgcaacctccgcctcccaggctcaaataatcctcccacctcagccttctaagtagctgggactacaggtgcctgccaccacgcttggctaattttttgtattttttgtagagatgggatatcaccatgttgcccaggctggtctcaaacttttgggctcaagcaatctgcccacctcagcctcccaaagtgctgggattacaggcatgagccactcactgcgccccaccccaactcattttaatagcctctcaatgtacattttcacaggatagttacatcaggtaatccatcagttccatttttttttcttggtaatgtctggcctttaaacctccttttccttctgtctggcttgttgtactcaagacctgctgtccagctgtatcccttggatttccctttgccatcatccttgtaattcctgccgcatttctctgtggtcagattcattacttcctggatttgtcttcctctttctgggtttacttgcttattttgaccaagtacatccatctctaactggttaaaaagatgatataatcacacagaaatctagactccagggatttcaaatgacacccccctctcccgcccacacccttccttagaatcaagcagttgggaaccctttatgttcctggggggtgaaacaaaattcacaaagcaggcaggaagaatgccatgaggtcacaccagtggagagctcagcagtgtgcccattctccacatcttcccactagcgaaagatggattccattctgccctccccagaaggagtgcctctggggagctgggcaacagcccagtgggctctggaggaacaactggagctctcaacaaggcaactgaactgaaggcctcaaggaagaccacctgactacctatggaagtgccttcttgagccccttccatcttggtgtgggacagaaaagaaagggaggatccttgcttgattttctcataccttgcccgactctcatttctaggtcgggggagctgatatcttcaggattttaaagcccaccagaccaggcccagctggctgggagtccaaaaggcccaagttggatcctgtccagctcccttggagtactatttactaggaagaaaagctggggatatatatggctcgtctaaagttcaatcacctaatcccatggcagagaagaaccaggcccaggagaaaagctcaagccccttcttctctcatagattaaggttgagcttatgtatgattgctctgaaaggagagcttgcttttgagctagaagagctattaaagggagtaaagaatgagaaggaattgagccccttttcttcatacctgttctagcccttccccactctgccctagagctcagccacaaccactatttaccaccaatgtggaaacaaatatcttaaggtggaatgagttccctagccttgctagcacgggctacaattttaagaacatcttccttaggccaggcatagtggctcatgtctataatcccagtgttttgggaggccaaggcaggagaatcacttgaacccaggagttcatgaccagcctgggcaacacagcaagacccccatttctgcaaaaaaagtattggccaagcacggtggctcacacctgtaatcccagcactttgggaggccaaggcaggcagattacctgaggtcaggcgttcgagcccagcctggccaaccatggccaacgtggcgaaaccccatctctactaaaaatacaaaaattagctgggtgtggtggtgtgtgcctgtaatcccagctacttgggcggctgaggcaggagaattgcttgaacccagaaggagaaagttgcagtgagccaagatagcaccactgcactccagcctgggtgacagagggagacaatgtctcaaaaaaacaaaacaaaaacaaacaacaacaacaacaacaaaaagacaagagagaagaacaaagaacatcaaaacatctgccttagcctgaagggtccagccagtcacccagactcttccagagctgttaagtttgttgaatatattcatatttatttaagattgcatgaggcagagggcatggcgatgataccccttactgtgcatggctcttgggtcacactgtcctgtcaggatgggttgcttttgccacctggagtgcagttatcccgtcatctccctctgccatcctcccagaaactcctgctgcttccctcctgcattgggtctccagcccacataatcttctttgataatggactgctcctttctggtggactgcatccatgaggggcttcctgagaaagagcagatgagaggtacaggaacaaataagaggttgagaccttgccctcacatgctttattctatcctcacactggtttggtattttgtttggatataggcttgtttattggtttttggttgaagataatattccttcaaatttttgaagtcattattttagtgtcttctatcttctagtgccaagaagcctgatgccattctattttctgctctcttgtgaagtcctgtttctttttccagaaacttgtaggagattctctttgtgctcagtgtttttgattatgaaactcatgagtgtgtcttgattttcatccattatcctggcacttgctgggccttttctgcctcagaaaaaaatttttgaattgttttgttattgacttcctgttcattgttttacctattttctttttctgtaccctctattattgggatgtggactcttgaactggtcctcccattttcttgtagtatcctgttcttatttcatggatacaacagctttcctgttctctctgaggatattaatggtatttaaaaatgttctcttcatcctccataatttctgtttcttttaagttgcttttttctgtttgttctggtcttctactttcttattagaggcttttcttgggcatcatatagtctctggttatatgctcatagttaagaacaaggaactactggaagctctgagcttcactatggttttctagctgggccatttgctggtggaaccccagtgtcagaatcttcagagctttccctctgagcttctcccaaaaaagtctttgaatattgtgcctggagagtgaagtctgcctgccgggtttcccagagtctagtgagggaagaggggtggggaatcccagcattcagcattttgtatgtgtacagtcctttaatcccctgttttcagaacagtatccacattttcagaacggtatccacaatctcacgtatgccaaatgtcctctgctttatcctttccagaaacaaagctccagccttctgcccagtagtggagagtgtttccctatgggcaaatgatagaggaggggatctagggatttaattattttctaaacagttttttccatactccttagctcctagttccatagagactttggctgctacttcccgagccttttgaggattctttctggatgaattggttggttctccaccttccctctcctggcttagattttcgctttctaggattgttaagttaattatctttcattcagttgctttctggattccacattgtgttgctgttatctcttctcctgtcctctctgaccttgtgaggttttgtctttagaagtcttcagcgtagttctagtcaggtttcaggagggaacaaaattagctgggcttgcttaatccatcatcttaattcagaagtcctttgacacactttcttcagttggtcctgtgatactgtattctcctgagtgttgtcttattcacttgatgctctcaactcaggtgcccttgtggggtccccttcctctttctgcccctctgtggggaagggtctcacagcttccttccaagctcctcttctttagctggattcactccttaattggcttcattcagtcctaggccccaaataccacccatatgctatgcttctcaaactcatatttccagcctgaccttccttctgaatgtagaattgctgactcacagtcttcctttgggtgtccagtaagcattcccttcccccaaaccagtttcccctccagtgttctcctgagtaaaaggcaccactgtgtaccagttactcaagctaaaaacctgatgtcattccttgattcttctctttctcccacatccaatccctcagaaaatcctggaagctctattttaaaaatatagcccaaatctggccacttctcaccacttaaccactattttagatgttcccttaaccagagaacctttctgggccatcctatataaggtgatcaaccccttctagcacagcactctcacgctgtctctctctctctctctctaaatccaacaccacagaatatattctatctatttttcccctttttatagttgtaactcccttctccaacagtgaaaaactggcctctcttattatgagtgtttcagctaaaagggatctcagagtctgaggcctctgcattacagaaaagaaactgagtaaagaagtgaagtgagtagccagttcaagatggcactaagtagtttgtacagagtttttacatttgagagttttgtaattctggggattagctgtgctggggattaaaggagcaataatgatatgcaactataatttacttttatatgctccttttatataatttatttggggaaatgtttgtaggaactaaagttgcctggtactggtaaccctatattaatacttaatttgcaggccgggcatggtggttcacacctgtaatcccagcactttgggaggctgaggtgggcgtatcacttgaggtctggggtttgagaccagcctggtcaacatggtgaaactctgtctctactaaaaatacaaaaattagccgagtgtggtggcacacacctgtaatcccagctactggaggctgaggcaggagaatcgcttgaacctgggaggcagagtttgcagtgagctgagattgtaccactgcactttagcctgggtgacagagcaagactccatctcaaaaaaaaaaaaaaaaaacaaaaatttaatttattgaataatcaaaatatattccatttttctggacaaaatgtagaggctactgggaaggctgaggcaggaggatcccttaagtccaggagtccaaagttcagtgagctatgatagcaccactgcctccagcctgggcagcacagcaagaccctgaccctaaaaaaaaaaaattaaaagtggaggctggggaaaagcattccccctaatgtctcatcttagttgcatttttctaagccttttttctcgacagtgactttttctagcatctatgcctatatgccgctcaaacaaggaaaagagaatttggagagaagcaacttcaaacacagggacatagccctggtccagcaatgtcccaactagccttcctggaagtggcctcttcctttccttcatgtgatcccactctctgttcaaacaccccctgatctgcttgaaaggatttcctgaacgtctggcctgtgacaacagtggccttgtagcctctctcagaggctacaagtgactttttgtagtccccttaacacagctactcaagagcttcctccctgatttacttattcgttttggctgaggaccacagcaacactgtggaatgtttatcaaaacagtaagtccagccagtgggttggggtctcagaaaataaatgcactctctctgtggttcgtttcttacactccctgccttggtttgttgttgttttaaatgtttccaggcgagatgcctctttctaattcacacaaagtacctgctggaactactggttgccctggtaataaaagatgtgagtcagggaagaagtactgggagcagtggcttgaagtttagctgtggtgatggaggagagagtagaaagatgtacctgggctgcagctggctgccatggcagcatagggaaagaaccaggatgcctcaggtttttaaattattattaacatttaataacaatttacgatgggggagcaagagagactgcatcaagaccctggtagggcagatctgggatgctaaaaaacaaatagaatggtttgcaatgtaaagctctttgctataatcagtaaagtcttcattatctaaaaaaccaaacaaacaacagcaatgctgctctgagagaccacatgcccacacatggaagatgagtcctgcttcaaggctgtctgtttggggcaacttgagaaaataaacagcatcttttgtgctgaatagtaacttaactttacatcagtaaaaaattccttgtgaaaatggagcttaagttaccaggcagtttcccagtggtgtcacagatgtttgagataggtggttataaatacttgttgaaatccctgtaggttttcatgtccttaccaaagaagtagatgtttgcatttttgttaacctgttctccctagacttcagcggtgtgctggtcgcatatttttacattttggattcatggaatgattgatgagtaagatgactatgtgtcacctaagatttttcactactaaagcctatcttcgtttattttttcttttcttgagctgaattccatggctacactaaagaatgtgtttgtgctgctttatttttattagggtaccagaacatctcgtgaagagcataacttggcagacactgcaagctgtaaatttttgccataaacacaatgtaagtctcatgatctcttttgaaaagcaacaaggctccccttaagctgaggtggagccttgtacaaagtttatgtcacacttctgtgggtaaaattttttacccaaatcttcataagcctggttgggtaagtataggctaaaaatgccaacctagctattccttcttgctcaggttatataaaacatgcatttttatgattttaagaaactagtgccaggcatggtggctcctgcatgtaatcccaggactttgggaggccaaggtaggcagatcacttgagcccaggagttcaagaccagcctggacaacatggcaaaaccctgtctctacagaaaataaaaaaaaatgaactgggtgcggtggtgtgtgcctgtggtcctggctactcaggaggctgaggtggaaggatcacttgagctggggacgtcgaggctgcagtgagtcaagatcatgccactgtactccaacctggatgacagaatgagaccctgtctcaaaaaaaaaaaaaaaacccacaaagaacaaaaaattagtcatacatttatactgcttagaaactactcagatttaaggtagaaccccattcacttggagtctatgtggtcttgtactcccaaaaggctatgaaattggggaaaaccccaggtgattcatgcctgcttagctgcagtatatcagttgcagtaggtggaaccccaaacccagtgcaaagtgccagtgtctgctttggtgagatatgagtgtcgagtctcgaaccaagcaacctatcgaaagcctgtgacactcctggccacaggcggctggtagaggcatagtagactattgcccaggtgacgtgacttcacagatgctgggaagcctgctgccccatccaatacaatactgcccactgtgcatagaaaccagattccaaagttagagcttcgttttggccatgagtgcaatttcactgcaatgttttatcttactcaactgccagggtcaatttaggtggtagggctaaatctccttctttatattgttccaaatgatttttcctgatgctgcattcccggaaggaggaagtatgagagtagacagcacttctccctgaggagcctccaactagctaaaggctataatccttgtaatacacaggggagagtggacacccatattgttagttactatgacttaccactctttcaagagcaggttttaggatgggggagcaagagagactgcaccaagaccctggtagggcagatctgggatgctaaaaacaaatataatgcataccacagttccctggagagccccagacaccctttttggctccatgtgctgatgggggtgggtgcagaaacttgtaaagaattcccagaacagaataggagcacatgcttgcttacaagtacttctgaccatatgtcatcatgatattcatggtgtacccatttatagcaatatgtgaagccagtggtaaaaagaatagagatctcaggatgttaattgctaagaaccagatcgattataataaaatcccaaagttgttttatttcccccaaattttccagaataataaatacccatggggaaacattgacactgatctctcatcctgaaggtcctttggagtgagaactggtcatgcccaagaagaacccaagtcctctccagattcttaagaataaccccagggtttcaggctgcaggccaaagagggtctctcaggttgcaaacgatctagcattctcctcctaagaggaaaacacttgggaaagaggaagattattagggaccctgagcagtattttgacccaagtcaaaaaaaaaaaaaaaaaaaaaaagtaactcttaattaggttgttgatttgttctttgccaaagaaattgtcatttaatgagaaaatcatgtgaagattctcaaacgttcttttctctaagatcaccctgtttaagaatgttggctgtgggctggaaaccacaggtgatttgagtctaaattctggagggggggccgcatctcgaggggtggctgcagctctcagagcacttgtgtgtgggacagagctgacatctagcgactctccccagagggtgagggctgctgcctactcttgtttatcttgtccggatgaatgtcagagctggaagggaaatctcttggcaagctgtggttgccacccttctcttcccagcttatctcagcaggcccagggcttgtcctgtttacgaggctgactgtgttctgttcacagttaaacaactgaattgtgaattctgcttatgcaccaatttgcagctcctgcaaccatgatgcagcctcacccggacctttcaacattttccctttcacctaaaactgtcagattaaatacaggacaccctgttaaatttgaatttcagataaacaagcataacttttagtataagtacatcccaagtgcttcatgggatgtattatcctaaaaaaattatttgtttatctgaaattcaaatttaactgggtgtcctgtatttttctctgctaagaccggctaccctactttcattttcctttcactcttcttggctcttttgggccttttaggaatttgggatgattcaggctctgacaggcatggtactagatttattttaggctgctcttttgctgttgtccaacaggccaaggagagatttaaatgatttatccaatatttgctaaatagtcatgtgtttcatttatcccatatatagttcagccttaatattgtttttgttttgatttgttacactagtgcatacatagagacgtgaagccagaaaatatcctcatcacgaaacattccgtgattaagctttgtgactttggatttgctcggcttttgagtgagtattgacattttcttttgttaagtataaaaaatgaaaaagttattgatacaacaaaggatctaaatgctctagaagtatacaagatagtacttgtatatttagggcataagtgtgctataaattataattttgtaattaccgaaaatgtgtagataatacaatggtttacctatgtatgctatccataaattataccacagtaaagtagttattaaaaagtatcttacctccctgatttctaccatttcttgctaaaatacttttcagaagtgctactttagaatagtggctttcaaccttggaggcagattagaatcacctggggaactttttttttttttttttgagacagggtctcactctgttgcccaggctggagtgcagtggcacagtcacagcccaccacagtctcgacctccccagttcaggtgatcctcccacctcagcctcctgaattgctgggactacaggcatgagccaccacacctggctaagttttgtattttttttgtagagacggggtttcaccacattgcccaggctggtctcgaactcctgggctgaagcaaaccacctacctcggcctcccaaagtgctgggattacaagtgtgagccgctgtgcccagggaactttaaattttaaaccaaaaaaccccccccccccccccagaccctccccagggattctgttttaattggactggagtgtggcttgagcatcagtaatttacaaaatatttatttaagtgatttgaatgtgcaactagaattgagaaccagcgatatagaaaggccacaaaattgggcacaggcttgacttctgagatctccccctcagttttgattccagccttccgctgctgtttgttttccatgttccatcactggctagctggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggtaagtggtgtttttgtcccaccttttggaaaactggatatttccccaggttggggcagggcagagccaagttctcagtctcacctaatgccctttaaggcattagttaggaaagaggaaaactcgaagcctcatttaaatgactccattaaaggtggccatatttgttttaattaaaatagttaacaattattgagtacttactcattgtccaaaaacaacccaagattcttgagcagtttggatcaagttaaaacattaataatgacaataacaacaataaaaactcacatttctgtaagggcttagcagtttacagaatgctttcatggtttaccttgtttatgacgatggggtaatccatttggatgtccttaatcccagcctgcctgactagtttggattattcagactctatggagaatgattcccaaccttctaagtgtcaggaggaaagctagttgtaatgtcactcagtccgtcttgctttcccaccccagtgccctttcctttctctctacccttggaggcggaggggaagggcaggggagaagggagggaagatgagaaaaaaaaacccatcagtagtgattgccctcttccaaagtcagggagtttagacactactcgcctgagtatcgcagtttaaggtaaacttttcctcctctaaactcttgtaggaactgccatcgccatgccttcccttgtaatcttatcttcccaaagatactgtaaacttcctgatggtgagaccacgtcttatatttctacttaccctccaccagtgtctgcacattgtaggcaataaatgtttgctgatagcttgactttgttgggtgacatggaaggcgctttgtaggccttccaggggcactcagcctttcttggctgtgtttcctctagtgattttaggacagcctccccatgtcacccctctggcactggaggaagaaggttattaaggtgcaaggaattgtgctcatgatgctgctcactgagatctgggacaaggcattgagggtatatcttggttgctcacccaaaatgaggcgaggcagcagtttttgcatttgagtgagaggtaaatttctaggatgcatcagtaataatttgataccctggagtaggaactcccacagtgctctgggaaatgggcctggttgtgccccaggagaacacctttgagtatctccctatattctctgaacaaaatccctcttcaagtgtaatatagaattttacataaaggggattttagctgatgtgatggaaatgtgggcaggaggagcttcctagagtcccctaaaatatagaaatactcttcttgtttcattatgtcacattgtaagtgcttctaaacagtagatgaaatgggatttccatgtgattgctaactggtgaaataagaaaagatggtcccaatgtggaaatgtattccttctagctagaaaatccgtgatttcttccttccttcccttcccctcccctcccctccctccctccctctcttcctccctccctctcttccttcttcaaatatttattgagtgcttgctctatgttagacactgttataagtgctagggcaataaaattttatcttcacctatcaggattcagttaatatgattttgatttgtggttgttgccgttttgctgttttttaaaaggcattattttatttgtgtgcatgtgcttctgagttgtttggtttgggttccttcagtacactgtaggctctgagaacaagaacctgagagcaagaagcttgtagccctcagtttctgttgcttgcctcctctgtgcctaacacagtgtgctgtccaccgtagggatcaatacaggttgctgtgggttgcctgaatgcctctccttctgattgcccaagaacactgcagtgtccatgcatatgggcacagacaaacacagcattgatggaagaaaaccatagatcagtgtttgctaaccaatttcacttacctttttcttttcttgtccaaaggggatctcattcctaggcaccagcaagtgtttagcacgaatcagtacttcagtggagtgaaaattccagaccctgaagatatggtgagttacccattttggagagagctctgtaggccaggctagctaggctttggttgttattcacctcctgagccccatggctcaccctgcattggaggtcagtctaacagagaaaaagaaaattggagcaaattggctagcgagactttagccttactgctcatttagaggctgctgataacagagtctagccagcctgttgcataggaaggcagcgctgcctgcctgctggagccacacctgtcctttatcatttcttagcagttgaacctaggtagcttagagccaaccaacttttagacctagacctatcaaggtaaagttaactagtttttccccagcattgtccaaattccctactctactatgcccatggtctccagaccatgggaaaaatcataatgaacttccttgggctgggtgcaatggttcacgctataatcctggtactttggggaggccgagatgggcaggagacctcacctgaggtcaggagttccagaccagcctggccaacatgatgaaacactgtctctactaaaattacaaaaattagccaggcatggtggcacatgactgtaatcccagctactcaggaggctgaggcaggagaattgcttgagcccaggaggtggaggttgcagtgagccgatattgcaccacaccactgtactccagcctgggtgggcgacagagcaagactctttccaaaataaataaataaataaaaacttccttagccagccttactctggtgcttaccctctattatggccaacccaaatgggggaagcccattttttaaaagcagaaaaatttgaaatgtttatacccctaatccacttccaacaatttattcctgtgaaaccataatccaagagcataaagatgtggcattatttaatagaaattatttcctttagtattccatcagtaggggattatgtatggtacatccttacaatagaaatacctcatcaggccaggtgtgctcatgcctgtaatcccagcattttgggaggctgaggcaggtggatcaggggctcgagaccagcacgggcaacaagacaaaactgtgtctctactaaaatacaaaaagttggcctagcatgggggcacgcacctgtagtcacagctactcaggaggctgaggtgagaggatcacctgagcttaggaagttgaggccgcagtgacctgagatcgctgcactctagcctgggcgacaggagtaagaccctgtctccgaaccaaaaaaaaaaaaaaaagaaagaaaaaaaagaaataccatacagagccaggtgcggtggcccacacctataattctagcaactcaggagacaactgaggtgaaatattgcttgagcacaggaggtctagaccagcctgggcaacatagcaagaccctgtctctacaaaatatttttaaaactaactggggttggagacacatgcctatagctccagctacttgggaggctgaggcaggagaatcacttgagcccaggagtttgaggttacagtaaactatgatcatgccactgcattccaacctgggtgacagagcaaaactctgtctctaaaaataagaaataccatgtagttaaaaaaaaaaaaaaaagacggttataaaacagtgtaggctgggcatggtggctcacgcctgtaatcccagcactttgggaggccgaggcaggtggatcgcttgagcccaggagttcgagaccagcctaggcaacatgatgaaaccctgtctctactaaaaatacaaaaattagccaggcacggtggcacacacctgtagtcccagctacttgggaggctgaggtgggaagacggcttgaccttgggaggtggaggttgcagtgagccgagatcacgtcagtacactccagcctgggcaacagggccagattccgtctcaaaacaaaaacaaaaacaaaacaaacaaaaaaaccagtatgtataatttgacaaagttttaataaaaatgtaatatgcacacaatgcatatatacatatatttacatatataaatacaaaataatgtgacaacatctgggaaatcacaaagctttttttttttacatttgtgaaataaatggctgcaaggatatatatcaaaatactaagagtggatatctcttttgggtgggattttggggtaactttatgattttttatatttttgaatgtcttctaatgagcctgtattgtaatcaaaaacatttcagagcataattaaggtctgtgaaatcttgagtttctactgaggaaggtatcttaaaaatgaaactaaccctccagtttctcactaaacccttcagttttcagatggaagttctgtctctaccacttgtgttttgtttgttccctaacctcttggcttgtcccacaatgaaggtttctgcttctccactgcctcttcctcctgtagcactagcattcaaagtgggtcttgctgggacggaggggcaggaatgacacctgacatatgggaggtgacccatctggcttccttgtgatctggacattcccagttgtgcactaaatatccctagtgatttcctgttcacttgtctgttggtgaagcctcagaaataacccaggtttcataaatgtaagaagcttcccatggcttcccagagattgtcctgcagatttcctgttgacagaaacacaggaagaggcagtgcgggggctgcactggttgaacatctgtgccccagtccctctgcctgtcagtaaccctgacagagggaggcctgcttgcttctggggctgtgaaacgctcacagatgggctccagcgtatcacaggcaaccagctggcctcatccagacattgttgctgagacagcagagctcgatgatatagcaatggcacgtcaaaccccagtgatgctcagattcaaccgacagaaagaacaagagaaatattgaagctatggagcatgagtggaagtatgagggtgcaacaggggctactgtcaagggctaatacaaacctactttaggattttttttttctcctgttgacatagggaactctgaaacagaggctcttctctcctactcttatcaatgattagtatgtgtacaatccagaattggttattgggagctggttgcctgtccaaaataatactgtactgtgaaagctggccacagcaccaggactgtttgattagatgagcctggccagtcactccagtcggcagctcacacactgccacttttatacacacaatgcactgcagtcacttattttgctcagcttggctggctcttattttctcagcctctctgctcaattagcctttgtcagtggtatgtctctttaactggcctgtttgtctgcctgacattcggcattcctcccatttatagtgttattcctgattgtctccagcacgtgactggcgcaaaatcgccttatacggccaaaaggagattgacgaatgccccacaggagactgtttaaacagcaggctgagaagggaagcagcaggccctagtgggaggagacaacagtgtttattccagaaaatcaagaagcatctgttcacctgggtaggggaaaaacatctattttgcagctccctttatataattagaattagagctgcctttttttttttttttttttttttttgagacagggtcttgctctgtcgcccatgctggagtgcagtggcacatttatggcttactgcagcctcaatctcccaaacccacgccatcctcccgccttagcctcccaagtagctagtactagaggcgcacaccaccacccccagctagttttttggtattttttttagagagacagacagggtttcatcatgttgcccaggctggtctcaaattcctgggctcaagccatcagacttggcctgagtggattataggcatgagccaccgcacccagccagctacctttttataaatcacactataaatgccaaaaattattctcaggaaaggcaagttatataacttgagcccccccaccccctcaaaaaaaaaaactgctcagaaaagttttttttcattagtatttttatttataatttgctatctccattggtatcagagcaggaagttaagggagtagttacgaagcaaatttggaaaagcgatttggaggtggggagagaaagcttgtgaaaaaggcaaagggagactgttttgggcaggaggttgggtgggcaaagggtggaggacgtgaggaaggtgccaggaaaatgtttctatcaaaagatttaatttgaggtaaccttaatttgaatacatgctgtaaattaaaaacctcttttcttttcaacaggaaccacttgaattaaaattcccaaacatctcttatcctgccctggggctcctaaaggtaaaaatcatggcttccaacagaccaggaagcacacagcagttgtcatcactggggaatctgaattacttatgtcaatccatgcaatgaaaagtgttccttttagaattcttctcctggctgggcagtggctcacacctgtaatcctagcactttgggaggccaaggcaggcagatcacttgaggtcagttcaaaaccagcctggtcaacatggtgaaaccgtctctactaaaaataaaaaaaattaggcgtggtggcgctcgcctgtaatcccgactactcaggagggtgaggcgggagaattgcttgagcctgggaggcggaggttgcagtgagttgagattgcacgactgcactccagcttgggtgacagagtaagactccgtctcaaaaaaaaaaaaaattctccttggaaaagtatattttcaatttttttaaatggatcacaacctattaagaaaacatttgcaagtattttccactttaaataaacctaacattatatttgaagtctaaatttacacaaaacagaaatttcaggggggtggtgattgttttacaaagggaactttttcttcagaaaatccttagctgcaggatccttttaaatagctaactccctggtacatttgaagtacatttaaaaacttgatatatatatttatatatatatatatttagaaatatagctcttatgtaaaatgaggtatggtatcaactaaaatgtttgcaagttacagtcaatgtcccacatggtttaaaaattatttatttactgacgtattaaataatgagttaatataaatgataatgtaactgttacctgaaaggggtcccaatccggaccccaaaggaaggttcttggacctcatgcaagaaagaattcagggcgtgtccacacagtaaagtggaagcaaatttattaacaaagtaaaggaataaaagaatggctactctataggcagcagtgctgtgggctgctcaactgagtatacttacagttatttcttgattatatgctaaacaaggggtggattatttatgagttttccaggagagggcagggattttctggaactgagggttcctcccctttttagactatttagggtaacttctgggcattgctatgggtatttgtagactgtcatggtgctggtgaaagtgtcttttagcatgctaacacattataattagtgtacaacgaggagtgaggacaaccagacatcactttcatcaccatcttggttttggccggcttctttactgcatcctgttttatcatcaggtcattgtgacctatattttgtgccgacctgctatctcatcctgtgagtaacaatgccaaacctcctgggaatgcagcccagtaggtctcagccttattttacccagcccctattcaagatggtgttgctgtggtttcaacacctctgacataaccaacaaaaactgagtcaattccttggagtatgtagttgtgaaatttaatctaatctatccaagaatgagctccatggcctacttagttgcaacaaaaatagttaagaatgatgtaatataaaggcatgtacattatgcctctccttatatacatgatcatatatacttataatgcatcaactatttctggagggatacagcaaaaaaaaaaaaaaaaaagtagctgattttagaagggtgaagggaacacctacagtggtggagactttgctgtatgctgtattaactgtatttgttatcatgtgtaaatatcatttttaaaataaaaacactagtttttacaaagtacatgcaagggaccaaactggctaaatggattaccccatttggccactgaggtaaactctaaaattatatcttactctcccagggcagagtaccaattgcttcaagaacagaataaggtggagaaaatgatttttcattactacttctagaaactgtttatttaatatgtgagtgccatttaggaatgactggaaggaactaaaatcatgactggtgtgttttcctgccttttcccccttcttattgcaactgaagtttcatctttcaaagaagaaaaaaatgacattaataagttaatacaattttgaagaagtaagaagaaggaattttctgttcttttagggctgtctccacatggaccctactgaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaaggttataatttgaaatgatctcctacctgccacctggtacagagagttggaatctagacttgaggatggcagttgtggctttcagctccagcatcctcattccagcactaggagacaggtcataggatctatcaaccagggccccagggacatctgtctcctgaagccccctctccctgaatcctaaaggtgcccttgtcctgctgcttcctgatgccacacaggggccagggtttccagcctgcatgagcacaggtctcaacaaggtacatgagtatgagtccagctaaggagactttttgggctttggaaaataaaatcagattttccccatgcagttctgtgtcatcatgtacacttttagtattaaaactaacactccaggtttgtccaaaaaaggagctgttttcctccctgatcctttgtcagagttggctagggcaaatacagtgatgagtgcttttggtggtatcagctgaatacatttaaccagagaacagcatccaaactgcacactgggagactgtgaagaatcctgattggtataaaatggccttacattaagcatcttgtgataagccaaaagctgtaataatttagaatgaactgtagttggaaccacaactgatcctgggtaacctcaggatctacctaggtactccttaagctatacattatcttgccttagtctttctctttgcagcttccactgcccagcatgctgaatggtaccagggtgtgttgtgtatgaggctgggaggagggaaaagggtgaaaaaggtccatgaggaacaagtacagcatgaactccagggccctaatgtagatcacagttacaaaattaatgttttattctccatcatatgtgacccaggtagcacaacaggccagaaacagactcctccacccccacgccagaattattccttatctcagtattagtctgtattcgagagcaaaaggttttgatggaaatatttctatttgaaaaaatagggaaactccactatttggtgtattgattttttttgagactgagtctcactctgtcgctcaggctagagtgcagtggtatgatcttggctcattgcaacctctgcctcccaggttcaagtgagtctcctgcctcagcctccccagtagctgggattacaggcacgtgccagtatgcctaactaatttctatatttttagtagagacagggtttcgccatgttggcaggctggtctcgactcctgacctcaggtgatccatccgccttggcctcccaaagtgctgggattacaggcatgagccaccgcacctggcctggtgtactgcttttaaatcctgaaagaatcaactgatttaaaagtactaaaaagcacttttctgaggacaatggctgaaaaatttttttctagaaagtaaaagtactaaacagttccctttttagggataccgaaggacatacagtgcaatacaaaaaatacaggtgtgttctttcatttgacattgacaataaattcaaacattttcaggaagcttgaaggaagcagtttgtcttttttctttagagatggggatcttgctatgttgcccaggctgctctcctgggctcaagggatgctcccactcagcctcccttgtagctggaactacaagtgtacactgtgccatgcttgatttgcctttttaactaagggaagagagtgagtaggcaaattgcctaggtgctctgtttatcagttttctccgctataagacaaggcattggcttaaatgatccctaagatctcagcaagctctcaactcctgtaaatctatgttttcttcccaataatgttaacatgtagattttccccttttcatattctctaaatcttctttaatgtgaatgtttttcctttttaatataaacatttaaaaggaaaagccaagacgaaattgaaacatttaatcctctctcaagtcctggattgtgtgcaaaaaaagtacttctatactaaaaagcttaattacctcttttgtgatatattctaaataatgaaaaaaatgcatggcacagttttgaacctaattctgtgttttgcatttttagttgcagtacctaccccagctaactggcagcagcatccttccagctttggataataagaagtactactgtgataccaagaaacttaactaccgttttccaaacatttaaaggagctaggagacatgattttaaaaaaggaatcaatagatgctttgaagaaaataaaacttatacagttgattgaaaacaattacaatgttgaaaacacaccaggagaaaacataagcaagaaactgggaggccaactggcaagatatgaagggaaattccagatccagtcttccatgcttgatgatggtgtccagaaaagaaaaaacctgtttggagttgcacttgtatttcagtttatgtaagtagccgaacttatggacagaatatgaactgtcccatacctctggcaaaactagatgatatcaaaaagatttatgcttcagttgtaccacatgccacacaagaaaaatgaaccacaaaatgcccatatatatttcctcggatctctgttgcctgagtcctatctcctgcctctcagattgtttcagcatcatatttaagatagttctatttcttgaaatcaaaatgtttaaaatcccatttcctgcttgctctatttcttgatttttatattttaaaacattttgagggtaacacttaggttcaaaatatttaaaagcatatgaattatcacaaaagcttggtaatttataatttaattatatgtttccacatttcatccttactttatcagtaaaggatacaccttagtcacttttgcaggcaacgtggatttactgtaatctgtctacatttattcacccaattccccttgtaaacaatggcatgaagctcggcagctgattaaggcagtcaaagggtagagcaagacctacaggctttgcaggaactgaacctatcagcctgaaaataattagtatttcattctctctggcacagcctttgacctggtacatctataggcaaacctgtaattcagtgatctgggtttcagaagaaattacttgtgagcttttacttgagtcatgaaagacattatgttgtaaactgatgttttccctgaaacatctttttgcactatgtttgtatgtgtatgtatgtgtatgtatatatatatatatatatatatatatgctattctaacaactaatatattacactaagtagtccaaagtattgaggactcatagctttgcacagtgagacttaaaatgatgacacacacacacatatatatatatgtgttttttatatatatatataaaacctgccacctcagcctcccaagtagctgggactgcaggcatgtgccactatactggctaatttttttgtattttttggtagaggcagggttttgccatgttccccaggctggtcttgaactcctgggctcatgtgatctgagcgccttggccttccaaagtgctggcattacaggcatgagccactgcgcctggccaaaatgacataattagctttgatttggtctactgctcttaatcaaaaagctttttcatccttgtcccctggacacaagggcaatatgaagcctgacgtctgtttcttacagctcaacaccatttctggttgatgtgctgccactattcctagcacttctcagccatggtcttcaaagttgtatttcactctattttcaaaacatttcttctgtactctcattttcttcctgttaattttcttcatgataacatctgaccccatttacttaagtaatccactgaggtctggtgtctactcaataattttgactaccctaggcagtttaatgatatcctaaggcttcctaatgtatgtcgtttcttgcctagacctgatatgggttaaatgctagtccctgaattattcaattcctgttagacggccttgattcaaatgacaaggaagaacatccagcttccgtgaatagttaaaaaaaaatttttttttccttaacccaagaaaatacacttgacggaggcagattactataacagcctaataattcagccaatagttttaccaaaaactattcagaatagaaaagtagctctagactaaatcgtggtgaatcagttgtctcaccatacagtaatgaaacaaacctgagaaaaaaggcttatttttttctaatgagttccgttaaatttatgcttatgttcaatttaa

SEQ ID NO: 13424 - DNA, 85850 bp, Human
  misc_feature (1)...(85850): n = A,T,C or G
ctctctgcaaaaaaatttaaaattagccaggcacagtggcacaagcctgtagttccagctacttgggaggctgaggcgggaggatcacttgagcccaggagtttgaggctgcagtgagctatgatcatgccactgaactccagcctggatgacagaagaaagagcctgggcacagtgactcaagcctgtaatcccagcactttggaagaccaaggcgggcagatcacttgaggtcaggagtttgagaccagcctggccaacatgctgaaaccctgtctctgtgaaaatacaaaaattacctgggcatggtggcaggtgccagtaatcccagctgcctgggaggctgaggtcagggaaaacctgggaggcagagcttgcagtgagctgagatcatgccactgcactccagcctgggtgacagaatgagaccctgtcaaaaaaaaaaaaaaaaaaaaaaaaaaaaagccgggcgcggtggctcacgcctgtaatcccagcactttgggaggctgaggcaggtggatcacctgaggtcaggagttcgagaccagcctgaccaacatggagaaaccctgtctctactaaaaatacaaaattagctgggcgtggtgatgcatgcccgtaatctcagctacttgggaagctgagacaggagaatcgcttgaacccaggaggcagaggttgtggtgagctgatcacaccactgcactctagcctgggcaacgagagtgaaactccgtctcaaaagaaaaaaaaagaagaaagaagcctggcgcggtggctcacgcctgtaatcccagcactttgggaggctgaggcgggcggatcatgagatcgggagatcgagaccacgatgaaaccctgtctctactaaaaatacaaaaaattagccagacgcggtggcggacgcctgtagtcccagctactcaggaggctgaggcaggagaatggcgtgaacccgggaagcggagcttgcagtgaactgagattgcgccaccgcactccagcctgggtgacagagtgagactccgtctcaaaaaaaaaaaaagaagaaagaaacaaagagagaaagaaaggaaagaaagaaaggaaggaaggaaggaaggaaggaaggaagaaaggaagggagggaaagagggagagaaaggaaggaaggaaaaaaataacttaaaaaatcagatttgttggacaaagatcagggcttaacctagggaggtgggtagagctaatggaatgcggaaaaggctgtgatttgaaatgaggggatttaggaagacctcatgagaaggtagcatttgagcaaagacatgtaggggtgagggagctagccatgaagttgcttaaggtggaggacacagcccgtgcaaaggccctggggcagggccgtatgttcctggcatgttggaggaagagcgaagaggcccgtgtggctggagcacagtgaagagggggagagagggagtggggagggcagggagggaactgggcaattcaagcagggttttgtgggccttggggaggacttgggcttgtccctggaggaaagtgggagccatagagagttgtgggcagaagaagggtgtgccctgactcagatgctcacaggcaacctctggtggtggctgcagggaggacagactgtggggtacgggggctggagtcagaagaccagctgagtgatgacggggctggaccagacagaggagggggtgagaagtgggtgaattctgggtatatttcagagtgtcactgccgccgtctgcatatggaggaagctcacccatctcatagtctagctggcctgactcccccagccccccaactccccatgcccaggcctgtgtcgagtgggcggaagaaagagatgtcagattctgcatggaaggcgtggggtggggctgggctgcaggtgctcccccagctcccccccgccccatggctcctcctcctccaccccctctcagggcgacagttacaggcaaagaagaggaagtggtagcactagctgtcgctccacaggcgagcagggcaggcgtgcgggcgggtgggtggtggaggctgcgagggtgcacggccggccctgggcaggcggtagccatggagctgtggcgccaatgcacccactggctcatccagtgccgggtgctgccgcccagccaccgcgtgacctgggatggggctcaggtgtgtgaactggcccaggccctccgggatggtgtccttctgtgtcagctgcttaacaacctgctaccccatgccatcaacctgcgtgaggtcaacctgcgcccccagatgtcccaggtgagccctccgcgggcaggtgtgctgagggttggagacgggggtcctccccggggctgacagtcgaggggctgacgtgctgctccacctctgggcctgcaaaggagagggaatatgcttacaggtccagggctggcccagggggtggtcacaatctgagattctggggtggcctccccaagcttaacaggctccctgtgtgggttcacgggccctgagttggcccgcatctgggctgagaactggcaaactaggggttaactctctcaagccccaggcgcctctactgtggttcatgcccccagatgggaccaaccagaggtctcgggggagctccccagaacccccagggtggccattgggttacctgaggctttggactcctttgacccccagagtctggatgtgggggaggagcctccgccaacatcttcccccacatgtgtctcctcctcccgggccctgggccccttccttccccttacatcttccttccccttggcttcctgcctgggcctggggcagcatggggcaggtggggggctgcagccccagggatctgagcttcctccctgcatccatctcagaggagatagtaaggcagggcccagtcctgggctcagagagtgggtcctgaggtcttggtgcttggaagagctgcattttctcggcagggatttctgcaggggcccaggctggaggggtggtggtggatttgactgtggctgtatgagactggctcaggaaatatattcaaatccctatttgaatgtggttgggtgggcgtgtgatgtggctgcattatgttgctgtagcatcatgtctggttccccagggctgctgggtgggaacgggggacggggcggggctggtggagtcccatctcctctgggatgaaaggagatacagccctatcctggggcctgggggacacagtcctgccctgaggtctgaggggacagctcccatctggtcctcaggctggccctgcagatgaagagctgggaggataagttaatggagatgggcccatgggggttcctggcgggtggttttcaggggcagggccattggtggaagagatccatgcgcctttactccttctgtttattttatttatttatttatttttttgagacggagtctcactctgtcacgcaggctggagtgcaatggcaccatctcggctcattgcaagctccgcctcccaggttcacgtcattctcctgcctcagcctcccgagtagctgggactacaggcgcccgccaccacgcctggctaattttttgtatttttagtagagacaggggtttcaccgtgttagccaggatggtctcgatctcccgacctcatgatccgcccacctcggcctcccaaagtgctgggattacaggtgtgagccaccgcgcccagcctttttttttttttttttttttttttaaagacagggtctcactctgtcgcccaggctggaggcagtggtgcgatctcagctcactgcaaccttagcctctcaggatcaagcaattctcctgcctcagcctcctgagtagctgggattacaggcgcccaccaccacacctggctaatttttgtatttttagtagagacagggtttcactatgttggccaggctagtcttgaactcctgacctcaaatgatccacccacctcggccttccaaagtgctggaattacaggtgtgagccactgtgcccggctgctccttctgtttttttttatcttatcttttattttttgagatggagtcttgctctgttgcccaggctggaatgcggtggtgcaatcttggctcactgcaccctccacttcctgggttcaagtggttctcctgtcccagcctcccaagtagctgcgactacaggcacacatcaccatgcctgcctaattttttttttttttttgtatttttagtagagatggggttttcccatgttgaccaagctggccttgaactcctgacctcaggtgatctgaccacctcggcctctcgaaaggctgggattacaggcatgagccaccatgcccggcccttctgtttctttagtgccaggggattacactgtcctcagctgggacagggcttcctgaaaggagaaggcactccccccaccaacctaagcatccatcctctggccacagcccatcccagctttgcctacatttgcttaatcttctggtttctagggcatgaggaagtagtcatgggatctgttaggccccatctgttagacctggcagggagtcaagctctctgtgatgcttcaatagcagctaatgggaaagtggatagacttaaggatgaacttccattcttgtgtatgtcttagctaaagctagtttttggatgaaggacgagggtgcatgatgctaatccctgggagagcagctgcactccaaatacagtcctaatcctctgtaacagggaacaacgggaacccagatggggtcaggctttatgcaagaggggacatttgtgctggggttttgaagagtaaataggagtttttctcattgttctggcttcctgtgcccagctgtatcaggctccaggctgggcatcggtgtacccagaccctttccctcttcgagggggcacattcctgcccctacccattttgttgccctttgaagcccggccgtgtgtctggtatgtagtggggacgtgtgagggaaggtaagaggtcttgacaagaagccagaggaagctgccacaggaacaacctctctgggtttctgggtgcctaactgtccacagattgaagcagagctgtgaatgccccatgggatgtgaaagggtagagggaaaaaggaaaggtgctcctgtggaggaaatggcataaataaaggtgtgcaggctggaatgagaattcttcccagtttctgtcatttctcttcggagtccttctcttttttctcagttgtttcttgggaagagggtggaaagaacatattcatccatccgttcatccacccatccactcattcatccactcatctatccctccaattatccatccatctacccatccatccatccatttatccatccatccatccatccatccatccatccatccatccatccatctgctcatccattcatccatctgctcatctatccacccatccatccatccatccatccatccatccatccactcctccatccatctgctcatccatttatccatccactcatctatccatccatccatccatccatctgctcatccattcatctatccactcatccatccatccatccatccatccatccatccatccatctgctcatccattcatccatccactcatctatccatccatccatccatccatccatccatctacccatccacgccacccatctatccatccatccatccatccatccatccatccatccatccacccacccatccacccacccatccatccatccattcatccattcatccatccactcatctatccatccatcctctcatccatccatccatccatccatccatccatccattcaaccacccactcattcacccactcatccgtccatccactcatccatccatccatccatccatccactcatttatccatctatcagtctatccatccatctacttttccatccatgtatccacccatccacccacccacccattcacctatccacccacccatctatccatggatccatccatccactaatctgtcttttttatttatttgtttatttatttacggcgtctcactctgtcacccaggctggagtgcaggggcatgatctcggctcactgcaacgtctgcttcctaggttcaagcaattctcctgcctcagcctcctgagtagctgggactacaggcacccgccaccacgcccggctaattttatatttttagtagagatggggtttcaccatattggccaggctggtcttgaactcctgaccttgtgatccactcgcctcagccttccaaagtgctgggattacaggtgtgagccatacgcccggcccatccattcatctatctatcatccacctgcccacccacccatccatccatctactcatccatccatccatccatccatccacccatcccatccatccatccactcatccacccgtctactcatctatccattcatctacccatccatccattcattcatccatccatttatctgtttaactatccatccatccatccatccatccatccatccatccatccatccatccatccagcaatgacaaggtctgccaggccctgttcttggtgctggggacagtgggaatagcacacacacacaaaaacccctgttgttgaggagcctgcattctagtgggggaggctgacagtgaagaaataagacaatgtataagtcatcaggaggtggtatgtactgctctggagaaaacaaagtggaacagggtatgaggggggcactttgacgaggagggctagtggtaaggtgacattgcagcagagacctggggaaaattaaggaatgaatcatgtggatctggggaaatggtgttccagacagtggttactgccagtgcaaaggccctgaggtaggagccagtcagtgcctgtatgttcagggcagtgactggcccagctggtgggaatggtgcaggaggtcaggttggatgaatctccaagcggctggtccccttgagatctgaggcccagggagagaatgataccatcatgagaagccacagctatactgagacacccaactctcaattatgaattttgttttttttaaatgagacagagccttgctgtctcccaggatggagtgcagtggcatggtcccaactcactgcagcctccacctcccaggttcaagcaattctcctgcagcagcctcctgagtatctgggattacaggcgcctgccaccacgcctggctaatttctgttgcccaggctggagtacagtggcatgatcttggctcactgcaacctcctcctcccgggttcaagcgattctcctgtctcagcctcctgagtagctggggctacagatgcgtgccaccatgcctggctaatttctgtatttttagtagagacagggtttcagcatgttggccaggctggtctcgaactcctgaccttaagtgacccacatgcctcggcctcccaaagtgttaggattgcaggcgttaagccaccacgcccagacaccactgtgctcttgaagtccaaaatctgggctgcggagatggaacttgaaggccaagagactggagaggaaagaacagatggttggaaagatccaccaggacatgggagctggttagacctaggatgtgggcagctgctggggccaagatgatgttaagttccccagccccagtgaatagtggggagagggtgggacagttagagtagggggtggactggggagtgggttgggtggtggctttggagagccacacctgggttcaaattctggtaccaccacttcctggtttcacctctctgagcttcagtttctccatctgtgaaacatagataaaaatggcaccttttaaggctgggcggtggctcacgcctgtggtcccagctacccgagaggctaagtggggaggatcacttaagcctgggctgcagtgagctgtgatggcaccactgcattccagcctgggcaacagagagagactttgtctcaaaaaacaaaacaaaacaaaacaaaacccaattttgcctgggtgtggtggctcgtgcctgtaatcccagcactttgggaggctgaggtgggagaattgcttgagttcaggaattcaaagcctggtaacatagtgagaccccgtctctacttttttttttttttccttaagagacagagttttgctctgtcagccaggctggagtgcagtggtatgatcacagctcactgcagcctcgaactcctgtactcaagcagtcctcctgcctcagcctcccgagtagctgggactacaggtgtgcaccggcaatacctggctaattttttattttttgtagagatggggtttagctatgatgcccaggctgataaatcactcctggcctcaagcaattcctcccgccttggctttccaaagtgctgggattacaggcatgagccactgcacccggccagaatagaggttcttnnnnnnnnnnnnnnnnnnnngtgtggtggctcgtgcctgtaatcccagcactttgggaggctgaggtgggagaattgcttgagttcaggaattcaaagcctggtaacatagtgagaccccgtctctacttttttttttttttctcttaagagacagagttttgctctgtcagccaggctggagtgcagtggtatgatcacagctcactgcagcctcgaactcctgtactcaagcagccctcctgcctcagcctcccgagtagctgggactacaggtgtgcaccggcatacctgggtgatttttttgtttgtctgtctgttttctgagacagggtctcaatctgtcacccaagctggagtatagtggtatgatcacagctcactgcagcctcgaactcctgtgctcaagcagtcctcctgcctcagcctcctgagtagctgggactacaggtgtgcaccagcaatacctggctaattttttattttttgtagagatggggttttgctatgatgcccaggctggtcttgaactcctggcctcaagcaattcctcccgccttggctttccaaagtgctgggattacaggcatgagccactgcacccggccagaatagaggttcttatctccatcctcccataacaggaaagatgacacatgccacccactgctctatgcttgctttcctcactaatcaccttggcagtctttccaagtcagtctgtagagattataattattctttataacatgactgcgtattccatttatttcaagaaagacttacattttgctcgccctgtgctagacattagtctaaaccagggaggggcctggctggatgcagtggttcaggcctgtaatcccagcactttgggaggccgaggcgggaggattgcttgggtacaggagttagaggccagcctgggcaacagagtgtgacctcgtctctataaaaatgaaaaataaaactaaaataaagctgggggctgggtgcggtggctcatgcctataatcctagcactttggcttacaggtgtgagccaccgtgcctggcccaattatagcttctaaaaaataataaaaggccgggcacggtgactcacacctgtaattccagcactttgggaggccgaggcgggcggatcacaaggtcaggagatcgagaccatcctggctaacacggtgaaaccccgtctctactaaaaatacaaaaaattagccgggcgtggttgcgggcgcctgtagtcccagctactcgggaggctgaagcaggagaatggcatgaacctgggaggcggagcttgcagtgagccgagatcaggccactgcactccagcctgggcgacagagcaagactctgtcttaaaataataataataataataataataataataataataataataataacctcatccatgaatcattttccagctcctctgctgtgtgatcttgggcacattagtaaacctctctgtttcctggtttctcatctgtaaaatgaggatgctaaatccctatttacagcatcattgtgggggataagtgtattattataaagaacctagaaaagtgtttagctgcatatgcagttgtgtgttgcttaataaaaggaatctgttctgagaaatgcgtagttagatgatttcacagttgtgtgaacatcagagtacatttacataaacctagagggtacagcatactgcacacctgggctatatggtataacctattgctcctagctacaaacccgtacagcatgggactgcactgaatacttaccattgcattaaaagattgccttctccttttctttcttttttcttttttttttttttttgggacggagtctcactctattcctcaggctggagtgcaatgacgtgatctcagctcactggaacctccacctcctgggttcaagagattctcctgcctcagcctcccgagtagctgggattacaggcacgtgccaccacatccggctaatttttttgtatttttagtagagacagggtttcaccatgttgaccaggctggtcttgaactcctgacctcagatgatctgcccgcctcagcctcccaaagtgctgggattacacgtgatagccaccatgcccaggcgatttcttatcatttataccatattttatacaaagatttcttatctttcttttgagacagagtctcactctgtcacccaggctggagtgcattggcacgatctctgctcactgcaacctccacttcttgggttcaagtgatcctcctgcctcagcctcctgagcagctgggactacagatgcacaccaccaagcccaccattttttaaagtagagatgggggtctcaccatgttgcccaggctggtctcaaactcctggcctcaagagaccctcccacctcggcctcccaaagtgctgggatgataatcgtgaatcatcgtgctccacccagtcctcgtgtttttatttttcaaattttaagacgttttattttgtcaaccgaagtgctagccaatctttgtgtttttgatagatattgccaaattgttatccgtctgggattgtttccatatgaattatttcaattataccaccacatgccagaggactggcttctctgccgcctccccgacagacggttctgttgccaagattctggagttttgccagctggatgggaaatcagtggagctcattaaggctcagtttacattttctcttattctgagtgaagctgagcctctttccttatgtttaagagctatttatattttcttcctgtgatacaatctctgttcatatcacttgcttactattgttgcactttctagaactactgaccttttctcttactgattttttttttttttttgaggctgagtctttctctgttgtacaggctgcagtgtagtggcgcaatctcagctcactgcaacctccgcctcccaggttcaagtgattctcgtgcctcagcctcacaagtagctgagattacaggtgtgcgccaagatgcccagctaatttttgtatttttagtagagacagggtttcgccatgttggcctggccggtctcaaactcctgacctcgagtgatccacccgtcttggcctcccaaagtgctgggattacaggcatctcttactgatttttaggagctctttatatataggttgacttaaattgcaagtcaggtatttgctagctttgtggtcttggagaaaaaaataattacttaacctattggatccctgattgtcttatctataaaacaggaaatctataaaatgagaatgttggccgtgcacatggctcactcttgtaatcccagcacttcgggaggctgaggtgggggatcacctgaggtcaggagttcaagaccagcctgtccaacatggcgaaagcccaactctactacaaatacaataattagccgggtgtgctggtgggcacctgtaatcccagctactcaggagactgaggcagaagaatcccttgaacccaggaggcggaggttgtagtgagccaagattgcaccactgcactccagcctaggcaacagagtgagactccatctaaaataaataaataaataaataaataaaaataaaaataaaataaaataaaatggaaatgttgacagtacctttatttcagagttgtgtaaggattaaacatgataaggtaaatgaaattcccagcatggcaattaacatatagtgagtgctaaatgaacgagagtcattatttttgttaatttaattccattgagtcccagctgcctgtaggcaatggtatataagtcagggtacgtatgttaactgctgtaacaaattgcatcattttgccaggcacaatggctcacgcctataatcccaacactttgggaagccaaggcaaggctaatcgcttgaggccaggagtttgagactagcttgggcaacatacaagatccccatctctacaaaatatatatatatattagcagagcatggtggtgtgtgcctatggtcccggctacctaggacgctgaggcaggaggatcacttgagcccaggaattggaggctgcagtgagctatagatcgcgccgctgcagtccagcccgggtgacagagtgagatcctgtctcggaagaaaaaaaaaaaaggccaggtgcagtggctcacgcctgtaatcccagcaccttgggaggccaaggcaggtggatcatgaggtcaggagtttgaaaccagcctgaccaatatggggaaatccggtttctactaaaaatacataaattagccaggcgtggtggtgtatgcctgtagtcccagctactcaggaggctgaggcaggagaatggcttgaacctgggaggtggaggctacagtgagctgagatcatgccactgcactccagcctggtgacagagcgagactccgtctcaaaaaaaacaaaaacaaaaacaaacaaaaccaaaccctcaaaacacaaaaccaaattacatgacttcagtgatagtgagactttacttcttattgatgtcacaattcagtttgggtcaatgtcaggggttgggggaggagggctctatgttatagagtctctctagggccgaggctccatcatctcatggtcttagcttcccgaaggcccttggagtcttttctactggggaaagagcgctatgaaagaatttcccaggccaggcctggaagtggcgccatcacctccatcctttttttttttttttttttttgagacggagttttgcccttttcctccaggctggagtgcaatggcgcgatctctgttcagtgcatcacggcaacctccgcctcccaggttcaagtgattctcctgcctcagcctcccaagtagctgggattacaggcatgcaccatcacacctggctaattttgtaggggtttctccatgttagtcagggtggtctcgaactcctgacctcgggtgatccactcgcctcggcctcccaaagtgctgggattacaggcgtgagccaccatgccctgcctccattcttgttattggccagaacttggtcacatggctccatttaactacgagggagactaggaatgtggttaaactggagctggggataaaaaggagataggttggttggacgcaaagaagtcactgccgtagaacctcagggtaatgcctcactggctccagaaatgcaggtatggagcgggtttcaggaatgcaggtctagggccaggcatggtggctcatgcctgtaatctcagcactttgagaggccgagacaggaggattgcttgaggctaggaattcgagaccagcctgggcaacataccaaggtcccgtctctacaaaaaataaaaaaataagcccggcatggtggtgcacgcctatagtctcagctactcaggaagttgaggcaggaggatcgcttgagcccaggagtttgatgctgcagtgagctatgattgtgctaccactgtactccagactggacaaaagagtaagaccctgtctctaaatatatctatgcaggtctgtggaaatctcaatgggatgtagaataagaaggacctgagccaaggccatgggggaggaattcagctggggatgagggagctgggtgatagcaacttcagcaaaatgggttgggctgattggaaaacctcctcttaccttgcctgctagggccaacaggaggggcatctaggagggtcagcacttggcaccatccctttccattccattctgttccttttttttttttttttttgagacagagtttcactctctctcccaggctggagtgcagtggcacaatcttggctcacggcagcctccgcctcccgggttcaagcgattctcctgcctcagcctcctgagtagctgggattacaggcaagtgccaccacacctagctgatttttgtatttttagtagagacggggtttcaccatgttggccaagctggtctccaactcctggcctcaagtgatctacccgcctcggcctcccaaagtgctgggattacagacgtgagccaccatgcccagcctccattctattctattcactgacctcctctcttggtccagtgctgggaaatgtcacctttcaggactttcacagagatgctagaaatctctgtcccttccctactcacagcccttccctggttccccactgcccttggtgaaaaagacaaaatcctcactgtagcccacaagggcttatgcatttggcctctgtccatctctcagcccttccctgctccctctctacccattgctctctgcaccgcagccaaatcggccacccagcacaatccagcctcagggcctttgcactggctcttccttcttcagggatttctcttccctcaggtatacacggtgagtgttctcttatctccttcaggtttctctttctctctctctctgtcttttttcggagaagggggtcttgctctattgcccaggctggagtgcagtggtgttatcatagctcactgcagcctccaacttctgggctcaagtgatcctctcgcctctgcctcccaaagtgctcggatacagacatgagccacttcacctttttcttttttctttgttttaacggggtctctgtctattgtccaggctggagtgcagtgacatgatctcagctcactgcaacctctgcctcttggattcaagtgattctcctgcctcagcctccccaagtagctgggattacaggcatgtgccaccatgcctggctaatttctgtatttttagtagagacggagtttcaccatgttggccaggctggtctcaaactcctgacttcaggtgatctgcccgcctcagcctttcaaagtgctgggattactgatgtgagccactgcacatggtcagtggccaggtttctttctttctttctttcttttttttttttttttgagatagagtcttgctctatcgcccaggctggagtgcagtggcacgatctcagctcaccgcaacctctgcctcctgggcccaaatgattctcctgcctcagccttccgagtagccaggattatagggacgcaccaccacacccagctaatttttgtatttttagtagagatggggtttcaccatgttggccagctggtcttgaactcatgacttcaagtgatccgcccgtctcggcctcccaaagtgctgggattacaggtaatgagccaccgcgcccagcccagatttcttatctgagagatcttccactgtttctagatataaaatcatagatttcgccctcccaacttcccattctctttcatgttttatttttctccatagcacttagtgctctctgacctgtcatagtttttacttatttgcttattacctgttttccacactcaaatgtcaaggcaaggatttttgtctattttacgtcccccagtgctttagaacaccacctggcacatagtacggaatcaattaatttattcatttatcatatgaatatatgattctaattgcttcattcattcgcttaacacaggggctggcaaatgataactcatgggcccaagctgcctcgtgttttaaaaattatcttagcttgtatctgtagtcccagctacccgggaggctgagatgggaggatcgcttgagcccaggagtttgaggctgcagtgaactatgatcctgccactgcactccagcctgggcaacacagcaagcccgtccctgtaaaataaattaatttaaaaaattaaaaatgaaaattatggctgggtgcagtggctcacgcctgtaatcttaagacattgggaggctgaggcaggaggatcacttgagcccaaaagtttgagatcagcctgggcatcctggcaaaaccccatctctataaaaaatataaaaattacctgggtgtgatggtgtgcgcctatagtcccagctactcaagaggctgaggtggaaggatcacttcagcctgggagatggaggttgcagtgaaccacgattgcaccactgcactctagcctgagcaacagagacagggtctcaaaacaaaatgaaacaaaacaaaataaaaattattttatttatttacttttcttggtattgatttgacgtttactatttttatattttattattattatttttggtattccgcatattcagaaaaacttctctagtaacaatctatataaaaatgatccctgaaagtagagtcttactgccttattttgaaaataaaatttaaccaatacacggtcaggcccatttgttgacacgctgtctatttttttttttttttgagatggagtcttgctctgtcatccaggctggagtgcagtggccttcaggtctggctggatccaggggctcaggcaatatctcaggacacctcctccccacccttggtctttccatctctctctctctattttttgtttgtttgcttttttgtgttttgagacagggtctcactctgtcaccaaggctggagtgcagtggtgcgatcttggctcactgcaacctccatctcttggcctccagtgatcttcccacctcagcctcctgagtagttgggactacaggtgcacaccacaatgccaggctaatttttgtatttttagtagagatggggtttcaccaagttggcaaggctggtcttgaactcctgacctcaagcaatcttccccgccttggcctccaaaaatgctgggattgcaggcgtgagtcaccgcacccagccctccatctcttaactctgctttcttgtgggtgttttcctccatcctcaatcattcttttccctcatggaggcagatgagggtgaccaactactccagatttatttatttatttatttatttatttatttatttatttaaagtctaagttttgctctgtcacacaggctggagtgcaatggcatagtcatagctccctgcagcctcaaacttctgggctcaggagattctcctacctcagcttcccaagtagttgggactaataggtgtgcgtcaccatgcccaactgtttttttaatgttttaaaaacattaaaacacagccagacatggtggctcacacctgtaatcccagcactttgggaggccgaggcaggtggatcacgaggtcaggagatcgagaccatcctggctaacacggtgaaaccccgtctctactaaaaaatacaaaaaattagccgggtgtggtgacgggcacctgtagtcccagctacttgggaggctgaggcaggagaatggcgtgaacctgggaggtggagctggcagtgagccgagatcccgccactgcactccagcctgggtgacagagcaagactccgtctcaaaaacaaacaaacaaacaaaaaaacattaaaacattcaatggagatggacctcactgtgttgctcaggctgatatggaacttctggcctcaaatgatccttctgcctcagcctcccaaagctcttagattacaggaatgagccaccacatccagcctgctctaaatttatattctcatcactctgagttcgatggaaaataggggggttggctttctggtcactgaagccaaggtcctagcattatccttcgttgaacatgattctttttattttattattattattattattattattattattattttgagactgagtcttgctctgttgcccaggctggagtgcagtggcacaatctcggctcagtgcaacctccacctcctgggttcaagtaattcttgtgcctcagcctccctagtagctgggattacagacaggtaggtgccaccacacctggctaatttttgtatttttagtagagacggggtttcaccagattggccaggctggtcttgaatgacctcacgtgatctgcccacctcggcctccccaagtgctgggattacaggtgtgagccactgcacctggctgtttgaacatgattctttttttgtggaggtgggaggtggctggtcacatgtctatttctgaaccggctgctgtggccaggagaataccatgctctgatgggccaggccagggtcatgtgcctattccttgagttgaggttggggtggcttccacagaggaaactgaggaactgttacctcagaagggtaaataagatgtcaggaggcaatcagtgtttatatgggcagtgacttctaaatttaagccagaatttctgattctcagtcctgttgacatgtggggccggatcattttctgtcctgggagctgccctgtgtattctaaaatgcttagcagtatgcttggactctatccatttcacacaagtagcacctctcctcagtatctccagacattgccaaatgtcccctgggaggcagaatcgccctgggggcgggcaaaccagttttggagggagtgagcttgctgtcttggggaaaatccaaagagatctgatgattactggctgagaacagcaaagaagagattgagggcttctttgaattagaatatttattttaatttctttctttctctctcctttcttcttttttttttttgacagagtctcactctgtcgcccaggctggagtgcagtggcgcgatctcgtctcactgcaagctccacctcccaggttcacgccattctcctgcctcagcctcccgagtagctgggactataggtgcccaccaccatgcccagctaattttttatattttcgtagagatggggtttcaccgtgttagccaggatggtctcaatttcctgacttcatgatccacctgccttggcctcccaaagtgctgggatttcaggcatgagccaccgcacccggctctttcctttcttttctgttctgctttcttttcttttctttccctccttccttccttccttcctttctgatggagtctctctctgtcactcagactggactacagtggtgtgatcttggctcactgcaacctccgcatcatgggttcgagtgattctcctgccttggcctccagagtggctgggtttataggcatgtgccaccatatccggctaatttttgtattttttagtagagaaggggttttgccatcttggccaggctggtctggaactcctgacctcaagtgacctgcctgcctcggcctcccaaagtgctggattacaggcatgagccactgcacccggccttattttttatttaatgatggggagaggccagacgtggtggctcatgcctgtaatctcagcaccttgggatgctgaggcgggtggatctccaacatggtgaaaccccatctctactaaaaatacaaaaaaattagccggccatggtggcaggcgcctgtaatcccagctactcgagaggctgaggcagaagaatcacttaagcccaggaggtggaggttgcagtgagctgagatcgtgcaagtgcactccagcctgggtgagagagtgagactctgtctcaaaaataaaataaaataaaataaatgctggggagaggaagaggggaggaagactcatttgatgttattttatcatcagtgataagggctacactgattgctggggttacagcacaggacataatggacacagttaatacttttctgagttcatgccctcttgagggagggggtggtgtttttgttccttgtggcttttgtaacaaagaaccacggatcggatgtcttagaacaaaggacatttattctctcataatcctagaggccagaggtctgaactcaaggtgtctgcagagctgtgctccctctgggggctccaaaggagaatctttctctgcctattcctgcttctgggggctccagatgatccaggacaggcgagcccctagattggggcttagccctggagggttcttggcttcacccaggaaagaattcaagggcaagctggtggtgttagcaagttttattgaagcaaccatgcagagcagcagcagaggtactgttccttgcagagcagggctaccccattggcagtgagcccagagtagcagctcagaggcagtgctgcaggcatatttatcccgttttaattatatgcaaatcaaggggtggattatgcagagatttctagaaataaagtggtaacttctgagttgtcaggtctttgccatggaagggggcatcagcttctgggtgttgccatggcaatggtaaactgacatagcactggtggccatgttttatggagaggcacttttgcctcttccctgtttcagctagtcctcaatctggtccagtgtctgagccccacctccagagtcgagtcctgcctcctatttcacatgcatccttggattgtgactccatctttacatggttttctcctatgtctgtctgtgtgtctcttacaaggacacttgttattggatttagggcccacctggatgatcccagatggcctgggtgggtcttaaatatctcctcatcttgaagtccttgagatacctcctcatcttgaagtccttgagttatctcctcatcttgaggtccttgagatatctcctcatctcgaggtcctcaagctatctcttcatcttgaggtccttgagatacctcctcatcttaaggtccttgagttatttcctcatctcgaggtccttgagataactcctcattttgaggtccttgagatacttcctcatcttgaggtccttgagctagctcctcatctcgaggtccttgagctatctcatctcaaggtccttgagctagctccttatcctggggtccttgagctacctcctcatctcaaggtccttgagatatctcctcattttgaggtccttgagctatgtcctcatctcaaggtccctgagacatcgccccatctcaagatccttaccttacatcttacaaagtcgttttctccaaaaaatgttcacaggtcaccttcacagcttccagggatttgacctggatacatctttagagggggccagacccattccagacagtaaacaaatagacaaaacgctggcacattgtaataaatgtcacagatgaaacaaacccagggatcaaggggaagaagaagaggagggcatgctttctggagggtggtcaaggaaagctgagagctgcaggaggaggagccagctctgggaagcatgaggcagagagggcaaagactgtgcaaatgccctaaggtgagaagaatcagaatgaaggagcttctggaaggaagggagtgagtggagggagagtggtaaagaatgaggtttgggaggaaggtacttacctagaatggctatgggggatgtgtgtggaacttaagggggggatgggaaatccttggagcatttaagcagatcaattgtttaaagaggtccctgaccaggtgtggtggctcatgcctgcaatcccagtgttttgggaggttgaggcaggaagatcacttgaggccaagggtttgaaaccatcctgggcaacatagtgagatcccacctctacaaaaaacaaaaaaagaagagagatctggaaaaagaaggttgatgaaggcatccccatgagaagtgatggtggcctcgactgggagtcgggagtcatggatccagctcacattttcgttgaggaggaagggtggaggtggatgaaaagaggaggcaggtctcatattccaggaaggcaagaattaaaaaaaaaaaggaatgaaatgaaatgaaaagaggaggcagggtggtgtctaggtttacagcttagggacttgcgtgaattagggtatcttctactgtagtaggaagactaggggaggaacaggtcttggggagtttgatcaagcaagggaaggaaggcagtacagcataatggctagcacatggttcttttttctgttttgttttgttttgtttgtttttgtagagacagggtctcactatgttgcccaggctgctcttgacatcctgggctcaggtgatcctcccatcccagcctcagtgctgggattacagggcatgagctaccatgcatgtccggtgcatggttcttaactaaggggtggtgtggggcagcagtgggggcgaggggagtgactctgtcctcccaggggacatttggcaatgcctggagacagtttcagttatcactactggagggcttggtgtgttattgatatctattggatagaggccagagatgcttctgagtgtcttccaatgcccaggacaggcccctctcccaccaaatgtcaacagcgctgagaccgagggactcagtgctaggcacatggactccagttgtgtggggggtccaggttccagtcacagctgtgggatcttgggcaagttatcaaatgcttcaagaaaggaccatatatatggccgggcgcggtggctcacacctgtaatcccagcactttgggaggccgaggcaggtggatcacaaggtcaggagatcaagaccatcctggctaacacggtgaaacctcatctctactaaaaatacaaaaaattagccaggcatggtggcgggtgcctgtagtcccagctactccggaggctgaggcaggagaatggtgcgaacctgggaggcggagcttgcagtgagccgagatcgcgccactgcactccagcctgggtgacagagcgagactccatctcaaaaagaaagaaagaaagaaagaaaggaccatatatcaaaaatgaccccaaaagcagagggagccaagacaccaaagaatgcagcagacaaatcctgtttgttggtaaagggtgatttgttgggggagcttatggagagaagaaacatggtcttgggcggcggcaagacaggtacctctctgcaccattacctcacagacccagtgcttatatagtacaggaaaatgtgcaggacccagtgcttatatagtacaggaaaaggcagtcctccagaacaggcaaaaacaccgtgcacatcacagcctataatttgtatgataacatcaagtttgctttgatatgttcttacactagggacagcaaataatgtagaactcaggagacattcccgggagtggggttaatcagaagtcaacatggcaattagcatccaagatggggccactttgtcttcacacagaacctctctgtgactcagtttccctatctttcaaatggagataaaactagtccctaccttataggattgttgtaagaattaaaaatgaggtaataattgtaaagtcgtaaagtgcttcaagcagtatccattaaatgattgataaataaatcattggtaaatgatttaccagtgatactgataaatgacttctttatcatttatgaaaaattgataaatgatttatttaccaataaaccaacggtaaatgatttatttaccaataaaccaacggtaaatgatttatttaccaataaaccaacggtaaatgatttatttaccaataaatcaacggtaaatgatttatttaccaagggtaaatgtcactcattgataaatgacttattggtaataaatcaattattagtttattggtttattggtaataaatcatttatcaatgagtgaaatcatttgggacaaagaagagagagggaaaagaggtggtctgagggttgggccttaggttgtaacagcatagaaacattggggagaggagaatacagtgactgaagaggaaaaccaggccaggcgtggtggcccatgcctgtaatttcagcattctgggaggctgaggcaggaggattgcttgagcccaggagtttgaggctgcagtgagctatgattgcatcactgcgctcaggcctgggcgacacaatgagattctgtctcaaaacaaaacaaaaaaacaaagaggataaccagatgggtgtggtgtcaagagaccaatgccgttgagaggagtagattcagaaagtgtcatgaatagcaacaaaagcaataggtcactttaatgagcacccactatgttcaggtgttgttctaggtactttatacttattaacacttttgaattttcacaacaaatccatggtgttggcaccatcatatatttaggttattagttattgctgtgaaacaaaccactccaaactgagtgatgtaagaaaaacatgatttttgattctcacagattctatgactcaggaattcagacagggcatagtgatgatggtgcctcagctccatggtgagaaactttgactttctgggaactagaatgctctggaggattcttcgtcacatgatgggtgtctgggctgggatgacttgaggctatgctcagttggggctattgactggagcacttacgtgtggtatctccaagtggcttgggcttccccacaacatggcgaccgggtttcaagaaacccggagagagagcaagtattcctcaaaaagatcaagccagaagctgcaaggcgtcttctaacctacttggaaatcacgcagtgtcacttacagcagttttcgtaacaagaagccataccctggcttctctcttcctaccctaggcaccagcagggacctccaattggctgaacctatctaggagcagggtgcaaaggagcctgggaaatgtagttgtcttcctggcagcgcaaaacaaaggaaggggatgagtcattaaccaatcaggttaatgacctacatgaaccttgagcaaatgaccctccttctctgaactctgtgtatcgctcgcgaaataggagccctacttcattgcaggatcgttttgaagaccagaggagacagttgtaatgcacacgaattgcttcacccagggcgtagttcttttatttatttatttatttatttattgaattaattttatttataactctaatgggtaagcagcctggttctcaattgatgggagctgtcaatattgctattggtctgagaactgatgatacgtaacggtttactatgtcctggcacagggtggcacgtcttagctctactggtcctgctggttttggggtttagtccactctttttgcttgtttgtttgtttgtttgttttttgagatggagtctcactctgtcgcccaggctggagtgcagtggtgcgatctcagctcactgcaacctccgcctcctgggttcaagtgattctcctgtctcagcctcccgagcagctgggactacaggcgcgtgccaccgcgcccagctaatttttgttatttttagtagagacagggtttcaccatattggccaggctggtctcaaactcctgacctcgtgatccgcccgtctcagcctcccaaagtgctgggattccaggggtgagccaccgcacccggctagtccactctgagatcaagcctagatatcctttcttgtgaccgtctctgccatgagctaccaggacatgacgaatctgccttccttcttgctgcctgttagagatataccctggtgatctaatcacctcttaaaggtcccgcttctcaacaccattgcattggggattatacgttcccaacatgtgcacattcaaaccatagcagcgtttaagcactccaaggatatgggtctactgccttcagcctgacttgctattgagtgtgtactcgagagagaggtgggagaaatacttcaaaggcttcaaaatcatttatttgtccttctttatagggaccccgggagatatggcagaatatggggtgcttggggtgacagccacttgctgcattttgattacatggccacggtttgggcatatcggcacctgagaccacccttggttcactcccttcctccctccccctcgcttactctgctccaggcacacagatctcctggctccaacatgccagggcctcagggcctttgcactggctgttccctctgcctgaaatgcttttttctcagagcctttgcactaacctcagggcttcttgtactaacctcactggctattccctctgcctgaaatgcttttcctccagacacccacctggattgtcccctcacctccttcaaacctttactgaaatgccactctctcaatgaggcttcctggacttccctatttaaaattgcaccccctcctgacattctccattccttttcctacttatttttttctcgcttaacacttaccaccttcagacaagctatgtaatatactcctacaataccttcattgtcttcctttgccagaatatcagccccttgagggcagagatgcttatctctttggttcatagctgtatctccagcacctagaccagtactgggtgtatagtaggtgctcaataaatatttgcatatttggccaggcacgttggctcacatctgtaattccagcactttgggaggccgagacgggtggatcacttgaggtcaggagaccagcccagccaacgtgacaaaaccctgtctccactaaaaatacaaaaattagccaggcatggtggcaggtgcctataatcccagctgctcaggaggctgaggcaggagaatcacttgaactcaagaggcggagattgctgtgagccgagattgcagcactgcactccagactgggtgacagagtgagactcagtatcaaaaaaaaaaaaaaaaaattgcatagtgaatgaaggagtgtctgaatgatcaaagccctctcacctgctactccctttgcttggagcctttttacccccttcacactctaaagtaagaatagtttgaattacaaagaatacaaatttatctctcattcactatgttttatcaagagtaggagcaaaatggccgggcacagtggctcatgcctgtaatcccagcattttgggaggccaaggcgggcggatcatctgaggttgggagttcgagactcagcctcaccaatatagtaaaacccagtctctactaaaactgcaaaattagctgggcgtggtgacgcatgcctgtaatcccagctactcaggaggctgaggcaggagaattgtttgaaccccgggggcagaggttgttgtgagccgagatcgtgccattgcactccagcctgggcaacaagagtgaaagatcgcgccattgcactccagcctgggcaacaagagtgaaactccgtctaaaaaaaaaaaaaaaaaaagagtaggagcaaaaatatgactaagactgtattttgcattattgaccaatgatggtttacattatttccttattttccaccccatcctcccccacccactccctaagctgatagtcatcctatgcacctagttttaggggaaagacacagcagggcagccagtatcctgctgacttaaaaaaaaaaaaaccagctatattgacatacagtaaattacatatttaaaatacattggtgggggcgcggtggctcacgctgtaatcccagcactttgggaggccgaggtgggcgaatcacttgaggccaggagttcaagaccagcctagccaacatggtgagaccctgtctgtactaaaaatacagaaattagccaggcatggtggcacgcacctataatcccagctactcaggaggtggaggcaggagaatcgcttgaacctgggaggcggaggttgcagtgagcggagatcgcatcattgcactccagcctgggcaacagagtgagactctgtctcaaaaaaaaatatatgatttggtaaacaattttttctttaatttctagatttgttttcagaaacggtcttggcagggcatggtgcctgaagcctgtaatctcgcccctttgggaagctggtgtgggaggattgcttgagtttaggagatcgagatcagcctgggcaacatggtgagaccagcctcatctctaataaataataaataaataaatataataaaataattagctggtcatagtggcatgtgcctgtagtcccagctacttgggaggctgagatgggaggatcatttgaacccaggaagtcgaggctgcagtgagccaggattgcaccactgcactccagtctgggtgacagagtgagaccctgtttctccccttcccccccccacccaaaagaagggggaaaaaagaaagattcagggtctccctatgttgcccagactggccttgaactcctggactcaagcgatcctcctaccctagcctcctgagtagctgggattacaggtgtgtgccactgaacctggcctgatttgataaattttgacatatgtgtgcaactatgaacccagccttgaaatcaatggatcatatccattgcccctcaaagtttcctccatcccacccctccctgcctccccctcctcccacctctcattccctcgtacctcctgatttgctgttagtcactgtcgattagtttgtatttcctggagttttatgtaagtggaatggtaccatctgtggtcttctgtgactggctgctttccctgagcatgatgtcctggttcatccatgttgttgtatgtatcagtgtaccattctgttgtacggatgcaccccagtttgtttatccattcatcccttgatggaggtttttttgtttgtttcgctttgtttttttgagatggagtctcgctctgtcgcccaggctggagtgcagtggcgcaatctcggctcactgcaacctccgcctcccaggttcaagcgattcttctgcctcagcctctcgaacagctgggactacaggtgtgcgccaccacgcctggctaatttttttgtatttttagtaaagacagggtttcaccatgttgaccaggctggtctcaaactcctgacctcataatctgcccacctcggcctcccaaagtgctgggattacaggcgtgagccaccatgcccggcctatactttaagttctgggatacatgtgcagaacgtgcaggtttgttacataggtatacacgtgccatggtggtttgctgcatccatcaacccatcatctacattaggtatttctccgaatgctatccctctcctaacccccagcccccgacaggccccagtgtgtgatgttccccttggttgaggtttgaattactgacggcacttttggctatcatgaatcaagttgctagctggatatggtggcacatgcctgtagtcctaactctttggaaggctgaggcaggaggattgcttgagcccaggaatttgagactgcagtgagctgtgattgggccaggctgcactccagcctgggtgacagactgagactgtctcaaaaaaaaaaaaaaaaaaaaaaggaaagaaaagaaaacagaatcaagctgctatgaacattctgtacaagtctttgtatggacatgtgctttcatttctcttgagtaaatgcctggtaatggaatatatcgtatgataggtgcatgcttaatgttttaagaaaacttaccaggccagtcacggcggctcatgcctgtcattccagcactttggggaactgaggcgggaggattgctggagcctaggagtttgagaccaacctgaccgacatagtgaggctctgtttcttaatttttttttttaataagaagaaaatgtaccaacttttcttcctttgtgctggaattgcaaggtaaaaaaataatagtaataacaaggaaaacgtaccaacttttccaaagtggatctgccatgtgatgttcctgccagctgctcagcatgcttctcttctttgcttcactatctgtctcatttttttttttttgagatggggtcttgctctgttgcccaggctggagtgcagtggcatgatctcggctcactgcaacctctgcctcctgggttcaagcgattctccttcctctgctttccaagtagctgggactacaggcgtgttccaccacacccagctaattttgtatttttagcagagacaggtttcactatatgttggccaggcgcgtctcaaactcctgacctcaagtgatcaacccacctcagcgtcccaaagtgctgggattacaggcatgagccaccacacccagcttcttttttttgttttgttttgttttttgtttttttgagacatcctcggtctgttgcccaggctgtgcagtggcatgatctcggctcactgccacctccgcctcctgggttcaagcgattctcctgcctcagcctccagagtagctgggattacaggcgactgtcaccacgcctggcaaatttttgtgtgtgtgtgtgtgtgtgcagtcggggtttcaccatgttgcccaggctggtcttgaaccccgacctcaagtgatccgcccgcctcagcctcccaaagtgctgggattacaggcgtgagccaccgcacccagccgctcaccatctctttgtcgcctgcatggcaccattctctcctgtaccaccccaaagccttaccaggtgcctcctgcatttaaccaggtcccatagctctctgtgcttcccggcacaccctctcaccaccctcatcatcaattattcaccttgctgactgcttagtgtttgtctcctggctggattacataagccctgtaagggcagagctctgtttgtcttgatcaccattaggttctggtgcttggcatacagtaggcattccacacatgcttgctgaattaatgcatgaccgggtctggggtgctgggtttcacaccaggctctaccgcaaacattgggtcaagtattttcattcccgacgtacagatgagtcaattgaatcaacggaaagcaaaatgatcccatccaagctccctcaacttgccgggctggtctgggagtcgaaccagatctgcctgaccctcccaccggtgctgaaaagtggagtgtgtgctggggtggtaggggatggggcagaagagagacgggcttcctcacagaaaggtttgagggctaggatgaggcgtgcacactctgcacccctgcttcggagctttgaaagggtgcacagcacacccgccctctctgggaaccctcgggagcttgaggttgcctgatgaaggggctgatgggttgaacgcaaagggcccctccacccacccttttttctatctccccaaccaagccctggtaacaggcatttccggtttccggccggctccctggtgctggggtgggggtggggagttgattgctgccgtcgtgcttggctctgggtccccttctcccagaccccagaggcctctgtccctgcacactgcttccccgaaggagcgtggaaagccagccgacctttctggctctttcttcatcttgggcaggggttttgttgatgggaggctggctggcaaatggggaagaatgaacctcagggttcaccgcagtgcgcctgggtgctgatttgcatatgggcacgatgccagcacagtgggtgcccgcctcttcctggaggaaggaagaggggcactgaggggggttgcccccagcagggaggaaccgtcctcatatggctctcctacgtttgtttaaaggaccatcattatcagcaaactatcgcaaggacaaaaaaccaaacaccgcatgttctcacttataggtgggaattgaacaatgagaacacatgggcacaggaaggggaacatcacacacaggggactgttgtggggtcggggaaggggggagggataacattaggagatatacctaatgctaaatgaggagttaatgggtgcagcacaccaacatgacacatgtatacatatgtaacaaacctgcacgttgtgcacatgtaccctaaaatttaaagtataataataataaaattaaaaaaaataaaggacctcctgtcctttgccactttctcacactcttcaggcgaccaggaagtcctttctggtggtctaactgcagtcactgctgctgtctgatggagcccctttctttagctggccccaccgcagcccggagaggggatgaatcatgccccctttcccctctttgaggcatcacatgactggaaggaagctgtctccgggttcagccgatctccctgaggtcaggagggaacttcctcccttgagccacagacacagccatctgctctattgtctctggtgatctgcctgcccatgagcgccctcattatgccactctctaagaggcaccaggagcagcttagtgtggttcaaagaggcagtgttgtacagaggttagaggcacagactttgggatccagtgctggtatctggttctccattcctatctgtgtggtccgggatgggcagtatcccctctctgagcctcagttgtttcctctgtcaaagggagatttattcattcgacagattttattgagcatctactatgtgtcagacatggtactaggtattgaggtcctctatttacccaaaggagttgaacatttatgtccacacaaaaacttacactcaagtctttgtagcggctttattcatgattgctgaaactgggaggcaacaaattgtccttcggtagatgaatgcgatgtagggcaaggcaagccctaaattggggctcagcctgggacggttctttgttttgcccaggaaagaattccagggcgagctggaggtgttagacagtagcttttactgaagtgaaagtgcatagcggcagttgcagaagtcctgctcctcgcagagcagggctaccccacaggctgtgagcccggagtaatcagggttgcagtcatctttgtacccactttaattatatgcaaattaaagggcagattatgcaaatttctaggaaaagggtggtaacttctgggttgtcgggtcattgccttgggaaaggagtagtagctgctggtgttaccatcacaatggcaaactgccatggcacactggtgggcatgtcttatggaaaggtgcttctgctccagccctgttttagctagtcctcaatttggtccgttgtctgagccccacctccagagtcaagttccacctacttcctcgtatggataaataagctgtggtgcatccagacaatggaatattattattattattagagatggacttttgcccttgttgtccaggctagagtgcaatggtgtggtctcggctcactgcaacctctgcttcccaggtccaagctgttctcctgcctcagcctcctgagtagctgggtttactggcacctgccaccacacctggctaatttttgtatttttagtagagatgggatttcaccatgttggccaggctggcctcaaactcctgacctcaggtgatccagccacgtcggcctcccaaagtgctgagattacaggtgtgagccactgctcccagcgcagacaatggaatattattcagcactgaagagagatgagatgagctctcaagccatgaagagacacgcaggaaccccaaatgcatattactaagtgaaagaagccagtcccaaaaggctacatactatatgataccagctatgtgatgtttcagaaaaggcaaaactgtagaagcagtaaaaagatcagtagttgtcagaggttagtggaaagggggtatggataggcagagcatggaagctttccacggcagtgaaaatactctctatgacactataatagtggatacccatcatcatacatgtgtccaaatccagagaatgtgacgcacggcaggcaagccccaaagtggggcttagcctgtgaggcttcttggtttcacccaagaagcctcacaggctaaggaaagaattcaagggtgattccagtggtagggtagacgaaaacagctttattgccgtggcagtgttacagctccatgactgctcttgcagggctaccccacaggctgagagtagcagctcagggcagtttggcggtcctatttatatttatttatttatttatttagagacagagtcttgctctgtcgcccaggctggagtgcagtagtgcaatctcagctcattgcaacctctgcctcccaggttcaagcaattctcctgcctcacccttctgagtagctgggattacaggcgcgtgccaccacgcctgactaacttttgtatttttagtagagatgaggtttcgccatgttggccaggctggtctcaaatttccgacctcaggtgttctgcctgccttggcctcccaaagtgctgggattacaggcatgaaccactgtgcccttcccatacctccttttttttttttttttgagacggagtcttgctctgtcgcacaggctggagtgcagtggcgcaatcttggctcactgcaagctctgcctcccacgttcacgccattctcctgcttcagcctcccaagtagctgggactacaggcgcccgccaccatgcccggctaattttttgtatttttagtagagatgagttttcaccatgttagccaggatggtctcgattgcctgaccttcctgaggcgtgaaccacccgcctcagcctccctaagtgctgggattacaggtgtgagccaccgccccccggcccatacctccttttaattacatgtagagtaaggggcagtttatgcagaaatttccagggaaggggtagtaacttttgggtgatcaggtaattgccatgaaaagcggtggtaagccgggcgcagcggttcatgcctgtaatcccagcactttgggaggccgaggcggatggatcacctacagtcaggagttcgagaccagcctggccaacatggtgaaaccccgtctctactaaaaatacaaaaattagctgggtatggtggcacacacctgtgatcccagctactcaggaggctgaggcaggagcatcgcttgaacccgggaggtggaggttgcagcgagttgagatcataatactgcactctagcctgggccacagagcaagactccatctcaaacaaaacaaaacaaaacaaaaacaaagaaaatagaccagttgtggtggctcacatctgtaatcccaggaccttaggaggctgaggcaggaggatcacttgagcccaggggttcgagaccagcctgggcaacatagtgagaccctcatttctacagatacacacacacacacacacacacacacacacacatacacgcacacacacatgagttggggggatggtttcaggatgaatcaaccacattacatttattgttcactttatttctattattattacattgtaatatataatgaaataattatacagctcacacatatgtgtatatatatatgcacacacactatatgaatattatatatagtaatatttattcatttatatgaataaaaaagaaactaaaagagaggaggaaaggaaggaaggaagaaggaaggaaggaagatcagcctggagtctctggactgccctgatggaagtgtcttggatgctaaaggggtttatgggctgattccctcaacttcctcccgtctaacaaggtctggtgttccatcaaggcagtggctatgctcccaagaagtttgcaaatgacagaaaacctaattacaggtcaacaaaccatgacctgtgggccaaatgcagcctgccacctgtttttgtaaatgaagctcttttttttgagatggagtctcactctgtcacccagcctggagtacagtggcacgatctcggctcactgcaacctccgccacccgggttcaagcaattctcctgcttcagcctcccgagtagctgggattacaggtgcattccaccacgcccagctaatttttgtatttttagtagaaacggggtttcaccatgttggtctggctggtctcgaactcctgaccttgtgattcacccgccatgggctcccaaagtgctgggattccaggcgtgagccaccatgcacggccaacaattttttttaatgaaaataattttttctcaatgccgttttggaagagaagcaaactcgtatgtgggttttaagtatggcttcattcagtagctccaacaatgtcatcaaggactgcatgtctctgtgatggattccttttctggctttgtaaatctaggatctcccactcatggcagcaaagtagctgcagttgctccagaccgcctaacctcactcttgaccaacacagcggagagtaaatcactgtcccagaagctggagcttaagatccgggatttgcactctctcattggtctgaagtgggtcatgtgttaatctctgaaccaatagtcataggcaaggggatgggccatgctaattgactggaactgggggtggagcccctctcagcccatgttgctagaagagaaagaggaaagggtatggatgtgtgcataattagttaatgaatatattcattctttccaccatccctcattgatttgtctactgcgtcccagcagcagggaatgtgatggttgataagaacttgtttctgctctcatggtgatcccagtctactgggattccacgatctgttcagacaggtacaacctgttgtaatcaatgctgtgtattcattaggatagaggtttggctactgtaacagttaggtagagattaatttatcatctaaacctatagagcagcagtctccaacctttttggtagcagtgaccggttttgtggaagacaatttttccatggaccagagttaggggggatggtttcaggatgattcaaatgcgttacatttattgttccctttatttctattattattacattgtaacatataatgaaataagtatacaactcaccataatgtagaatcagtgggagccctgagcttgttttcctgcaactagatgatcccatctgggggtgatgggagacagtggcagatcatcaggcaccagattcccgataaggagcgcacaaggtagatccctcacatgtggagttcacagtagggtttgcactcctatgaggatctaacgctgcagctgatctgacaggaggtggggctcaggtggtaatgcgagcaatggggagtggttgtaaatacagatgaagctatgctagctcacctgcccaccactcacctcctgatgtgtggcccagttcctaacagaccatggaccggtaccaggaggcttgtactgggagctactctggaggctgaggtgggaggatcacttgagcccaggaggtggaggctgcagtgagctgtaatcatgccactgcactcaactgggcaacagagtgagaccctgtcttttaaaaaaaagttaaaatcactcctgtaatcccagcactttgggaggccaaggtgggcagatcatgaggtcaggagttcgagactagtctgaccaagatggtgaaaccccatctctactaaaaatacaaaaattagctgggcttggtggcacacacctgtaatcccagctactcaggaggctgagcaggagaatcgcttgaacctgggagccagaggttgcagtgagtcgagattctgccactgcactccatcctgggtgacagagtgagactctgtctcaaaaaaaaaaaaaaaaaaagaaaagaaaaagttaaaaaaaaggccgggcgcggtggctcaagcctataatcccagcactttgggaggccgaggcaggtggattgcctgaggtcaggagtttgagaccagccttgccagcatggtgaaacccgtctctactaaaaatacaaaaattagccaggtgtggtggcaggtgcctgtaatcccagctactcgagaggctgaaggaggagaatcgcttgaacccaggaggcggagtttgcagtgagccaagatcacaccattgcactccagcctgggagacaagagtgagacttcatctcaaaaaaaaaagttcaaaaaaaccccaaccaattctctcctccccaataattaccttaggacaacaggcataagcttgggtcatccttggcaaactaggaggtaagtcactctatgtagcagagaaccaaagtaacaaggacttaaataaaactgaagattatttatttcttatgcaataatctgagcttaatcagtccaaggctggcatggtcctttctacaaggtcaaagaccagctcctcctgttctgttcttccgccacctgtgaatttcctttgtcctcagtttccaagaatactcatcaccatactcacttgccagccagataaaggggctagaatgttcctccctttaagaatgcaacctggaattgcacattatcagttagcttttgctgtgtaacaaacagtcccctaaaatggaatggcttaaagacaacatttgttattccaattaatttggtaaattgtctgggcagataggtgatctctgtggttagctaataacttggctggggtaggtagtctaggagggcctcattcacatatctgctggttggccagttgattagtataggatacctttagctaggtgcttgtctctgctccacacggtctctcatcctctggcaatttagcctgagtgcttgaatttggcaggagtattccaagaaagcaacaggagaagttgcaaagcctctatgggctaaagcgagccacaagaccaacccagatacaaaagatgaagacttagaatctacctctcttttttgttttttttttttgagatagggtcttgtcttgtcgcccaagctggggtgcagtgacttgatcttagctcactgcaacctcaaactcctggactcaattgatcctcagcctcctgagtagctggaactataggcatgtgccaccacacctggctaattttaaattcatttgtagagacggggtcttgctttgttgccaggctggtcttgaactcctggcctcaagcaattctcccaccccacccaatcctcccaatcatgtcttggggttacaggcgtgagccaccatacccggcaattctctttggctggtaggagctggaaagtatttgtaatctaccacaaagggcattcagggcagaggcaaccttatatatgagacctggagatgagagacagtaaaataggtgcatttagcgtgtggcaaccacttccacctggctggagcagaggtgggagaggtaagtgagaaaaaaaagagtagagtcatcagagaagtcagcaggggccgtggtgaggttgaactttgtgttggggatgatgggggaaccatggcaaggtttcaagaggagattgacatggttagatttgctgtatgaaggtgggctgggaggagtacaaaacggatcaggaagaccactgaggaggctgttgcagccacaaaggtgatcactgcggtggctgctctaggatttgggaacagggatggtgagaagagcttagatgtgacagatagtttggatgtagaatctgaataatctattgattgactggaaatggaggattcaatgaatcctccatttccagccaggtgcagtggctcatgcctgtaataccagcactttgggaagccaagacaagctaattgtttgaggccaggagttcaaaaccagcctggacaatgtaacaagaccctgtctctacaaaaaataaaaataaaaataacgttatctgggcatggtggtgcatgcctgtagtcccaacactcaggaggttgaggcaagaggatcaattgaacccaaaaggtggaggctgcagtgagctatgattgtgccacttcactccagtctgggtgacagagcaagacctcatctctacaaataaaaagttagccaggtgtggtggtgcatgcccatagtcccagctgctcaggaggctgaggcaggaagattgcttgagcccaatttcaaggctgcagattgcactactgcacttcagcctgggcaacagagtgagaccctgtctctaaagaaataaaaataaaaataaacccgactttcaaaacacttagattcgttcctggcttgtagacgatcacctatgaaattactctaacttggccgggcacagtggttcatgcctttaatcccagcactttgagaggcagaggtgggtggatcccctgaggtcaggagttcgagaccagcctggcctacatggtgaaaccctgcctctactaaaaatacaaaaaattagccaggcgtggtggcgggcgcctgtaatcgcagctactcaggaggctgaggctggagaattgcttgaacccaggaggcggaggttgcagtgagctgagatcacgtcattgcactctggcctgggcgacaagagtgaaacgttatctcaaaaaaaaaaaattactctaagttgattctgaaggattggggagtgttgaaaatcatcttgggttcctaagacaaattgctgggtggtaatggcaccattgttagatgaagaggctggagggagagcaagtttgaactggcaatgatgtcaatcttggacctgttaagtttgaggtgcccattgttgaaagaatgaacctgtttccccagctgtaagcaaagaaatggattgcaatgaaaaggcatgctttcaactgttgttccaaaacctttgtcctcatctggaacggaggtacagactgtctcttagttactgtgttattcatttctatttatttatttatttttgagatggcgtcttgctctgttgcccaggctggagtgcagtggcacgatctcagctcactgcagcctccgccttccaggttcaagtgatcctcctgcctcagcttctcaagtagctgggattacaggcatgcaccaccatgcccggctaatttttgtatttttagtagagacagcatttcaccatgtcggccaggctggtctcgaactcctgacttcaagtgatccaccctcttcggcctcccatagtgctgggattataagcatcagcctccacacccagcctcatttatttattcaataaattgtattgggcactattgcatgccaccatgtggtgttcaggattcagaggtgactcaaccctgggtcctgacttcatctggagagagcccagcacaggcgtcttcgttgtcaggcctgggttgaggagggacatcatgttaagggaggctgcagttgggggagaatgaggactctgcttggctgaagacattggggaaggtttcctggaagaagagatattggagatgggccttgaaggatgagtaggagttcaccaggcaaataggagaggaacttttagcccagacagcagtcctttattcatctccctgcatataattactgtaagaatcggcaagagaagctggaatggagatccatgaggtctctgaggatcagacagacacatcacagctaactctggcccaaagggtacttcattaggataacaccagctactgtaacaaacaagacatttcagtgacttcacatggtaaaaattgatttcttgtacacaaaacagtacaatgcatgtgcttctagttccaggtcggggggcttttccccgcagataattcagggacccaggctactttcatttgcagttttgccatcccttagagtctcagcctgcagaaaatagggagagaggaggtatggagaagtaatttctccttaaatacagtgccctgaaagtgatgcttatgacaaatgctcctattctattggccagaagcagtcacatgactgcatccacatgcaaggagagatgggaaatgcagtccttagctgggcagccattttccagcagcaattccatattatggaagagaaaacacgaatattggtggatctttagtggcctctgcccgaggtagacagcaggaatagaactaagggcttggaggcagtaacactcagtttgatttgtgctcttgagtaaacccttcttctcactctttgggtttctctctctgagtgatgagtgaagattggaagctgattaatatctgaggtattttccagtttcaaaaattgaccgggtgcagtggttcacacctgtgatcccagcactttgggaggccaaggcaggcagattacttgaggtaaggagttcaagaccagcctggccaacatggtgaaaccctgtctctactaaaaagaaaatacaaaaattagcagggcatggtggtgggcgcctgtaatcccagctgttcgagaggctgaggcacttgaacctgggaggtggaggttgcagtgagccaagatcacgccactgcactccagcctggatgacagagggagactctatctcaaaacaaaaacagaaacaaagacaacccaaaatacaaaaattgatgggttggtgaatgctcttggtttcccagctggagctaagatgatgatggtggtgatgctcatggtcatgaatactattgtggtaatgatggtggtgatgattataatggtaacgatgatggtgatggtggtgataatgatgatgatgatgatgatgataagaatggtgatgaggagaatggtgatggtggtgatgatgatattactatcataatgataatgataatttccagaacttgaaacgtccagccctttttatgcatcatataactgaattacaacaacatgacacagtaggcataaacccttcatgttggttcatttgcctttatccttgttacctatttattgctaagtaacaaattatccccaaacttaattgtataaaacaaccatttattatgcttatggattatttgggtcaagaattctgaaatagctcatctaggcagttcccctttggggtttctaatgaggttgcacacagatgtcggctggggctgcagtcatctaaaggccttagctggagggtctacttcctgagtggctgggccacatagagcttcagctcctctccacctggggctccccacaggactgattgagtggcctcacaacatggtcgccggtgagtggtccaagagaccaaaatggagcttcgatatgtttcattatttagtcttgagaactcacatcttgtttcttccaccctgttcttttagtgacacatggccagtcttggttcaatgtgggaggggattacaaaaaggcatcttaacttatgtatgaatactaggagctatggaccattgggggccatcctggaggctggctactacaaacacattgtcttaattactgtagatttatggtgtcttaatatttggtaggactcataccctttattttccctctgtaggagtatattggctactcatggctgaggttttctatacaaatcttaggatttgtatgtcaagttcaatgaaaagccattctggggtttttaattgaaattggattaaatctatagctcaattttggagagaattgaagattttaaaacttgagtcttggggctgggtgcggtggctcatacctgtaatctcagcactttgagagcctgtggtgggagagtcacttgaggccaggagttgaagaccagcctgtgtgacatagtgacatcctgtctctataaaaaatctttaaaaaaaaattagccaggtatgatggcatatgcttgtagtcccagctacttgggagactgacgcaggaggatcttttgagcccaagaggtcaaggttacagtgaactatgatcgtgccactccactccggcctgggtgacagagtgataccctgtctctaaaaataaatcaatgaatgaataaataaaataaaacaaaacactgagtcttgctagaaaggaactggtatatattctattttgtttaggtcactagctttatgcagttttgtttcacatcttctaggctatggtcaatagtatccttttaaaatcaaagtctgatttccctatgtgaaaagctaaattcttcattttatcattcaatcagttctagcaactgtggacacttgtgcaatccacacccttatcaaaacagaacatttccatcacttgtggcctctctgagtcaatctctaccttccctcttgctccggaagcaaccactgatttgatttctatcatcataggttagttttgcttactgtaggatttcacaattttttttttaatttgtgagttatttttgcttatgtactgacacttagtacactttgtatactggttttgtattcagccacactgccaaataattttattaatttcagctatttatctatatattctttgggaatttctatgttgatgattgcttcttctgcaaaaatgactttctttctttctttcttttctttctctccttccttccttccttccttccttccttcctttctttctttctttctttctttctttctttctttctttctttctttctttctttctttctttctttctttctttctttcctttttccctctgtcttgtcttgcagtacaggctgagatcttcaatacaatgttgaatagaaatggtgatagcaggttccgttgcgtagttctgatttcaaagggaatcttttcaacatctcattattaagtacagtgtttcggtctaggttttctgaagaccttctttatcaggttacagaagttcccttccatttttactttgccaagagatttttttccccctctttcttttgatcaggaatgaatgttgagttgctaccgcatctttcatgtgtcttctgttgcagatttctctttttgacaaaaagagaacaggtcttgggtcagagccttgggcgagcaacagaatctacctagaatttagtaacgttgtttgaaccatatttattctacagttgcttcttcttttatttatttatttatttattttgagacagggtctcattgtgttgcctgggccggagtgcagtggtgcgatcatagctcactgcagcctctacctcctggcctcaagtgatcctcctgcctcagcctcccaagtagctgggactactggccatcacaccaggctaatttttgtattttttgcagagacagtgtctctccgtgttgctcaggctggtcccaaacccctgacctcaaagtgatcctctcgccttggtttcccaaagtgctgggattacaggtatgagccatcacacccatcatacagttgtttctgtttgtagcccgtgagcttagttttgtaggaggatgtaaagctctcttcttaaacacaaaagagttaaagttcatgttccatatgcaatgggttgcatagactgtggcagcaattgagaagatgatacattctgcaaatggaagtgtgagaaacagggttacaacagacattaagtgccaaatgaattcacacacacagctatggcataatggttacgcacaggcttggaagtcatgctgcctgagtttgtatcccggctgtgtgtctcacctcagtttccttctctgtaaaatgaggataataatatgacttaccttgaagagttgctgggaggagtccatgttatctctgcagcatgctgaaaattgagagcatggtgggtggaagctcatgctagcttccactacacacaaggtaaagagaaaaggctgtggtcaagaaagtgggctcagctgggagttgtggctcccacccgtaataccaacatttagggaggctgaggcaggaggattgcttgaggaccagcctcggcaacataatgaaactctctgtctctacaaattttttttttttttttttttgagacggagtctcgctctgtcgcccaggctggagtgcagtggcgcaatctcggctcactgcaagctccgcctcctgggttcacgccattctcctgcctcagcctcccgagtagctgggactacaggcgcacaccaccacgcccagctaatttttttgtgtttttggttgagacatggtttcaccgtgttaatcaggatggtctcgatctcctgacttcatgatctgccctcctcggcttcccaaaatgctgggattacaggtgtgagccaccatgcccggctacaaaaacatttttaaaattagctggatgtggtggcacacatccattgtcctggctgcttgggaggctgagctgggagcattgcttggtcccaggaggtgaaggctgcagtgagctatgattgcatcgctgcactccagcctggacaacagagtgagagcatctctctctcgctctctctctctctcacacgcacacagacacatacgcacacacagacacacacacacacagaacgtgggttctagattcataccatctcggagtttaattgcagctcctcccctaacttactcttgctgttaatctcaagcagcatccccacaccgatctaagcctgctttcttgtaggtaaaatagacacagacgggtgtggtggctcatgcctgtaatcccagcactttgggaggccgaggcaggtgcattacttgagatcagttcaagaccagcctggacaacatggtgaaatccccatctctagcaaaaaatacaaaaatcagctggacgtggtggcacactcctgtagttccagctactcgggaggctgaggtgggagaaccgcttgaacctgggaggtggaagttgcagtgagccgagatggtgccactgccctccagcctgggcgacagagcaagactccatctcaaaagggtataaacactgacagtgtggttatgagaatggagttaatctgaatgcctaaccatgcgtagtaggcatccaagaaatgcattttttttttcttttgagatggaatctcactcttgttgcccaggctggagtgcagtggggatatctcagctcactgcaacctccgcctcctggttcaagcaattctcctgcctcagcctcccaagtagctgggattacaggtgcccgccaccatgcctggctaattttttttgtttgtttttttggtatttttagtagaaatggggtttcaccatgttgcccaggctggttttgaactcctgacctcaagtaatctgcctgcctctgccttccaaagtgctgcgattacagggatgagtcatagcacccagccaaaaaatgcaaatattgttatggtaggggcacagagtaggggttggcaagtatgtcagaatcacctgaggagagtgttaatatgcagattcccaggccccacctccatccatctagttaacaaacatatatcaggggcctcctacacataaggtactatcatagttgctgggcattcaagaaacagaacgatggccctcccctcttcaaactgacattttatttgggtgagataaacaataaacacaacaagagaagcaaaactaaggggatagaaaacgccggagtaggggtgtgggattttatgaaattttaattaatttatgtatatatttattttctgagatggggtctcgctctgttgcccaggctggagtgcagtggcaccgtcgtggctcaccgcagcctccacctcctgggctccaacaatcctcctctctcagcctcccgagtagctgggactacaggcacccgccaccttgcctggctaattttttgtgtttttagtagagacgggatttcaccgtgttagccaggatggtctcgatctcctgacctcgtgatccgcccgcctcggcctcccaaagtgctgggattacaggcatgagccaccacgcccagccttaaatttgtttttgtagaaatgggatctcattatgtggccccaggctgattttgaacacctaggctcaagtgattctctcacttccacctcccaacgtgctgggattacaggtgtgcaccaccacacccagctgactttttattttttgtggagatggggtctccctgtgttgaccaggctggtcttgaactcctgggctcaagtcaacctgggagtgggattttaaatagggtggctagaggaggtctcacagagaaggtgtcctttgaggaaagacaaagacgttggcaaggaactttcttctggatatcagggtgtatttgtttgcgtgggtgccacaacaaagtaccacgagcttggaggcttaaacagcagaaatttatcttctcacaataaatgtcttgttcacctccctatcctcccctcttcttcctcctcgcccactctaactccagccacatgggcctccttgctgttcctccaacatgttaggcaagatcctgcctcaggaccattgcatgcactgttctctcttcttggaatacactttcttgtgtgctatgggttgaactgtgtccccccaaaatttatacattgaagtcttaacccctagtacctcagaatgtggcagtatttggatatggagtatttacagaggtagttcagttagaatgaggtcatctgtgtgggccctaatgcactgtgactgatgtccttataagaagagtaaactagggtgcaggcagggcaagaccacgtcacagtgcagggagaaggtggctgtctactgaaatgagcccttagaggaacctacaaatatctagtcctaaaaagtagaaacaaactggccgggcgtggtggctcacacctgtaatcccagcactttgggaggccgaggcgggtggatcacctgaggtcaagagttcaagaccagcctgaccaacatggtgaaacctcatctctactaaaaatacaaaaataagctgggtgtgatggcgggtgcttgtaatcccagctactcaggaggctgagacaggagaattgcttgaacctgggaggtggaggttgcagtgagctaagatggcaccattgcactccagcctggcggacaaagtgagactccatccccctcaaaaaaaagaaagaaaagaaacaagctatccatgaaaacactttgtgatgtgctgttttatatcacagaatggaacctgtgttttgattcaacaagttcaaaacactcttttcataaaatctaagaagttatgtttctgaacctattgagcctttataggaacatatgaatatccagtcctaaaaactagaaatgagcgatctgtgaaaacactttgtgatgtgctgtttcatatcacagaatgggacctgtgttttgaagaaaccaaccctactgacaccttgatcttggacttctagtctcagaactatcttggacatttcctatgaatagaattgtacaatacatggcattttgtgatttgcttctttcactgagcatgtttttaaggttcatccatgttgtagtgtggaacagtattttgctccttttttatggctgagtaatattccattgtgtggatttgcctgtactggacatttcctataaatagatgcatgcaatacgtggctttggaagatggattttaaccaactctactgacgagtctgctttaggactcttggtccagactgacttcatggagagtgttgggggttgtgggagaggccaagcctacaagctgtgggaagctggtggatggaaggctggttagaattcttcaggatctggggaacctcagagagtgctgaacctgttgggacgttggatgagccaatacttggcaaatgcaagaatacaaaggtttctttctttctttttctttttccagatactcaaaagctggggccatgttacatgtgcccagctgtttcattagttaatatcttttggttgcaggccatggcaaccaaatctaaagtaacttaaacaagaaaaggaatgttttggctcatgaaataaaaaagtttagggatggccaggcatggtggctcccacctgtaatctcagcactttaggaggccaaggtgggcagattcctcaagtccaggaattcaagaccagcctgggcaacatagcgagacctcgtctctacaaaaaatacagaaattagctgggtgttgcgacacatgactgaagtcctagctacctgggaggtggaggcaggaggcatggttttttgtttgtttgtttgagacagggtcttgctttgttgcccaggctggagtgcagtggtgccatcatagctcaccgcaggctcgaactcctgggctcagtgatccactcatctccgcctcctgagtagttcaaaatgtttttcaggtcatccacattgtagtatgaatcagtgcttcattcctttttatggctgaataatattccattgtatggatataccacatttgtttaaccgttagtgattaattttatcttttgtgaattttaactcaataaaaacattcagagcatagatctggatcaggcacaacttaatctttaccagaagataattcaatttcatggaagagggtctgtgctttcatttcccctccacaccagtccccaagctaggtggcctgggggtcagtttctcccctgccctttcgtactgccccaccctcatttctctgtctcctcacagttcctgtgccttaagaacattagaaccttcctgtccacctgctgtgagaagttcggcctcaagcggagcgagctcttcgaagcctttgacctcttcgatgtgcaggattttggcaaggtgagctgcacacttgaagcccaaagactgagtttcagttaatttctattgacgtctacactgggcaagctaaggactgtcaggggacaggcagacaagccagaccaggccatatacaagacgcaaatagcactggcttgggatatgtggaactgggtttgagttcctgctctgacacttgctgtgtgaccttggatacgtggctgtgcctctctgagcccctcgtttctcatctgaaatatgggaatattatcatcctgccctctctgagtggctatgaggattaaatagaaagatagagggccgggcgcagtggctcatgcctgtaatcccagcactttgggaggctgaggtgggcggatcacgaggtcaggagatcgattccaccctggctaacacagtgaaaccccgtctctactaaaaatacaaaaaattagctgggtgtggtggccggcgcctgtagtcccagctactccggaggctgaggcaggagaatcgcttgaacctgggaggtggaggttgtagtgagccgagatggtgccactgcactccagcctgggtgacagagtgagactccgttaaaaaaaatactaaaatataaaagaaagaaagaaagataggagcaaagggtggggctcatttgagagaacgatggtatggggaataggaggtagagaaaatcctgaattaggcttccaagaggcatgggatctagcgcctcagacagagccttgcagctggaagctgtgttctgccgtgggggtgtacaaggggctcactgagtggccactgccccgtcacaggtcatctacaccctgtctgctctgtcctggaccccgatcgcccagaacagggggatcatgtgagtaaccacctgggccttgggccatttagccccagtcctccccctccctgaagccccacttctacccagcccccaggcccctggctcacaccctcctgaccccccaggcccttccccaccgaggaggagagtgtaggtgatgaagacatctacagtggcctgtccgaccagatcgagtgagtgctcaggcctgtggccgcacagctcactggagcaccgtcctgggggtggagggtgtggggggacatggccttgccctccgggaaataaggtcataccctggtgtctggggcacacaaccttgcctgagagtctggggagacacagccctgccctggggtcttgggggacatggcactgtcctggggtcttgggggacatggccctgccctggagcttggagggacatggcctgcccttggagtctgaggtcccacccttggagtcttggggggacaaagccctgcgctggggtctgcggggaccctgctgtgatctgggagaggtccaagggatccctgacctcacaacccacagcgacacggtggaggaggatgaggacctgtatgactgcgtggagaatgaggaggcggaaggcgacgagatctatgaggacctcatgcgctcggagcccgtgtccatgccggtgcgtgacgtggagggtcgggcctggggagggcgtgggcggggggcagccccaggccccccaacaccggcctctcccctcgctctcagcccaagatgacagagtatgacaagcgctgctgctgcctgcgggagatccagcagacggaggagaagtacactgacacgctgggctccatccagcaggtgggcgcctcccacccagcgcctgccgggcgcatgcgcgggagctgggccggcaggtgcacgtccacctgtccggccgctctgggcagctgaggatttcctgctcccatcgcttttcctttctgtgactgtctccgtctctgagtttctctgacttacatatgtatatataaatatgagtctgacgtatatatatattaaaaaatatatataaaatataggacactgcctgcaggagcagtcaaaaaaccaaaaacaaacaaaataaatacaaaatcaaaaatatataaatatattaaacatatacataaatagaaaatatataaatatatacaaagtatatataaaaatataaacatataatatgtataaaatataaacatgatatatgatatttataagatataaaatatatagtttttcatatagagctatatgtaaataatatatacaatatataaatatataaaatataaaatgtagatatattgatataggtatatatctttttatatagatatatatttttaatatacaagatatatgtccatatgtagatatatatacctttatatatcttatatacataaaagatatatatctttatctatctatcttttttttttttgagacacggtttctctctcattgcccaggctagagggcaatggcaagctctcgctttactacaatctctgcctaccgggctcaagcaatccttctgcttcagcctcccaagtagctgggattacaggcatgcaccaccatgctcgactaatttttgtatttttagtagagacgaggttttgccatgttggccaggctggtctcgaactctgacctcaagtgatctgcccacctcggcctccaaaagtgctgggattgcaggcatgagccactgtgcctggcttatatatctatcttttaaagatatatatcattatttaaagatatatatataaagtatgtataagatatgtaatagatacaaatatatattttatatatattttttgttatgttaaccaggctggtcttaaactcctgggctcaagcaatcctcctgtaatccaagccctttgtgaggctgcactgggcctcttcctcttgtctctctgtctctctctttatctctcactctgtctctttttccctctgggtctcctctcgctactttcttcctcagtgtgtcattctctcctttgtagctctttatcccaggctcagtctttttctgtatcctcacctctccatttcttttaaaaatagctttattgagatttcattaatatacatgtaatccacccatttagaatatacagttcaatggtttttggcacacacaagattatgcagtcatcatcactgtctaattttggaatattttcatttgttttgttttggttttttttgtttctttttttttgatttgttttgttttgaaatgtggtctcactctcccatccaggctggagtgcagtggcacgatcatagttcactgcagcctcgaactcctgggctcaagtgatccccctgccttaacctcctgaggagctggggccacgggtgcatgccaccacaccctgcttaattctttaattttttttgtagatatggggtcttgctatgttgcccaggctggtctcctactcctggcctcaagtgatcctcctgccttggcctcccaaagtgttgggattttgggtgtgagccaccaccccggccttaattttagaacgttttcatcatctcccaaagaaaccccaaactctttagctgttccccttcaatctcttatcttcccccggtccatggcaaccacgagcttactcgctgtctctgtggattggcctcttctggacatttcatataaagggcatcacatactatgtggtttatatgtgtctggcttcttttgctgagcgtagtgttttcaaggttcatccacattgtagcctgtgtcagagcttcattccttttcatggctgaataatattccattgtatggatggaccacattttttttttcttttttgagatagagtctcactctgtcacccaggctggagtgcagtggcgtgatctcagctcactgcaacctctgccatccaggttcaagtgattctcctgcttcagcctcctgagtagctgggatcacacgcatctgccaccgtgcccagcttatttttgtagttttagtagagacggggtttcaccatcttggccaggctggtcttgaactcctgacctcgtgatccacccacctcaggctcccaaagtgctgggattgcaggcgtgagccaccgcacctggccggaccacatttgaaacacccatttacccattgataagcattttggttgtttccgcttttgggttattatgaataatttcactgtgaacattcttgtacaagtttttgtgtggacgcgctgcctctctttatctccctctctctgtctccttcccctgtctctctgagactggtctggaggagggaatcttatcttccgtcatctttctctcccttccccgcagcatttcttgaagcccctgcaacggttcctgaaacctcaagacattgagatcatctttatcaacattgaggtgagccggccgatccccagccctcttgggtctgtctagtgcggataacctgctgcccctacctctccctggagtacgggggttgggagttgagcggcatggggcgggtggatgaccctttccttcctggccccctgagccctgggctctggtcccagccctcacccttccctccgagtaggacctgcttcgtgttcatactcacttcctaaaggagatgaaggaagccctgggcacccctggcgcagccaatctctaccaggtcttcatcaaatacaaggagaggtgagacccagctggccagactgaagctctggggtcactctgtcttgcctaggctgggcatctgagagaccttaccctcagacaccactggacggggaggactttttgctgtgtgttcatgggcgaggggctgcccatctctggttcaattcccagctctgctgtgtggcactgggtagtcacttaacctctctgtgcttctgcttcctcatctgtacatcagtgggccacaggaatgtgcctcctaggctggtggtgagggttgactatacggatgcacacagggcctggcacatagtagatgctcaataagtatttgttaaatgaaggaacattggccaggtgtggtggctaatgcctgtaatcccagcactttgggaggctgaggcgggtggatcatttaaggtgaggagttcaagaccaggctggccaatatggtgaaaccccgtctccatcgcctaaaaatacaactaaaatacaactaaaaatacaaaaaacaattagctgggcgtggtggcatgcacctgtaatcccagttactcaggagaattgcttgaacccgggaggcggaggttgcagtgagtcaagatcatgccactggactccagcctaggcaacagagcaagactctgtctcagaaataaaaacaggccaggcgtggtggctcacgcctgtaattccagcactttgggaggccgaggagggcagatcacttgaggtcaggagttcgagaccagcctggccaacatggcaaaaccccgtctctactaaaaatacaaaaattagccaggcatggtggcaggtgtctgtaatcccagctactcggggggctgaagcaggagaatcgcttgaacccgggagatggaggttgcactgagcccagatcacaccactgtactccagcctgggagacaagcgtgaaaccccgtctcaaaaataaataaattaattaaattaaataaaaataaataaacattgggcagagacaataccaggtactgtggtgaaattactgtagcattaaatgagataatgctacaatagcctcacatgggagatgctattgttatgcccatttcacagatggagaaactgggactcaggtttcttctccagcggggaagagcaaggccagggctgacgccagcctctgcccgaccttgatgccagtcacctttacctggtggcctgtcttctccctgtaggttcctcgtctatggccgctactgcagccaggtggagtcagccagcaaacacctggaccgtgtggccgcagcccgggaggacgtgcagatgaagctggaggtgggcgccgggccacttctcgggggcctctcccgctcctccccaggccctgggggcagcagggaggacactgagttgcagatggtccactttctgctgcagcccagccagagatccaccaaaggactagggagggaggtactagccagccaagcagaggaaatggagaagaacagaaatgggctggccctgggtctgggctgacccctgatatcagggtgaagtcctgaccctgaactgagctctgatctcacactcaaccccagccctgggctgagccctagcactgattgtaccccaagtcgggctgagctcccacttctcactgaaccccaattccaaccaacccctgatcccaggctgaacttgatcttgaactgaacttcaacctggatctgtctggtggaaacacagacagggcaggggtggtgaggacgggggctctccagatctgtccccctccccatctccagcccccctcagcaggcagaatactggacctctatcccaggcagcatttgccacattccagtgggtttgtttgtttgtttgttttgttttgttttgtttttttgagacagggtctcattctgtcccccaagctggagtgtagtggcatgatcatagctcaccacagcctcgacctcctggactcaagcaatcctcccaactcctaccttggcctcctgagtagctgggactacagatgcatgccaccattcctggctaatttttgtgttttttgtagagatggggtttcaccatgttatccagggtggtctcaaactcctgggctcaagcgactcacccactcagcctctcaaagagctaggattacaggcgtgagcaatcgtgcccagcctcttcccattgcttttttgtttgtttgtttgtctttgttttttgagatggagtctccctctgtcacccaggttggagtgaagtggtgtgatctcagctcaatgccatctctgcctcccgggttcaagcaattctcctgcctcagtctcctgagtagctgggattgcaggagtctgccaccacgccagctatttttttttttttttcatagcagagacggggtttccccgtgttggccaggctggtcttgaactcctgacctcaagtgatcctcccgcctcggcctcccaaagttccttccagtggttctcaagctgcccccacctcatggagtccttttcctgtttccttgggggcagatatgatgctttggcctctagaaaaattcccacagctctggggtggagagctgctcacgtatttattcaaatctatctgcacccaccctgcaactggctctttctgggacctgcctcagtttccccattgttctctgattccccaggaatgttctcagagagccaacaacgggaggttcaccctgcgggacctgctgatggtgcctatgcagcgagttctcaaatatcacctccttctccaggtgccaggcacatctctaggcgtgggctccacgtacctactctcctgtgtctataaaagtggggacggggctggcttctgggggttgggtctctaggacgctcggggatgggtcactggggtcatgtctcagcctccagggtcagcagtacgatggaggagctggtgagctagcattgtttggaaggccctccccgcagggagaaggggaggggcccaggtgacgtctgacgtcttggttctctcaggagctggtgaaacacacgcaggaggcgatggagaaggagaacctgcggctggccctggatgccatgagggtgagtgggtgtagggtgctggtgactcacctgctgcagacaccctcctggtaggggctgatcctctagccgggattaggtaggagcctgggtcggctgttggggggccaggttcacccctgccccctccccaggacctggctcagtgcgtgaacgaggtcaagcgagacaacgagacactgcgacagatcaccaatttccagctgtccattgagaacctggtgaggcggtggagccgggtgggccaggggtgtggccacgtggggagagtgtgtgtctggctcctttcttgggagacccttgctagaccccctgcctactgcataggaccagtctctggctcactatggccggcccaagatcgacggggaactcaagatcacctcggtggaacggcgctccaagatggacaggtgggtggagtcaacatggatctgggatggagcctgggcaaaggggtgggaccaggctcctagatgggcaggtgggtggagtcaacacagatctgggtggagcctgggcaggggcggggccgggcttctagatggacaggtgggtggagtcgacatagatctggagcagagcctgggcaggggcagagccaggcttctagataggcagatgggtggagtcaacacagatctgggaggagcctgggcagggatggtgccaggctcctagatgagcaggtgggtggagtcaacacagatctgggtggagcctgggcaaggtgggggccaggctcctagatgggtaggtgagtggagcaaaccatatctgtggtggagcctgggtagggatggggccaggtttctagataggcagttgggtggagtcaacataggtctggggaagagcctggataggggcgtggccaggctcctagatggacaggtgggtggagccaacacagatctggggtggagcctgggtaggggtggggccaggttcttatgtagacttgtaggtggaattaagatgaatttggggagggacctgagtgggggtgaggcaagatttctagacagacaggtggtagacccatccagagaaggcggtggagccttgatggacaggcaggacagggccagcgaggggtatgggtggagcgaagactgacaggcagtagggccaatgcggatcacgtgggtgaagtcaggatggacaggtgggcatggccaagttggccaaggaggaggagaagggcagggtgggaccaggatgtggaggaactggtcagagggctgatggggacagttgggaagagccagacaggaatgcgttatccatccttccaggtatgccttcctgctcgacaaagctctactcatctgtaagcgcaggggagactcctatgacctcaaggactttgtaaacctgcacagcttccaggttcgggatgactcttcaggagaccgagacaacaagaaggtggggctttgacgccggaactatggggtcctccacgcagtcggcagcttagccctctccacttgggcatgtgcctgtttgccagactacatctacatggaagtgtgtgttaatccactcaacaggtgttttttgtttgtttgttttgttctgttttttaagatggagtctcgctctgtcgccaggccggagtgcagtggcacaatctcggctcaccgcaacctccgcctcctgggttcaagcgattctcctggctcagtctcccgagtagctgggactacaggcacacaccaccacgcccagctaatctttgtagttttggtagagacagggtttcaccatgttggccaggatggtctcgatctcttgaccccgtgatccacctgcctcggcctcccaaagtgctgggattataagcgtgagcccactcaacagtttttaaattgagcacctactatatccagggcactcttctaggcactaggactaaaatggaaagcaaaacagaattttcattttgtttgtttgttggtttgtttttgagacagtctcactctgttgttcaggctggaatgcagtggcacggtcttggctcactgcaacctctggctcccaggttcaagcaattctcctgcctcagcctcccgagtagctgggattacgggcacccaccaccatgcccagctaaattttgtatttttagtagagacgaggtttcaccatgttggccaggctggtctcaaattcctgacctcaagtgacctgcccatcttggcctcccaaagtgctgagattacaagcgtgagccactgtgcccagcttattttatttcttgtatggtacttgcgttcttatgggatgctttctacaaagaaaataaagtaggtggctgggtgcagtggctcatgcctgtaatcccagtactttgggaggccgaggtgggagaattgcttgagcccaggagtttgagatcagcctgggcaacatagggagatccccgtctctacaaaacataaaaaaaaatttagctgggcttggtggcacatgcctgtagccctagctacatgggaggctgaggtgggaggatcgcctgtggctaggagttggaggctgcagagagctatgattgcactacagctaggaccacagagtgagatcctgtctctattaaaaaataaatgaatgaaacaggagatgtggctgtggtaggtgagggtgggagggggagctatcttacctccattgttcagggacattctctgtggaagtgacatttaagctgagacccctctccctctcggctcttccttacttccttctgctttttctcctgtgaactcttccgttcgcttcagtttttgccctggagttccccctgtgctctggtctgtggcttctctatttctttttttgagacggagcctcgctctgtcaccaggctggagtgcagaggcatgatctcggctcactgcaacctccgcctcctgagttcaagagattctcctacctcagcctcctgagtagctgggattacaggtgcccgccaccacgcccagctaatttttttgtatttttagtagagacggagtttcaccacattggtcaggctggtctcaaactcctgacctcgtgatccgcccacctcagcctcccaaaatgctgggattacaggtgtaagccaccgcgcccggctggcttctctatttctcaacctgtgtctccctcaaggagccagttgctgtcttgtaactgcctgcttacagcatccgtctctcctaccaggctggagctctggggaccacatcctattcactgctctgtccccagctcctagcagtgtctgtttctcagcaggtgctgcaccaatgctttgttgaacagaaaaatcgatgatgagtgacatgctgtgtctggtgtgtgcttctgcaaaggggagtgtgtgtgtgtgtgtgtgtgtgtgtgcatgtgcacgcctgcgtatgtggttttgggtttatggttgtgtatttggatatcctagaaagcccttttacaaggatatccatgcatggtgctaggggcatagagactgtcatgggcttgcctgttccctacagagggaggggtgggtgggtgtgtgctcccaccctcagcgggggcagtgccttcagtctgagctctgcttccctgcagtggagccacatgttcctcctgatcgaggaccaaggtgcccagggctatgagctgttcttcaagacaagagaattgaagaagaagtggatggagcagtttgagatggccatgtgagtccccgtcttcctccctctttctgtccacagaggggcaggggctgggaaggaggaacgtgatctagtccctactctgtcctgacatgccatgggaccactctgaaccacagtctcttcatttgggaaataagagggacaggcccaaggctgtcttcatccttggaatgcaggggttgtgtgcaagcttcagttaccagcccagactcttctcctttcctcctcctctttcttgttctcctctcctcttccttctcctccttctggtttccttcctcctcctcctcctctttctccttctcctttcctcctcctctttcctcctcctccccttcctcttcttcttcctcctcctctccttcctccccttcctcctcctcgccctcctcttcctcttcctcctattcctcctccacctcttcttcctcctcctccctttcctccccttcttcctcctcctcctcctcttcctcctcttctttctcttcctcctccctttcctcctcttcctcttcttccttttcctcctcctccttcttcttcccctcttcctcctcttccacttttgtcttctctttctcctttttatgtgaggcaaaattccaacaacaaaaatctaacaatttcgaagtgtatgatcgcatggcattttgtacactaacagcattgtgcaaccatcacctctatccagtttcaaaaccttttcatcagcccaaaggagacctcatacccattaagcattcactcccaattccccgctctcgcagcccctggaaactcctagcctgctttctctttctcccaatgtgcatggcagcacgattcagtgtggccaaagggtgaaaacgacccaaaagccaatcaatgaatgagtggacacgcaaaacgtggtctgttcataccatggaatagtattcagccataaaaaggaataaaatactgaccttcttttttttttttttttaattttcccctgccagctccaacatctatccggagaatgccaccgccaacgggcatgacttccagatgttctcctttgaggagaccacatcctgcaaggcctgtcagatgctgcttaggtgagaatctgggaggagggtcctgcataccggacttggtcatcagttccttgctagagaagatggcctagtaattggttccctaaattgggagatgggggagtccctactttgatcttctgcttctccgtcactctcctgatctaaagagaacccaaggggtccctttatgtttttagcagaatatttggccctgtctgtaaaggtcactcgctcttctttatgtgttccctgcatctcagaggtaccttctatcagggctaccgctgccatcggtgccgggcatctgcacacaaggagtgtctggggagggtccctccatgtggccgacatgggcaaggtacgagtgggagggaggctgggaggtgagcttggttctctttggaggatttcccgttctcaccatttcctttaccctcccgtagatttcccaggaactatgaagaaggtaagactttcccgtggtccttcctgtgtaccacaaataatgggcaacagcgcggggaggacccaggacatcctggaactgggcaggatcctttgtggggtgaggagagtaagggggcctacaagcccccaggctgggcataggtagacaggctttctttgtttctccttccaggacaaactacatcgcagggctcaggacaaaaagaggaatgagctgggtgagttggcaggggttgctgtgttggggcaggaggaaaattcatctctattgatgttgacccagggacagatctccataatcatattaacagccacattgggccgggtgcaatagctcacacctgtaatcccaacaatttgggaggccaaggcgggaggatcgcttgaagtcaggtgcacaccaccacgcctagctaattttttttttttaaatagagatgaggtcttgctacgttgcccagccatactgtataaattaaatcatacagtatgtgcttattttaattaattaatttatttatttctggagatggagtcttgctgtgtcgcccaggctggagtgcagtggtgtgatcttggctcactacaacctccacctcccaagttcaagcgattctcctgcctcagcctcccaagtagctgggattacaggcacatgtcaccacgctcggctaatttttgtatttttagtaaagacggggtttcaccatgttgggcaggctggtctcgaactcttgacctcaggtgatctgcctgctcagcctcccaaagtgctgggattacaagcgtgagccactgtgcccagccttaattttaaaaaatttaaaaatatatgtattttattaaatatataataatttattatttaataatatattaatattaattaatataatatagtaataatatattataataatatataaaatatatattaatatatatttattaaaaatatattatatgtatatataatatatcttttttttatttttagaggcagggtcttgctctgtatcccaggctggagtgcagaggcaggagtgttccacttatatgccatttatatgacatataaatatataacataagtcaggtgtggtggttcatgtctgtgatcccagcactttgagaggccaaggccaggagtttgagacaagcgtgggcaacagaacgagaccctgtgtctacaaaaacatttttaaaaattagcggggttcttgcttgagcccaggagttcaaggttgcagtgagccatgatcacgccactgcacgccaacctgggcaacagagcaagatcctgtttcaaaaaaataaaaaaataaatatatgaaatctatgaatgggtatgttttcttcttattattacttactatgtaattagcaatagtcagtcagctttcttagcaagagtcaaaattagaaacaacccgtgtcctttgtacaatagaatatatatatgtgtatatatatatacatacacacacacacacacacacacacacacacacgtattttattgagagaggaaatacatactttaaggtatgtaaaaatcaataaatcttaagtatatgacttaatacatttttatccatgcaaccaacaatcaaataaaaatgtagaacatttccatccctccagaactgcactgtgtaatataaattaattaaaatgaaatcaccttaaaaatttttttgctcacgttagccttgaagttctcaataatggcctgtggctagttgctaccatattggacatatccatcaccacagaaagctttgtcagaaagcactgctactcacctatctcccatagggaaccactgtctgacctctatcaccatagattaattttgcctgctcttgagttttctataaataaaatcatacagtacatgcttatttcatctggtttcttttatctgacgtaatgacggtgagatgcattgatgtgatcgcctgtagcaatagcttgttccttttcattgttgtatagtattccattatgtgatgatatcacaatttgtttattgattgatcaacctattgaggacatttggttggttgccagtttttggatattgtgtataaagctgcaacttttgaaggactttttttttgttttttgtttttttgtttagttttgttttgagacagagtctcactccatcgcccaggctggagtgcagtggcatgatctcagctcactgaaacctctgcctcctgggagttcaagtgattctcctgcctcagcctcccaagtagctgggattacaggtgcccaccaccacacccagctaatttctgtagttttagtagagatggggtttcaccatgttggccagtctggtctcaaactcctgacctcaggtgatcttcctgcctcggcctcccaaagtgctgggattacagacatgagccaccgtgcccagccaggacacatgttttcatttctcttgggttgctgggttacagagtagatacaatgtttagcttcagtagatattgccaaatagttttccaaagagtatccccaccagcaatgagtgaaaattccagtttctccacgtccttgtcaacacttagtattgccagtctaaaaagaaaaattttagccattctcgtgggtggcaagattcagggttgaaagttgactgccaaccaccctgtactcctgtaccctgtcctccaggtctgcccaagatggaggtgtttcaggaatactacgggcttcctccaccccctggagccattggaccctttctacggctcaaccctggagacattgtggagctcacgaaggctgaggctgaacagaactggtgggaggtacaggctggggccacaagagtgatggggtgggacccaagtgtagggttatggattcatgtggtctcagggagttgggtcatagttccaccatgctctggaggtgatgcctggggagtggggtaggtagactgagacttctgggcatggcttttctgagcgggccatcttcccaggaagttaatactcattatcacctctctgggctctccaggccatcctgagatagatggacaagcagagtgaccattgagcagagagatggacacacacacacacacacacacacacacacacacacacacacgagtgatggggcaggatccacgtgtagggttatgggtttagatggcaggtggggttatggatcctataacctctctgttcctgtttttgtctcctgggtgtttagggcagaaatacatctactaatgaaattggctggtttccttgtaacagggtgaagccctatgtccatgtgagtgcctcaagtctgaatggaataagggcaaggggtccagggcgggtcctgggaggatggacagacttggaaagacacccccggagttggggagggggctgcccatcatggcaggtctttctctaactcaaggcttcacccaccccaccaactgagcccagagaggggccaccctggaaacaatgattgatctttttctccttgatcatttttgtgtaaaggtcctttccttcctacatgggtatggtagggaggaaggagcagggacctagaaggtgggcctgccccttgcttccttctgagacaccaaattgagttctgtgggagcactgtggcctccattgcctgtgtccttgccctgctcctggtggacacacctgtccactccagcctctgctgttcttccagtgttctctgcttgatggacccctcgctcttcatgatgacttcagatctctccctctctccccaacctcagacaccccctacctcattcacagcaaatgaccccactgtacacttcacagcctgcagagggaaattctctccagtgctggttttaactttatattatttcagacttctagcaaagctatgagaataatgcaaagagctcctgtgtagcctttacccagtttcatcagttctgttaatgttttgttccatttgctctgtcatttcctctctctacccacacatagtatttatttttcctggaagagttaaaagtgagtttgcagacgacgttcccctttacccctaaatacttcttaagagcaagagccttctcatgcataaccagagcaagatattaaaagacacaaaattcaacattgacattatactattatttaattcatagtctgtatttaaatgttgtcaatttccccaaaaattttatcaaaaatttttttgttcctatggtttctccactgtcaagttacaataggaatttccaaccccatcattctttccaaatttattagctggtgttctgctgcaagaaagagctgtcctttctgccctcatctgtctgtctgtctgtctatctatctatctatctatctatctatctatctatctatctatccatgcatccatcttttatctatatatcatctatctatttacctatcatctatttgcctatcacctatctacccatctattatctatctatctatatcatcatcatcatcatcaatcttttatctatttacctatcatctatccatctattcgtcatctacatattatctatctatctatctatctatctatctatctatctatatgtctatctatccatgtacctacccatcaatccatccattcatcaatcagttcttctatccatccatccatccatccatccatccatccatccatccatctatcatctatctacttatcaatacattcatgatctattcatccacctatcatttatctatgtatcatctgtctatgtattatctatcatctatctattcaccgatcatctctctgcctatttttcacctaccgatctaaccatctatcatctgtctattacctatttattatcatttctctctcatctattcatttatcatttatccatcacctgtctgtttatcatctatcatctttccatctatctattacctgtttatccatcatccatctattctatctatctatctcttaattttttgttttagagagagggtctcattctgtcacctaggctggagtgcaatggtgtgatttaactcactgcagccttgacctcctgggctcaagcaatcctcccacctcaccctcctgagtagctgggaccacagatgcaagccattatgctcagctttatttatttatttatttatttatttaagatggagtttcactcttgtttcccaggctggagtgcagtgggatgatctcggctcattgcaacctccgccttccggtttcaagcgattctcctgccttagcctcctgagtagctaggattacaggcgcctgccaccacatctggctaatttttgtatttttagtagagatggagtttcatcatgttggtcaggctggtctcgaactcctgaccttgtgatccgccagcttcagcctcccaaagtgttgggattacaggtgtgagccactgcacccagccgcagctgtttttttgtgtgtgattttttttttttttagagatagggtctcactatgttgtccaggctggtcttgaactcctgggctcaagcaatcctctcacagaacatccttctcttttttcttttaaaaaattgaggtgaaatttgcacagcataaaactgaccgttacaatgaaaaattcagaatactgagtagctgagattacaggcgtgcaccaccacacctggctaattttttgtatttttagtagagatgggattttaccatgttggtcaggctgatctcaaactcctgacctcaaatgatctgcctgcctcggcctcccaaagtgctgggattacaggcgtgagccaccacgcccggctgggtatggcattttcttttggagtgataaaaatgttttagaactaggtagaggcggtgattcctcattcattttattattattatttttgattatggcaaaatatatagaacataaaagttaacaatgtaaccttttttttggagacaggatctcactctgttgcccaggctggagtgcaatggtgcaatcttggcccaccgcagcctcgcctcccaggctcaggtggtcctcacacttccgcctcccaagtagctgggactacaggtgcataccaccatgcctggctaattttttgtatttttcgtagcgatggggttttgccatgttgcccaggctggtttcgaacttctgggcccaagtgattcccctgcctcagcctctcaaagtgctgggattacaggcctgagccgccatgcccggccaacataaccattttctaaggtacagttgagtggcattaagtacattcacagtgttttgccaccatcaccaccatcatctccagaacacttttcatcttgcagcactctgaacccattaaacagcaaccacctattcccctctcccagcccctgacattcacattctactcttgagctctatggatttttctgtcctaagtacctcacctaagtgaaatcatacagtatttgtcctttgtgtctagcttgtttcacttggcataatgtattcaaggctcatccatgttgtggaatgtgtcagaattttctttctttttttttttttttttggtgaaatggagtctcgctctgtcacccaagctggagagcagtggcgcaatcttggctcactgcaagctccacttcccgggttcacaccattctcctgcctcagcctcccgagtagctgggactacaggcacttgccaccacgcctggctaattttttgtatttttagtagagtttcaccgtgttagccaggatggtctcgatctcctgaccttgtgttcctcccgcttcggcttcccaaagtgctgggattacaggcgtgagccactgcgcccggcctttttttatttttatttttttgggatggagtgtggtcctgttacccaggctggagtgcagtggtcgtgtaattataactcactgcagactcgaccccctaagcttaagtgatcctcccacttcagcctcctgagtagctgggactacaggcatgtgccaccatgcctggctaatttttctacttttaaaaaaatttttgagatggagtttcgctcttgttgcccaggctggagtggaatggtgcaatctcggcccactgcaacctcagcctcccgggttcaagtgattctcccacttcagcctcgagtagctgggattacaggcatgcaccaccacaccaagctaatttttgtatttttagtagagacagggtttcaccatgttggccaggctggtctcgaactcctgacctgaggtgatctgcccgcgttggcctcccaaagtgctgggagtacaggtgtgagccaccatgccgggcctaatttttgtattcttttgtagggacagggtttcatcatgttgcccaggctggtctcgaactcctgggctcaagagacccaccctccttggcttcccaaagtgctaggattacaggcatgagccaccgtgctgggcaattttcttaattcttaaggctaatattccatggtatgcatataccatgttttgtttatccgttttcctgtcaatgaacaattggttgcttcaacttttgcgtattgtgaataaagctgctacaaacatgggtatgcaaatatcatttcgaatccatgctttcaattcctttgggtatatactcagaaacaggacggctgggtcatatggtagtgtagttctagtttttaatgttttgaggaaccaccatactatttttcttttcttttttttttttttttgatagggagttttgctctgtccccaggctggagtgcaatggaatgatctcggctcactgcaacctccgcttcccaggttcaagcaattctcctgcctcagccttccaaataactgggattacaggcatgcgtcaccacgcccggctaattttttgtatttttagtagagacggggttttgccatgttggtcaggctggtcttgaactcctgacctcgtgatccgcctgcctcggcctcccaaagtgctgggattacaggcatgagccaccgtgtccagcacatactgtttttcatagtgcaccattttccattcccaccaacagtgcacaagggttctgatttctccacatccttgccaacatttgctactttctgttttgtttgttgatttgtttttgccttatagtagctgtcctaattgttttaaggtagtgaaagtgagcactttcggccgggcgcggtggttcacgcctgtaatcccaacacatttgggagagccgaggcgggtggatcacctgagctcgggagtttgagaccagcccgaccaacatggaagaaaccccatctctactaaattatacaaaattagccgggcgtggtgacacacacctgtaatcccagctacctgtaatcccagctgaggcaggagaatcgctggaacctgggacgcggaggttgctgtgagccaagatcgcgccattgcactccagcctgggcaataagagcaaaactctgtctcaaaaagaacaaataaataaataataaatacatacataaaacaaaaaagaaagtgagcactttcatccatatttagatgagggttggtaaactttttctgtaaagagccgaagagtagtgtaaatctgctcaccctccagggtcccatatggttttgcaactcttcagctccgcccctgtagtgcaaaagtagccacagataatctgtaaatgatgtatagacacggctgtgttcctacaaagcataattcatgggcactgacaggtgaatttcatatgatcttcacaatcccaaaaacattcttttggctaggcgtggtggctcatgcttgtaatcccagacctttgggaggacaaggcaggaggattgcttgaggtcaggagtttgagaccagcctgggaaacaaagggagaccatcccccgcccgatcttgacaaaatttaaaaaaattaaaaattagcgggtgtggtggtgcgtacctgtagtcccagcacttgggaggctgaggtgagaggatcgcttgaacctgggagatcgaggctgcagtgagctataatcatactgctgcactccaacctgggcagcatagtgagactctgtccctaaaaaaaagaaaaaattcttttgatttttgccaaccatctaaaaatgtaaaaaccattcttgacttgagggtaatgataaactgctgggaagacaacccctgctttatatgatactggggcagtctctcccccgaggttctgggactttatccccagtgagtaccacagtgcctggcacataataggcactcactaaatgcaagtggaatgagtgaatgaatgaatgaatgaagtgccctgccctctgctgtcaagctggggtctttacactaagttggggtctctctctgtattcttagggccctcctcaggacctgtctgttcatctctggtgagtagaaacatttatttttgtttcaatgagaggtttctgggttggggttccaggctgggtatgggaggaacctccgagccaattagttatgcattctgtgatccctgagcaccgacttctgaatctagctctgggctgggggctgctggggatgggacagacaaaggagggtccctcaccttgggagatgatggtcttgttggaaggaaaatggttacaatgatgatgacgatgatgacaatgatgatgatgataatgatgatggtggtgatggtaatgacagttccagttgtttttgtaggattttttgttttgtttgtttgtttgttttgcacctatagcatgtcaagcatataggggtggaggtttacagtgtggcttttggagcccgctgacctggattcaaattctgaccccaaccttacctagctgtatgaccttgggccggttacttaacctccctctgtttcagcattcctctctggaaaatagcttaatgacagtatctacttcatagtgtttttaggaggcgtaaatgagtctgtcaagtgcttagtcctggtcctgacacataatgaggactttatacagcattagctgttgttattactcatttaatctgttctaagatgcatggttgttttttttttcttcttcacatttgaacatctctgacattgaaatagctcttgcgatccacagtgtccatcttctgctgaattttataggcaggaagtgttctttcataatggcacataaaagaatggggcattgaacaattgctggcgcatcagctatttaatgagctcctttaatcttcacaaaagcccttcggaaaatagatttgattcttattctctgcccccatactttcttcttttcttcttcttcttctttttttttttttttttttttttttttttttttttgcaaatgaggctgagagagggtaagtgaattacttaatgtcacatggtgaggaagtgatggagatgggatttgaacccaaagcctcagtgcctcagtttatcatctctggctagtaataaaacacagcatgatgatgctcccatcttcttgttgcccaggctggagcgcaatggcgtgatctcggctcactgcaacctccacctcccaggttcaagcgattctcctgcctcagcctcccgagctgggattacaggcacctgccgccacacctggctaattttttatattttcagtaaagacagagtttcaccatgttggccaggctggtctcgaactcctgatctcaggtgatccactcgcctcagcctcccaaagtgctgggattacaggtgtgagccacctcgcccagccgacgctcccatcttctaagtgtgtaccacatagtagcaggtgcactattgccatttataaaaaatgtgcatctgtggcgtctccctcttttcagaagaggaaattgaggcccagagaggcaaaaccagttgccgaggtcttagaacacgtaagaggcagggtcaggatttgaatcgtgctctcctgcgttagcgctccttccgcccttctgcgccgagatgtggtcaatggggtggggaccagggtgagaccagggaggctctctcgtgggtgcaagatttaaggggacgctgaaaatctcagtcattaaggtccatcatgttttaatgcaacattaaaaaaaatcaaaaacaagccaaaaaaatttcgagatgaacaaataccaaaactgtaactaaagacaggatccaatagagccgggagtaagaggaggtgggtgaggtgagtcgggcagtcagattctgtctttattcaaaattttgatgtttgttcatcatggtttctttgcattcattaaaaaaagatgttaaacaccaactcgaaccagatttgcattcgttttttaaaattgaggtgaaattcggctgggcgcagtggctcacgcctgtaatctcagctctttgggaggccgaggcgggtcgatcacttgaggtcaggagttcaagaccagcctgggcaacatggtgaaaccctgtctctactaaaaatacaaaaaaaaattagctgggcatggtggcgcacgcctgtagtcccagctactcaggaggctgaggcaggggaatcgcttgaacctggcaggcggaggttgcagtgagccgagattgcgccattgcactccagcctgggcaacagagcgagactcggtctcaaaaaataaacaaacaaacaaataaataaataaataaaaatgaggtgaaattcatacaacataaaattaaccttttaattgttactggcatttctatttctattcatatttacatttatattacatattaacatttacatgatgttagatattatatgcaattacatatgatttataattaatacttatcatttatattgtgtatttatgtttacaacctattatatattataccacatatcataaaatatatttatattatgctatgtattttcacaaattaatgttttttatttatgttgcacatttatgtttatattatattataccatacacaatatattataataagatttataggttacctatttactttacattatattatatttatctacaattatgtataatatataactaatatttattctttaaattgtatatttacatttatatcatcttatcacatattataccatatatcatagtatatttatattacagatttgcatttatattatgctacatattctagagaattaacatttattatttatattgcacatttatgtttatatatcatatgcgttatataatatactatactgtagctttatatattacatatttacatttacattatgttaggtgacataaaattatatattatgtataattaatatttattatttatatatgttacatttatgtcatattgtacgttatgtattttaacatacatttacattaacatgatgtatttacacttatataaaattatatattatgtataattatgtattacacataattaatattctttattgtatgttacatttaaatcatgttgtacattatatactataatatacattacattaacaagagatatttacgcttatataaaattatgtattatgggctgggcacggtggcttatgcctgtaatcccagcactttgagaggctgaggcgggtggatcacttgaggtcaggagttcgagaccagtttggcctacatggtgaaaccccgcctctattaaaagtacagaaaattagctgggcgtggtggtgtgcacctgtaatcccagctactccagaggctgaggcaggagaattgcttgaacccaggaggcagaggttgcagtgagccaagacagagcgaggcactgtctcaaaaaaaattatatattatatataattatgtattacatataattagtatgtattatttatgttgcccatttacatttataatatattgtatgttataccatatattatacatttacatagactatatatggtgtattccatgtaatataaatattacatgtatatttatattatattcatattatatattatagggttatatataactatctatattaacatatagctatctacaatagatagttatatattattatataatgattatatattattatatataactattatttatattgaatatttacactcacattataaatatattcatgttatatttatattcagtggctttttgtttttttttttttggagacagagtttcgcactgttgcctgggctggagtgcagtggtgtgatctcagctcactgcaacctccgcctaccgagttcaagcgattctcttgcctcagcctcctgaatagctgggattacaggcgcccgccatcaagcccagctaatttttgcatttttagtagagacgaggtttcaccatgttgcccaggctggtctcgaactcctgaccttgtgattcgcccacctcggcctcccaaagtgctgggattacaggcgtgagccacagcgcccagccagtgccatttggtatatttgcaatactgcgccgccatcactgccgtttagctccaaaacattctcagcacccccaagagaaaccccatcccgggcagttgctcctgcctcccgcagcccccgggaaccaagggtctccttcctgtctctgtggattggcgtgttctgggcatttcctatgaatggaaatcacacagtgtgtggccgtttgtgcctggcttctctcactgagtgtgatgttttaaggctcatctccattgtagcccatgtcagtgctgcttcccttttgatggctgactttattcattttgatttctaagaatattgtattagaatactgtttgttttacttattgtcatttaccttgatgactaggttttttggctctcacttacattttgcacctgaggctcgtgactcattctccttcccctacttctgtccgggtgaccacagagatgggcacacagtgagccttcaggaaatgcctggtgaagccatcgccaaattccagacacccagccagacccaaagggctgagccatccccccgaatccatgtgtcaaaccttagtggtgacctgtagaagtggaagcccgctccccatgtctgggctccggcccctgcctccacggggcctaccttggtgctgaagggctgttagagccaggctgtcaccaacttaaaaaatcaaaggggttcagggggaaaggcaacctccatatggcaatatggggacccaggcacggggaccgtgccacctctgtccttggtgtctctttgcaggtacgcaggccccatggagcgggcaggggcagagagcatcctggccaaccgctcggacgggactttcttggtgcggcagagggtgaaggatgcagcagaatttgccatcagcattaagtaactcctttctccctgactcatacccttttggggcctgggccctgcgggcctgggaaaaagggtatccaggttttactttatagaagtgtacggtaatagcatccaccttttactgagcccctgctggttcccacgtgcctttcaccttctttatttcttttaattgacgaccacaagaaagagatatgattcctatagaggctcaaaaaggctcttaaaattaattaattaatttgagtcagagtctccctctgtcgccctgacctttcttttttcccctttttttcttttcttttcttttctttttttttctgacagagtccctttgtcgcccaggctggagtgcagtggtgagatctcagctcactgcaacctcccaggttcaagcgattctcctgcctcagacccccgagtagctgggattacaggcgcctgtgaccatgcccagctaatttttgtatttttagtagatacggggtttctccatgttggccagcctggtctcgaactcctgacctcaagtgatccacccgcctcggcctcccaaagtgttgggattacaggcgtgagccatcgtgcctggcctgaaggcttttatttttaaccaattttcatatatatgttttttctttttttttaacttccaggaatttctaatttttttaatttaattttattattattattgttattttggtgacagtctgtctctgttgcccaggctggagtgcagtggtgagatcttagctcactgcaacctctgcctcccagattcaggggaccctcctagctcagcctccccagtggctgggactataggtgtgcaccaccacatccagctaatgtttatattttttgtagagacgagggtctctccttgttgcccaggctggtctcatactcctgaccttcaaacatcctcccacctcagcctcccaaagtgcaggtgtgagccactacatcccacctatatattttttttttcaacttattttagaatcagagggcacatgtgcaggtttgttacaaaggtatattgcacaatgctgagggttggggccatgaatgatcccaacacccagggagtgatcatatactcggtagtttttcagctctttcatcccaccctcctccctctagtgctcccccgagtctactgtttccagcctttttttttttttttttttttgagatggagtctcactttgccgcccaggctggagtgcaatggcatgatctcagctcactgcaaactccacctcccaggttcaagcgagtcttctgcctcagcctcttgagtagctgggatttacaggtgcacgtcaccatgcctggctaatttttttgtatttttagtagagacagtggggtggggggtggggggaaagtttcaccatgttggccaggctggtctcgaactcctgacctcaggtgatccacctgcctcggcctctcaaagtgctgggattacaggcgtgagccactgtgcctggccaatattattcccatctttatgtccatgtgtacccaatgtttaacccctgcttataagtgagaacatgtggtgtttggcttactgtttctgtattaattcatttaggataataacacccagtgcatccacgctgctgcaatgcacatgatctcattcttctttatggctgtatagtagtccatagtgtgtgtatatgtaccacattttcttatccagtccactgttgatgggcacctgggtcgatccatgtctttgctattgtgaatgctgctgtgatgaacatacaagggtgtgtgtctttctggtagcacaattactttttcctttgggtagatacccagtcatagggtagctgcatcaaatggtggttctatttttagttcttcgagaaacctccaaactgctttccgcagtggctgaaccaatttacagtccagcccacagtgtagaggaattcccttctctcacatgctgctgagtttgtaatttcattgttatttttggctcctgtgaatttcccttactttttttttttttgagagctcagcaatttttttctcaacatttctagtgtttttttaaataggaagagttttgtttgtttgtttctttgttttttttttttttttttttgtgatctagtttgccagatgagcaggagtggaggtcttctccaaggccccttttagtctatttccaccatgttgacagaaatgggtctttcctccctcttcctttatatcctatggttgtctatattggtggaaggggaggtctcttcgtatccattctagaacactgccttctttacaagatcttactgacttctcaacaaacctgtgagtcagggaagatgattcctcttctacgagaggaagacattaaggctttagagtagcaaaggccccagggaatgggctctgttgggacagcttgtctttggtttccagtagttactcctccctgaaggggtcaaggttgcttcctccataactggggcttggtggggaatgggcctggtccccagactcagggcccggtgaccatctggttccagatataacgtcgaggtcaagcacattaaaatcatgacagcagaaggactgtaccggatcacagagaaaaaggctttccgggggcttacggtaagggtcaatgtccgctcaatcccagctttccagaacctaggaggaccctccctgcacctccgccttgggacccccttttcccacattcagggtgacccccctccagtggcactacagtgcaagtgaccttaaacttatgctcttaatgatgaacaatgggaataataatgaataacagcagttgaatattgacagagcacttaagtgtaagatatgttcatttttaaattttatttatacatatattcaagcattatgtatatatgtatgtgtgtatatatgcatatatacatacatatgtatgtatgtgtatttaaattttacttacgtatatatacatatgtatacatatgtatgtagggtacatgtatatacgtgtatctgtttatttttatatatatagatagatagagagagagagattgagagagagaaagagagtcttgctctgttgcccaggctggagtgcagtggtgcaatcatagtacactgcagcctcaaattcctggtttaaataatctctcgcctcagcctcccgagcagctggtactataggcatgcaccatcatgcctggctaattttaaaaaaaaattttttttttgtagagatggggacttgctttgttgctcaggctggccttgaactcctgggctcaaataatccttctgtcttggcctcccaaagtgttgggattacaggtgtgagctactgcattcagccctcaaatatgttatagatagaaacctaattaatcccctcaaccttctttctgagttcccatttcacagatgggtaaaactgaggtttactcctcgtctagcttcactgaatggcagagcccatagcttgtctttgcctaatctgctgcataatcatttcagcaacaactcaaatgccttttgagggttcttgcttctgtttggtgccttgtaattttcaaccatattttagacactttaggcctaatgatctaaggcatatggtttttacccatggtctgtgggcccttgagaagctgagtcctctgaaagaaaatcagaatgttgcatgcatctgtattttttgtcttagatttcacttgattctcaaatggatccttgactcccccaaagtttaatttattcaacaaatcttttttttcctccatactttttattctgaaacatattcccccaatttttaacttctgaaaaatttcagacaagttattggaatagggtagtgagtatctatgaacctttcatataggtttactttaaaaaaaatacaagagacagggtcttgctctgtggcccaggctagagtgcaatgttgtgatcatagctcactgtggcttcaaacccctgggctcaggcgatcctccctcctcagcctcctgaatagctgagactacaggcatgcactgtcatgcctggctaattgtttaaatcttttttagagatgggatcttgctatgttgcccaggctggtcttgaactcttggcttcaagtgaacttcccaccttgacttcccaaggtgctgagattccaggcatgagccactacatctggcctgatgatgattgctaattgtaaattaaggcatgtggccccatagaaggttttgaatttggtgagctaattatctggtaaatttatcacgaagtaagttagtccactattgaaagaacctgtttttggccgggcacggtggctcacgcctgtaatcccagcactttgggaggccgaggcaggcggatcacgaggtcaggagatcgagaccatcctggctaacacggtgaaaccccgtctctactaaaaatataaaaaattagctgggcgtagtggcgggcgcctgtagtcccagctactcgggaggctgaggcaggagaatggcatgaaccctggaggcggagcttgcagtgagccgagattgcgccactgcactccagcctgggcgacagagccagactccgtctcaaagaaaaaaaaaaaagaaagaaagaacctgttttaggcagtgtggtcccttccccataaatagtcctggctgctcagggaggtgatgaactccccatcatggggagtattcaaggggtcactttccaaagaggccagaaacagggcctgcttcatgtgaggagttgcatatggctgttcctagctctgcccccttatgggctggcccgctgggatagcatctgccatgtggtccgccttctaggagctggtggagttttaccagcagaactctctaaaggattgcttcaagtctctggacaccaccttgcagttccccttcaaggagcctgaaaagagaaccatcagcaggccagcaggtaggaggtctcagactgggggcttacagcctcagccccttcccattgtggagggaaactttggggatgccattgacaccccttccaatggccttgcagaggtcatatctgtgcagtagcaggaacccctttccactcctgtctatcccttcctatatatattttaatataatataatttaattaattaatttatttattttttgagacagagtctcactctgttgcctaagctggagtgcagtggtgcgatcttagctccctgcaacctttgcctcccacctcttgggttcgagggattctcatgcctcagcctcaaaataaaaaaataaaaataaaaattccaaaccagtcttattttctggctgggtgcggtggctcatgcctgtaactccagcacttcgggaggccaaggtgggtggatcacttgaggttaggagttcaagaccagcctggccaacatggtgaaactccatctctactaaaaaaaaaaaacataaaaatcagccgggcatggtggcacaggcctgtaatccccgtgattcaggaggctgaggcaggagaatcacttgaacccaggaggcataggttgcagtgagctgagattgtgccaccgcactccagtctgggtgacagagagagactttatctcaaaaaaaaaaaaaagtgttattttctaaattcagacgggaggatgatgctgggagtacaattgtgtccccttacagtacagggcatctaatactctgcagaaaagagcactgaggagccctttatcctggagttactgtcctgagagcttgtgcccccagagagtgagtgggtatctgccccagacccttttctcacttctgttctctctccacagtgggaagcacaaagtattttggcacagccaaagcccgctatgacttctgcgcccgagaccgatcagagctgtcgctcaaggagggtgacatcatcaagatccttaacaagaagggacagcaaggctggtggcgaggggagatctatggccgggtgaggcaggcagggctgggtgacggggagggcatgggggttgagctggtggtggacgagactggaactggggactggagaaggtgaggtgcggctcccatggagatctctcacggtgggagggaaggaagggacacagggatgtcatttatgcatttatgcaacctacctgcatgtattcagcacctgctgtgtgcagacattgtgctgggtgtcgaggagacagaaacaagcacggtacaaggattgccctcatgaaacttataatcgaatgtggaggacagacctataaccaagcagtcatgacactgagtggtcaagactaacaagggtgccagtcacggtggctcatgcctgtaatcccagtgctttgggaggctgaggtgggaggatctcttgaggccacaaattcaaggcaagcctggctaaaatagtgagatcccacctctacataaataaaaataaaaacaaaaacattagttgggcgtggtagtgtgtcccaggtactcaggaagctgaggtgggaggattgcttgagtccaggagttggatgctgcagtgagctatgattgtgccactgcagcctgggtgacagaacaagaccctgtctttaaaaaaaagaagaaagaataaaagagattgtggtggagaatcacagggcagcgtgggagcactgagggagcccctgacccaccctaggagtggatcaggatgacttctgaaaggccaaactgattaataagggataaataaagtcatgcaaatgaaaaggttgtatatgtgttgggggaaagcattccagacagaaggaccagtgtgtgcaaaggccctggggtgagaggtgcctaatcagtactgaatatacaaagaggtagagctgggactaaaccactgtgctcactttgcctgcttgaattccgattccaaggagtggaatagacttcaaatgtcttcaagtccacttgtttctgccaagttctcatttttgttccatgaaggcagagcaccttctttatttcatccactgatgacttctcagcctctagaattctgccttatgatggatttctcagaaatatgtttgtgtaatgaagacaaggacagtggttagagtttacattctactggggaaaatatacacaaaaaatgatgtggataattgcatcgatgaggagttttgttaaaacattggagggtcagtttaatgagcagtggaggacaattaggctttgagagaggcttttggagcattgaggaaggattgggatgtaaaggattcatccatccatccatccatccatctatccatccatccatctatccatctatctatccacaaatcatccattcatctgtgcatccatccatcttagcctatgcatccatccatttcaacctacgcatctatccattcatccacccacccttccactcacgcatctatctaaccatctatccacctacccacccattaaaacattaatctatccattaatccaccatccagccaacatctattcatccatttctatctgtgcatccatccatctatccatgcatgcacccatctgttaatctatctctatatttatccatccatacacctactcaccagtccattaattcatccatccatccatccgaccaccatccactcacccttccaatcaccattcaccaacccaagtatccatccacccattcatctatctatctatctatctatctatctatctatccattcattatctatctacctatctatccacctacccatcaatccaataatccatccattcatctatccatccagccaaaaaatattcagtaagtatctactgtgtgccaggaactgttctaggctcttgggattcagtgacaaataatacagacaaaaatccctgctggccaggcgtggtggcttatgcctgtaatcccagcactttgggatgccaaggtgggtggatcagttgaggagaggagtttgagacccgcctggc

SEQ ID NO: 13425 - DNA, 16500 bp, Human
aaataactaccttgccaaaatccttccaacagctaaccactgcaatcagaagaaagtctaaactctgcatggaaaaactacaaggtcccacaggatctggcttctgcctacctctctaacctcatctcctctctctcttgttcactaagtcgtagtcaggcattccctctgcttattattccctctgcttattatgcagccctgcattgccagttcaacgcatctgggttcaaagcctcagaaagcgtcctgaccatccaaaatccttaacctatactaatctgcattctctacccccgattacattctttcatatcctctttcgtgttctgaaattgttcactgtcaacttctttcccattggtctctgtaaactccctaaaggacaggactttgtcttttcaaccctgaatctccaggatctagccccagggccaggttagggtgaggcaaggaagcacaggcctcaggtgcgtttacggggatgaaaaaaatttaagtcatcaagagtgacactattttaacatttttaaaaatgaaaaaggcaaaaaacccatgatgaactaattatcaaaattttaggtaaagacaggatccacccagcacttgtatgattcatcctaatcctggccgcgccccacaactaattatcaaaattttaggtaaagacaggatccacccagcacttgtatgattcatcctaatcctggccgcgccccaccggactcgtcactaacggtactgaaaactgactacagccaagaactcactccgaggctgcagaaaggcaccagagggaaacagcaaaggaggattcgccgttttggagttcacatcccgttgcttcactgggctgtagccataaagctgagttcagggaatgcactgccctacttaagtgcatattcaaattgtgaaaagttaagcatcactaatactccggtacactttcatactgacgtccatgccagccatcactaaaaactcccttggccacgggggtccagcccaagagggcgggcacttctatttattctttttttgggagcaggactactgtctcctacacctggccctttaaggaaaggaacaaaaacccaggggagcgtagctgcacactcagtaaacttaacgttcctataaaccagtagcgtctgaagtgtggttgaaaatacaaataaacgcgcttgcaaggaagaagtgcctcggtcctaccctcggccccgccggaaggccctgggagatgcagccgcaggtctcctgctacagccgctggggaaggccgcacagcctcctcgcccaccccggaggaaaaaatcgcgggggactccagtgcgcaggcgccgacccgccaactccgcagccacagcccgccaaggcgcctgcgcagaggcgtgggtcaaggggagggtcgagttaggagggagagcagagcgcgcgcgtaaatcctagagaggcgggctaagctggactggggggagggtccgtcttccggaaagtctggattcccggacgagccgagttgctgctcaccgaactcccgttcgagagatgatcgaagaaagtcggctaccatttgtacccatcaaagatctccagatggaagccagcgctgaatttgggctgagattaggacttgcaggaggccggtccagaagacggcggaaggaatcttggcgggcgcacgcatgcgtgatagaccctccacacgtgtggccgggccgcggcctccccgtgctcggaggtcccgcccccggccgtagcatctttccggacgtggggagccggtaagctggaagggggctgggcttcgcggctcggccccgcctcggcagcctccaattgggcgcggacgagggcgcccccacccactgccctcctattggtgcgcgcatgcaagcgacgcgtctcattggaccgcgcggatttaggcaccaaattcaaagattttaaaagtaccagctggcgccttttaagagatacaggtctgtgaagcaggcaggttgctcagctgcccccggagcggttcctccacctgaggcagactccacgtcggctggcatgagccggcgcccctgcagctgcgccctacggccaccccgctgctcctgcagcgccagccccagcgcagtgacagccgccgggcgccctcgaccctcggatagtgagtgaggggagcggtcgcgaggggggcgcgcacgccaggaggggtgcacggggagggtcgcagcctgagaccctgacccgacgtccctcggagcctggacgcgcggccatgccacacgcccggcctcgggcggcggcagcggttcctgggtccgggaggagggcggctgggtgtcggggggaagccagaagagccagatgtgcaggggcgggatggcgggccgcggggtcccgccacccacgccgaccgtggactccagccccgggaggtgcgggtcgtggcatcccagggcgccctttttcctcctcggaagacccacctaccccaccctgcttgaataggcgccaaatgcccctcccctcccccaccccggggcccccggcggtgacagggctgcgagcgagaagcccccagggcctggccaggtgcctcaccttctccccctgcgccccttttctacatctgccccgcaccctcacagccaaaggcagtttccccgatttttcgcggtcccagccttgctggcgggcgcgggagatcgcgctcgcggttatctcccgcctcctccgcgtgtcccgcgccctgaggggcagccccaccgatccctcaggagttccagggtctccctccccactcccgccaaatggagagacacccccccaactcattggaccaaactcaactgggacatccaaacaaaaacgttactttttcccaattttttctccctttgcccgttaacccagtctcagggcctggagtggaaagggaagactttaaaaaaagcaatttttactacgaaccttgaatttgtccatagtattaagatgattttgtaagaatcgaagaattggtgactttttcccgataactcatgaagaattagatagtcctttatttcaaagcttgcagagaatggaatgcactcaaatgcttatttttatcctctttgttgctacctctaaataaaatctatatgcacttatttttacctgagaaataacccaaaatgaaaaaatttagcaattcggcattgtactattttgtaatgactctattattaaaaaagaactctagaaaaaaatacttaattttaattttaatagattaaatatatttctagaagatcctggatcgtcagtctaccatcgaaattctgaagcttgatggccttatgagggttttttttttttcttttttgataactctaattgtctttactaccttgctcctcagaaagaaatgactgcctgttggaattttttccccagtttacaggtttgaggagatgaaattaaaaatacatatatgttacttccaagtagttttcaaaggaggcttttgtaaaattttctcttaaagattactttatggtcacaagcattgggcctcttaaattcttaaggaatagccatgcctaacgttgaccacatggtcgttatctgtaggtattagagactggaacttaattatttaacagaagagttacaaagatttttaaggactgcagccttatttatgatatttgatatggaggatcaggtctatattgaaaagttaaatgtaagatcaaacattgtaaaatttacttttctctatatgactgggctgggagttggtaaatgagaagtttaaacaatgccatgtatgagtcttattagtgtctgcacttgggggaaaaataggaataggacattccaagttcacaaagctagtcaaaaggctaagcaaggattttcattcaaacttggatctgattcttaaatctatacattctaatggaaaagtatgtgttactctgaaatatatacttctttgtgaaatgtgttttactactttcaaatgttaatgattgtcaatgtaaggaatatgaagggatttggcttatgtgattaaaaatagattgtattgactagacccttgtgatagggactttgccttgcatttagtcctgtttcattgtcttactcccattttatggatgaggaaagtgaggttttaagagttaacttcttcagttttccatactcagtaaatagcactgtataccttcgatactcaagacttaaaccccagggtgtttttttactctccttttcttcatatccagatctagtagattagcagcaagttgactttacccttctaaataacagaccttgaatttatgcagttattttcatttccactacaatccttctagtctgggtttcccacactctacttctgtcataaacacttctaactattctctctgcttctacttaccttcctgcaattcattctccacaattgccaatgatcttttaaaaatgtaaaccaaatttctccacttttgacccagcctaccccacaaatctgcagatcattctacttcttcaactataattttcaataacctcccccaactcagccctacagatatttctcttccttgaacactcacatttttccttgcttcctgtgtttcccaccatctggaactcctccaccagatttccataaggtgttcagatctcagaatgtcagctttgctgaaagatcatccctaattaatatctttctctctccctaccctgtcactgaatggatgttggataaataagtgaaatggttcaactgaactcttagccctcatctgtttcattcaagaggttatgaagccatataatgttttctgtctttctggataataattatatgaatacttcacatatttcccaaatttggcctggtcattggaaaacacttagctagttaaaaggaatggatttaaccttttgcaaacagttgcttcagcttccatttttataaaatatgatgctattctatttcttctgcagtattgttatggaaatgaaaaatacattaatttcatattttaaaattaaatctacaaccaacatccagatttcactctcatttaatacctttttccaaaaaaaaggaaaccacagtgcttggagaaatgactgattctagggctgaaacggaaattataagatgcacttagagcatcttgtagtcccagaaagtaagggatgttcaaaacacaaaatgatttaagtatgtgaaatggacaccaatgtcaactgcaagagctcacaatagcaaaagctggaacaatttgagcaatacagtaaatagtattggattataacccaaagtctatgagtttatactgatataaatgattggtagtatgaataaataggagattaatggacaaatctgctgtaaagaagaattccaaatgatttataaatttactccccactcctttaagtgtgaggtgtacatagtgacttccttccaaaaagtttcaaatggaaaaagaacaaaaaggagtaactttacatttggagcaagctcagaaatactacctcagccaagtaatcaaggctaacaacagttcaaatcatagcaccttacctctggtctaaaaacccacagccccagactaaggctgagaaaaacttgacaaatcctaattgtggaacaggctacaaaataaccagtatttctcagagttgtcaaggtaattataaacaaggaaattgtcatagtcaagaggagcctaaggagatatgatgactaaatgtaatgtatcctggataagacccgggaacagaaaaaagattttaggtagaaactacagcagtccacataaaatagggattttagttaataatgcaacaatattggttaatttgttgtgacatgcattactgttagtaatataagttaagcaatgggtgtacaggaattctgcactatccttgcagcttttctgtgaattcaaataagtttattaaaattcttttaaaatactaaacctttttttttcttttttctttttttttaagacagggtttccctctgtcttccaggctggaatgcagtggtatgatcacaactccctgcagcctcaacctcccgggctcaagcaattctcccgcctcagcctccctagtagttggtaccaaaggcacatgccaccatgcccagctagtttctttttttaattgttgtagagatggagtctctttatgttgcccagactggtctgaactcctgagctcaagcagtcccccaacctcagcctcccaaagtgttgggattataggcatgagccactgcaccttacctaaatactaaatctaattatccatgtgaaaatactgttgttgcaagaggaacgtggtagtcattttaactccttaagtgctaatttcgtgaggaagagtacagattctaatgttggtattagctaacaaaaaaaaatgggaaacacatttttatatcatatgtcttcattgtgtcaggcactgccatttgcttggattttgtcataagcagtaacagttatgtctggcctttaaggaaattaaagtactttttaaaatttcaatttggtagtgctttagagtagagtttgatgaggtctgagaagtcccccgcccccccccccccccaaaaaaatgaagctctccatgagtaatggattagaagctaaataagcaaaggaagtggaaaagattctaagcagggaaaggcatgatgtacaaagcccctgggatggaaaggtcattgttactaaggactggaaaagggccagctcacatgagaaaagaaacgtacacattttcttctttagtaccttaagtgcgcttgcaacataaattctgacttttctatcatttttataaacagtatgaatgttatttgtaagatctgtttttccagagcacctcattataatgaggaagagaaatctggctcatttaattaactgcctgtattgggcaaactaagctacacttcagtgtgctcaattgtaaaaataacaattccccatcctacctcaaaaggtttgtaagcattggaaattgcaaacttctaaacaaatataaaggatttgcatcattattagctctaattttaaggaactgtccatattcaaagaacagtgttgaatgaaagaggttctataggacaaccccccagtaactgttctaaagacagcagaaagagaatgactttgaattcctgaagtattttcaggcctttttggtttaggcagctaaacaaagcagagtgtgcccttcataagtggcttctgcttttttatcctgtcatgtaaattgtggtcatatataaatcaaacctaattctttagttgatttgaggcaaaaatagaggcaatctcttggcattttttacttttcctctgaataaaactaaaccactcagaatcatttgttctaggtttagggttaattagggagctagaatttgtatattctttgctttttatgcagctgaacccttaattttaggtttagtaggatcctggagcacatactatgtgtctttcactgtattaacattgggaatttacaagcagtttctctctacaagttactttctatgaaggtatccatttctactttgagttaaaaagttttgctctatgtaaaaaatggttaagttttatatgaacgcattaccaatatttagtgcagactaaacatactgatgctgtatacatttacttacaggataaattgttagctatatatgattggcttgtgtggggatggtagatggggcacattttaacctggcatttaagattcaggctttcttagctcatgtccccattgtttgcctactcttactctctgccttcaacaatgctaaacagttttctgaacccatctaccatattccttcccagcattgtgccgttgctcaaattgtgaatgcccttcccaggccactgttgtctgacaaaatcctaatcattttttagagttgtggttctcaactgaagaatagaggaaattttgcatctggcctttttccctgcccagtatttggcaataactggtaactggagacattgcatcttgggagtgggggctgccactggtgtctaatgggtaaaggctgcttaacatcctacaatgcacaggacagtccctgagaacaaagaggtattcactgcaaaatgtctgtagcacagggatggtgaaatcttgctttaaagctatcttaagatgctgcctgctccattgtgtcttaactgatttcttagatcctgggggttggagcagggtggtaataaaaccctgaacaagtctttcccttttttctatttatcattaatagcaagtttatcttaagttatttaaagcaattgaacagtaatttacacctgctgccctatcactcatattcttaaatctggttaattgattagagtgtcattcttatttaccaacacttacttttgattgatagcagaactattcatacttacggttctttggtaaattagtcgtggaatgtctttgttcagtgattaaagagcagtttccagcacatattagacaaggtacagggagatgtcccggtactcgagtttactatccagtaaggtagacaaacgctttgaatatattagaaggtcaccaggagcacccatcagaataaaacttggagataagagctgtgggaattcaggtagactttaatttatagatgtttaaatgtgttattagttcttttctccaagctacctatagatttcttgaatagttattttaaggcttgcaatcattgctaatagtgaaataatacacaaaatttttattatttttatcaagattattcccacccttataccttgtcctcctgtactaatcttaaccacttttgctgtcagtggcttgggttgtgcttacgtcaaagagaaccataatgtcatttcaagtccaaggaataaacactgaatctaaaagtatttgtggttactttaaggataactttgaccatagcgcctactcttttgatacatcacatttcttcatttgttccataaacacagatgtttattatatagcccctttttccactattttttactcaatcagttatagacaacagtcaggtgttacagccaggcagatccaaaagcagtctgttctgaagtgccttctcaagaataatataatatgtatgtacttataagatttaagtaatattttcacatattattgtcatatcaataattaaacttgaataacatcacagctatgtaagcaagtacatgtagacaatacctaatgctgagagattgcaaagtaatctttgtatatcccaatttaagaagtagggatgtgtggaaattttgccattaagatgtaaatgtcatgttctttttataggttgtaaagaagaaagttctaccctttctgtcaaaatgaagtgtgattttaattgtaaccatgttcattccggacttaaactggtaaaacctgatgacattggaagactagtttcctacacccctgcatatttggaaggttcctgtaaagactgcattaaagactatgaaaggctgtcatgtattgggtcaccgattgtgagccctaggattgtagaacttgaaactgaaagcaagcgcttgcataacaaggaaaatcaacatgtgcaacagacacttaatagtacaaatgaaatagaagcactagagaccagtagactttatgaagacagtggctattcctcattttctctacaaagtggcctcagtgaacatgaagaaggtagcctcctggaggagaatttcggtgacagtctacaatcctgcctgctacaaatacaaagcccagaccaatatcccaacaaaaacttgctgccagttcttcattttgaaaaagtggtttgttcaacattaaaaaagaatgcaaaacgaaatcctaaagtagatcgggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaagtaagtactgttttgaatatacatattagcataatacactgaacattgctgttagtggctcagtaccaccagctcatgcaaaggctgttgtacaggttgagtgtccctcatctgaaatgcttagtaccagaaggatttcagatgtttttcaaattttggaatatttgtattataccctacaggttaaacagttgaacatccctaatccaaaatccgcaagtgctccaatgtgcatttcctttgagcatcatgtcagcattcaaaagttttcagatttttggattagagatgctcaacctgttgtagataaccttacaatgttgtttaattgcggtaatgacttgctggtgttttgctacctatgtgccactaagatgaaagaaaacttgaattatgcatttaacctagtcatttcaaattttatattcatgctattacaaaactatttctgttggattaggatccttgttccttttagttttgaaatttctaatatgtaagttacatctttggggcttaactgtaaaacagcctagttccagtctacatgtctaataggcattatgacttgtcacaccagaaagtatgaagtaatttttgttctttctaagccatttttggtgctagggctctcctagatttgacagtgatgaaaatataaagatccacaaatagagatttgtgacttttttttttttttgagacagggtttcactccagtcacccaggctggagcgcaatggtgcaatcttggcttactgcaacctccacctcccaggctctgtttatgacaatttcttagaaacctggtgctaaccaccatttctttctcaatctaccaaggaaaatcacttagtcagataactttgagaattaaggtgattatgcaggctagaattagataggacttaactggagttgtttttttttttttggctttttgaaaaattatctagaggtactctttgcaagtgtgagtttacactggtctttatgaaacagagctaaagcaaaacagatataaacagcttctttttttttaattttttttggggacggagtctcgccctgtcaccaggttggagtgcagtggcacgatctcagctcactgcaacctctgcctcccgggctcaagtgattcttctgcctcctgagtagctgggactacaggcgtgtgccaccacgcccagctaatttttgtatttttagtagacacagggtttcaccatgttggccaggagggtatctcgatatcttgacctcgtgatctgcctgcttcagccttccaaagtgctgggattacaggcatgagcctaaacagcttcttgagggacagtcaaatcagtaccacagattctactttttctgttaacatagtgagtttctaaagttgatttctaatagcagtgtgcctagagtactttgaaatttgtctattacttttaccagatagctaacatggtatcatatatacagtgggggctactatttgatgtttgcagatattgtgaaaaaatactgtacaaagcagtggttcttaagcctcaatgcactcagaattacttaatgaggagggagctttttaaaaatacagagccctgagcttcattttagaccagttaaaaccgccaggcaattgtaatgtggtcaggtttgagaagcactaataatataaaatatctttttgcactgctgatgtttttctactgtattcatcttagctctttgtgatgctttaattatttcatttatggtgatttacttttccagtgtgtctaaagtgagcacaacttggaagaagatcctagaagatgataagggggcattccagttgtacagtaaagcaatacaaagagttaccgtaagtgtttgcagatgatgtttttagttaaaaatgcactgttagtgctcttctagaaatagaaaagaaaagaggtaatctggaaacccttctttacagtcataaagtatttcagccttatactggaacttagaaaccacattcaaaaataaagaaatctcaactcaacatttatttcttggattcttcctagaaatagaatgtctaaagtaacaaagggaaaattactcatttctcagatagagtcgaccatttagtcaatcttagttgccagttgtgtgtatgtgtattttataacatctggaaaatttggaaaagctgttttactttttaggtattaagtaccatatagactgcatctaaagtgatttcccatagtatttggttcacagtttctgtctataagttaggcttgatatgtgtgagtatttaggttttgctttgtttaagtacgtgcaggtaaattgcatgtagggataagtctcttacctaatcttgtttgtcatttcttatatgtacaaacataaaaatgtctcattgaggatacaggaaataatttctaaattctattaaaacttttttttaaattaggaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaaggttctacttatagtcgacacaatgaattctctgaggtaattttttgtctaatcataaatcttaaaacataagagatttagagtaagaaatgtaaaagaactttcaaggtcaaaatgtaactttgctctagataataactaatttattctctgacattaagaaacctgatattaatgatcatttaaatttaattatagtataattagaactattagggatttcattagtgtcctcttcatttcgctctcaatgtggaaaacaaaagaaacatgaaattaggaaagtacgtagaaatgtatttctatgaatattaggtactgcttggcattgtttgaaagttcagtgattttgagttctaatttagaaacactgaagaaataatgaaaaacctagatttcttataaaattactcagtactacattttgcattttccgcttttaagaaccgaggaagagagttaagtggaaaaaggcaagctttctgaacttgaaggccttctattataccttcagatcagtgaatgatgtgtgctaaaatttctactcaaatgtagataactttgcaagcttaatttagataacttaccaaaattatagaatattttctgattcatgttgatcagtaaatataaatcctacataataaaactattcttaaattttatgccataatgactaatgcaacatacagatttattcaaaaagcatttattgagcatctatcagatactgcatagataaagggcaatagttagggcagtagttatcgtatgtgtgacagtgatatttcatacatgaattggggaaggtgcaagggtgtccttggttttattaactaaagtacatgtaattcttgctgaaatttgttaatgggttttttttttctttttaggttgccaagacattgaaaaagaacgaaagcctcaaagcctgtattcgctgtaattcacctgcaaaatatgattgctatttacaacgggcaacctgcaaacgagaaggctgtggatttgattattgtacgaagtgtctctgtaattatcatactactaaagactgttcagatggcaagctcctcaaagccagttgtaaaataggtcccctgcctggtacaaagaaaagcaaaaagaatttacgaagattgtgatctcttattaaatcaattgttactgatcatgaatgttagttagaaaatgttaggttttaacttaaaaaaaattgtattgtgattttcaattttatgttgaaatcggtgtagtatcctgaggtttttttccccccagaagataaagaggatagacaacctcttaaaatatttttacaatttaatgagaaaaagtttaaaattctcaatacaaatcaaacaatttaaatattttaagaaaaaaggaaaagtagatagtgatactgagggtaaaaaaaaattgattcaattttatggtaaaggaaacccatgcaattttacctagacagtcttaaatatgtctggttttccatctgttagcatttcagacattttatgttcctcttactcaattgataccaacagaaatatcaacttctggagtctattaaatgtgttgtcacctttctaaagctttttttcattgtgtgtatttcccaagaaagtatcctttgtaaaaacttgcttgttttccttatttctgaaatctgttttaatatttttgtatacatgtaaatatttctgtattttttatatgtcaaagaatatgtctcttgtatgtacatataaaaataaattttgctcaataaaattgtaagcttaatgtataccttttataaacattgtaatcctggaaacaactgaattaggaagctgcagtagactgcgtttgtgtgaaggcattgaatggatttttgtgatggtttttctggggagcttgtgagatttttgggcagtaccctgatcccggtttttcccacttaatagcttaattcagtagttgtggggttgggtcttgagataaacatctcgagatgattcaatacaggaaggccataaaagacactgataaatactgatgtgctaatttgtctatcactaaaccagctgaactatggattaaatagcaccccatccccctcaaaaagctagaaggatttaaattgtatagaataagatgccatcttggctgcagtcaaacatttgtgctaataacaagagcccagaacaaggatgtctttattccttaattccaaagttagttatgtttcagtttcaattacgaatatggggaaatcctaagaggctgaattcagactaggccctccaaagattcaagggtgggcctcggatgctatcagttgggccccaaagatgtttaagggctttgcctttcgtctcaacaaaaacctaaggtagagggtccctcctgtcaactcccaggcaatcactgatctttgtcactgcagacttttcaaggattttctataaatggagtcagtttgctttcactgaaggctattttgacactcatctgtgcgtgtgcatcagtagttaatgctcttttcttacaaggcagtatgctgttggatataccagttcaccagttgatggatgtttggctctttactccatttcctgctgttacaagtaaggtgctgtcagtgcaatcaaattagaactcaggattaagaaactcactcagaaccgcacaaccacatggaaactgaaaaatctgctccagaatgactactgggtgaataacgaaattgaggcagaaataaaaatgctccttgaaaccaatgagaacaaagacacaacataccagattctctggtatcattctctggacacatttaaagcaatgtatagagggaaatttatagcactaaatgcacacaggagaaagcagaaagatctaaaattgatacctaatatcacacctaaaataactagaggagcaagaacaaacaaattcaaaagctagcagaagacaagaaagaactaagcaaaactgaaggagatagagacacgaaaaacccttcaaaaaatcagtgaatccaagagctaatgttttcagaagatcaacaaaatagaccgctagccagactaatgaagaaaagagaagaatcaaatagacgcaataaaaaatgataaaggggatatcaccaccgatcccacagaaatgcaaactaccatcagagaataaacacctctacacaaataaactagaaaatctagaagaaatggataaattcctggacatacactccctcccaagactaaaccaagaagaagtcgaatccctgaatagaccaataacaagttttgaaattgaggcagtaattgatagcctaccaaccaaaaaaagtccaggaagggacagattcacagctgaaattctaccagaggtacaaagaagagctggtaccattccttctgaaactattccaaacaatagaaaaagagggaattctccctaactcattttacgaggccagcatcatcctggtaccaaaaccaggcagagagacaacaaaaagaatttcaggccaatatccctgatgaacatcaatgcaaaaatcctcaataagatactggcaaactgaatccagcagcacctcaaaaagcctatccaccatgatcaagtcggcttcatccctgggatgcaaggctggttcaacacatgcaaatgaataagcgtaatccatcacaaacagagccaatgacaaaaaccacatcattatctcaatagatacagaaaaggccttcaactaaattcaacagcccttcatgctaaaaactctcaataaattaggtattga

SEQ ID NO: 13426 - DNA, 12861 bp, Human
tttttctggaagcatccaaaagttaagctggctacaggacctctggtttacaattcatttccttgaaagaaaagaagaaataaacacaattctataaagtctgtgaattaaaactttgaacctgcagatggtgctatgattccattttcaaattgttttgctttctagtttaaattcataagagaaaatgcagttgtttggttgagtttacttttattcagaggtaataaaattgaattatttctttttattttatcttattattattataatagaagcaattgtcttttgtattgggaaaagctactatagttactctttgtaaatgctaagtgcttgcctaggccaaataatgatcagctttacatcttttatgtttaaaatttttcttcttatcattcagcagtcatttgtctgtgaccctcaattaagttgctttgctgtttctgctcttaaataaaattggttcactaagaattgggtgatgaagagctaaggataaaaaaattccatatgagaactgtttcaacctctagtttgtaataatcaggtaaaaaagatttcctggaattaagccacaggaactctggcttaagtcagagctgtcaactgggaaacaaatttccagacattttgaaacttaattcatttaatttttctggtaactggattagaaaatatgattaagcatagcaggatattcttttactggatcagtctgactttgaacgaaggaaatagatactacaatcttaaagtagaagaaagaggactgtaaagccattctgtcttatgaaacttagaaacaaaatgtaaaaataatacacatggcagaaagcctttaaaataaaaggaaaaatggcattttcctctgttgtttaggaaatttttcatgtggctgcatttttaccttaaactctgattgaatgtgtgctagactacctttagttacaaatccacaaatagaagtgaagtatttatcaaagtactatataaatgcttttcaactatttgaagccacctgtcaagtgattgaatcagaaatgttcaaaactggtttgagtatgtgtgtgtgttggggatgagggtagaaaactaattctacattatgcaaagacttataaaagtgatgaggaaaatctttaaaaagaaaagacaattaaattccttgaggtatatagcctgacaacaatttattttttggatcatttgacacagtgtatgtaaaagtgcattgggaattgtgccattttatacaaatatgaaatagcactacttgtactgctttgtacaacagcgtgcatatcttactatcttagagactttctgaaacacttatcttggaattagtttcaacaaagacgaaatgtaataataggaaggtgaaaattatctctagagcttttaaagttaggatagatttcaagaaagattaaatctggaactatatgaatagcataaaaattaaaaatattaagagaattgatactttgtaataaagtataattatacttttataagcgtaatgaacataagtgtttgttgctttatgcatttgtttctacacatgaagtctttattttctgaaggaatcccaatggccctggctataacactacaatcattttcttattttacaattaattaaaggttaaaacatttcacattgagcttgctactttgtttgtttaaagaaaagtaaatttcctcttatcttacattttgaagttgctcactataaacttatataaattaggcataatgacaattaagtaagaacttcaagccctattcatcccatggccgtcatactgtgacgtctttcagagcactttgtgattgctcagtcctaagtataagccctataaaatgatgggctttgaaatgctggtcagggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgaggtaagtgaaaactttacctttcctcttctttttccctcctgcctctggaacttttctcacaaaataatgaatttttctctcttgaaaagaatttgatagtgctttgcttttgcaacagcaaaaaacaagtttctcaagtcacctggtaaggatagaaatacttcaatttctctcatatggatagattttctgaattcttttgtttgtaagatgctttaccctgcttgctcttttactgaatactgatttttacaaataattcattcaagtaaagtttacttgtatgtagatttttgactgaaaatttcagtgggaacatttgcttttgaaattttcaacttatttttaaagtgctttttttttcctatttcgtatgttggttaagtgaatctaagatgcatttattttttccttaagtttaaattccataatttttataggcagcaagagaaacagaccttactcctaggcttttaatctagaaactagaaatgaaatgtgtaagttgattaaatgcaagaaatgcaagctttgcttttaatatatattttcctcttatggaaaaatttatttcaatgacaacatatgattcagtaatattttgagtattaatattcactactgagttaagaagttcaaatccaggtgtaaggaaataagtttccgtaatatctacaattgaaagaggaaaaagtaatgtatatacaaaatcttttttaaaattatatgtatatatacacattatatttatacatttgcacacacacgagcagaataattattaaatagatgatactctagtcttatattagtcagatactgaaattttaaagcagaagaaaatcaatgtcttgaagctgtttccttcgtcaaaaaatacactaagcttgagtggtacatccctgttatgaaaagattgtccccagggttatttccagcactatagaagtatggcattcaatagatactggggccaaccatgtgcccagacagcaggtgaaaaggattctaatttttattcaagcacctgtcactgagagaaatactgatttttgaatgtatcatcttgcaatttaactctttctacaagatgaaaattactctttacaaactctgcaagagccattgaaaattactgctagacaatcagaattaccttgctggtgacatctttggctggaagaactgaggtgattctctctctttagaggcacagaaatggacaccagaaataaggcccagctccttgtgctcctgactcttctcagtgtgctcttctcacagacttcggcatggcctctttacagggcaccttctgctctcaggtaagttccctttcaattcaaacatctgaacattccttcctcatctaaatgggaatttcctatacattttgttggacaactaaatagtataaattatgtattatgtatttaaatttttccttgatgtgttgagtgagaggtgtttgtcaacatcaggtcattctgagtcctggaattcactttcagggcatgagagacactgtcagttattagttttatgggctgagtggatcacattcccaaacatggtgaaaggaggctttcactttctttttattcaaaaccatctttagataaataataagcttttatccattgttatctcaagtcagttcaatttctggtggaaaaaagctgtttagttgccaaccacatttgagtttattttcaagattaatcagtaaataatcataagactagtagttgattagtgaaacatgtataaaatcatgttgcacagaaatctatctaggcagagtcaatttgccaatattaaatatggggtaattgatctattgagatacactcccccaataggaaaattttgatatactttgtttggaccataaatccttagttttattgttctatatgttatattatatattccaaatccataaagtataacacaactcttatttaaaactttattaatgtatgctaaagaagtaaacaataaatgaaaactatattagcttgaattttcctttcagtttacgggcaccactgtatctccaaaggaaaaataataattgggttggtttccttctttgcttattaggtcattcttgattttttgcttaaggtagacttatgctcaacagagagaataacctcttagctattagtgttctctgtgaaatctgtttaaatacagctcctgcgttgctttgataactaaacaaaatggttctatctgaatagttctaccacagcagatgaacaatcacaagaatgtggacatttgtgttgattgctaagcttcagacccacagaggactagttgctagtgactcccaactcccaaatcactgaaagatacacaagtgtccaggagctgacacgctccttggatgtttgccctaacagtgaaaatctgcacacacaaaattataagagttgccggtgattgaaatatgcatgcatccataaatatagtcatattccatatatgcatttgactattcttagtctttcagtgtaacattgtacatcccttattaaagttgtgttaatacataagattagaaaaaagaaggccccataaaacttattgaattcaaattcatcttcatagatgagctatccatctatggagacattctttgaactctgtcaatacagagaaatatataatgccaaagtaaatatttgaagcaaagcttgggggtcgagagagagagaagcagttaatactctgttcttcagagatgtttggaacaggtaatactgaacatcaccaaatccataaattgttatcagttctcattcaatattagttttttgcaagtttctattttgcataaaatatttctacatacgaaatttgactttgcaaagtgaagatattcttggcatagtaaattacaccaaagaagtatagtttgcttaatgctctgataagattgaattaagtagctcttgtgttttgtatattcagcttataaaagtcatatggcatctactttataggataataggaatttcctatttatactctcattaactatatgagccattaagtcaaattatgctattctcatattatgactgggtaatacttcccaagagtctaagtatcttattttaaatggttgcggaaccatacacactgtcttctgaaaaaagaatgtattattctcgtgtaactttccccatcaggttgggtgacagaataccctttgagggagcaaatgaacctgatcaagtttcattaaaagaagacattgacatgttgcaaaatgcattagctgaaaatgacacaccctattatgatgtatccaggtgagtttatttttataaaactatccaatgagttttattttagaaaatgtgtttaagaactataaacgtgcttattttatctcaccatgaagctattccgatagcaaaacactagaggtttctatgtgtcatggcttcattcatcctgatttactgcagatcttacagctgtacataattttcatactgaaaggttgtaacaagccaggatgaacacaccattcacttccattctgttgcacataattccaacatcacagattgtaccaattctgataaaagtacagcatttagcattccaatgatggaagagttgccaaggagttttgtctctatataaagaaaagatacctgatagagctgttcattcatagagctgtttgtctagagcatcatttcaagtacagaccaagtagctctatagtacttggtacagacaaagtataaaaggtgcttcatttgaaagagaaaaggtgggatgataggccttaatgccttctctatcttaagagattttgtttccaaatattttggaaaaagaaaaaaaaaggtgtactggggtttatgaactttccaaaatcagaatattttcccattgtgaatgtctttattcagtggggcagacacaaagcaccatgtacaaatagcagctaatttaaatagatcatatttttacaccaatatttcttagaaagaaatagttataaagattcaaccatggaggaatattgaaatgtgctcctagaaatgcctgtttctttaatttttcagtgtcttgggctagaaatatagggtatatcttgatataagtgactagaagatctcttttgttagggtgttaagaaatctccttttgaactttagttttaatgagaagctttcataataagcccataatttttttgttatttaataagccataataatattctagaaagccatttacaaaataatagctatttttttcttccttgttttagaaatgccaggcatgctgatggagttttcaccagtgacttcagtaaactcttgggtcaactttctgccaaaaagtaccttgagtctcttatgggaaaacgtgttaggtaaagagaatttattatttttataaaatatgttatcattattcaatctgaatattgtattttcactcttaacaagttatttactttgtttgaaattgaaaactcgttgataatgtttaatttagttaaatgaaataacttgtattcttcaataacatctatcaagcccatggactaagactttttcataatatcatattcattgactccagacacacatttttctcaagtagcaatcatttagcaatctgcaatcaaattgaacaagactcagtaaaacaatcaaaaagagatagtacagactgaggtaaattttaaggtcaaacagaatattctttttacttcctgctcaaattaaatggagaattccaaatggccaacagtcaaatatttagatgacgttgctcagggtagcatagcttctaaagaagtaattatgttttttttaaaaaaaaaaaaaatttctcccaatggcagagcacaacttcagctattcccaaatttttatttttggatgaattatttgctcagctgtacagaatgtgtcataaaacagtcccaggccatgccaaaatatggcagatgattccttgctttccttcatccttaggtttagttgtatttttcttttagtctttttatgatagaaaattagttgggtgggaattgctttttatgtggctccaagaaacctggaacatgtgtgtatttatcatttcttgtgaaaactctttgatttccttttcctcatgttccttagcagtaacatctcagaagaccctgtaccagtcaaacgtcactcagatgcagtcttcactgacaactatacccgccttagaaaacaaatggctgtaaagaaatatttgaactcaattctgaatggaaagaggaggtaaagaaaaagagaacttgctaaaatgaggaatcatgactgactttcaaaatagaagctgcacatggagacctctctatctcacttatctagctatactacgtgaagcagtgattttcaaccttggctgacattagactaccccgcagaactttaaaaatacagatgtctgggccttctcccaaaccaattgccaggaaatcggtgtcttcggtggtgtggccctagacatacatttcttttaagagttccccagttgactttactatgctgccagtgttaaaaatgatgactatacagacatctagtctgaatctaagagcaagtttcatcaaaagtgatgatttttaaaacatgtaaagcatagtcaattgcaatttggtaacacatggaactcacttcgtgtgcatattcactactgttatttaatcaaattaaaccattaggtattttgtatatttagattctgtaaaatctatatctctctatggtgtgtaaatattggacacaatacataaacagtgtagtgttctgtctttttattccaattgtttttgtttaagtgatgagtattaaggataattctgtttgggtgtgatcagacaagatgacctctttgcccactagatgataattctgtgagaataattttagaaactctaagattgatgaataattcataggtactaacaaacctcaaagataattgtttagcctccccatacactttcagagcacagagaacagcacattcattatgtcataatagtttctttagaccctttctcatctgagagccttaatatgtacaatgtttttctggtctgcagcagtgagggagaatctcccgactttccagaagagttagaaaaatgatgaaaaagacctttggagcaaagctgatgacaacttcccagtggtgggtatattcgtgcattccttctgtattcttatggctgtctctgattatataagtagctaagagtcacttagtaagaaacatcttagggttaaatagtttctcatcatgagacctcatccaagacagacacttctacaacagtggaccccaacccagtaaacagcttagaatgattcatgaaatttttttgatcttgtaaaagagagcactcacaataagcaaacgttttgagatctgaatagtgttcctggcttacttggggttatttctacctttgtatcaagataaaaaaacagaggaggctgactcacactgacaagaaaaatgggctttccttttgaggatcgacccatgctgcttttattaattgaaggtttagtctcacaattgactgttagctcctcaattaagtatagggaaatagcaccaaattagagcatggcccattactatgaaaatatcaaggcattctgggtctaactatattccttgaaacatggcaaacttcatagagcaaaagttaaatttagcttgttttacctgtaagtttgttttacctatatgactctaatagcattctctgccaacattttttttgagcagaaaaaacatggatagactttttttctttgtgaagtaataagcttgctatcaaaattgattttatataaatgtgggttcaagacatatttctttcctgagttacattacattaatattcacattcgctcataaaaaatctataatactgggcaagtgcttaaagaaatttcatgctgtcaccatatcaaaggttagcagattttaaagggctatggagtaaaatatgtttggctttgtgagccatctattttctgttagagtgacttaactctgctatggtagcacaaaagcagccacagttagatgtaaaacgaataggagtgactgtgttccaataaaactttattcataaaacctgaaggtgagccagattccaatccctaactaggttaaggagattaaattcacccatgctcaaactaaaggcaattcatggccttacctcagttcctgatggggttatctaaggttttcaacagtcatcaagagtggacatggtgtctgggaagatacctgcttaattgactgcttttgtccactaattacccttagacctctaagagaaagcagaggcaggagtgtggcccacatcaactctttatcttttatagacatctcagagaaacaagtccctttgctcaaagaagaaagttaattacatatagcttttctaagagtgtttataagaaggcttctccatcaaattaagaaacacggtaggcactaaaatataaaggagaattgattaatcacactgtgctttgtaaatggtaagatcacttatgagattccatcctccattcttttcttttttaaatgggtggctttggacaaattctttgaagaggaaatcatgtgggtcatccattagtgaaaattacaagtgaatcattaataatggttagttagacgtcttttcacattccagttcctctctgataatcagtcctctagaagctgctctcttggtatgtcccaggacatgatcccctgccacaggctgttaacaagggacaaagagaaataagtgtttatcagataagtaaatcagtgaatgaaactaagatgctagaaataaaatatattttatgcctaaagcaacaattttttctttttcagaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataatttttttgtttgattattttatatgattcagcagtaactcattttagctctaaagttctaggcactagatagcttttgtggtatttgattgtgtgcaagttctaaaataatgatggcttaaaataaaagagaaatttctttctcacgtaagtcaagaagtaagatgtcagggttattataatggttctgctcagcaaaaccctcaataacttacaccccttccagctcatccctcatctccaatggtgtggcacttttcctcatgatccaaaattagagctagcattccagccatcacatatgcattccaggcagcaggctataggaagaaaaaagggagcaaatattatatgccagttctctttgaactgatatcttatactaacatcccctttactagtacatagtcttatggccacagtcatttgcaagagaggctgggaaatgtagtatgttttcttttctttttctgggtgatcatgtacccaacttaaaactaagactctattaatataaaacaaggaaagaataaatgtatgcagcgattaaaaataattccaggcttggatcttaaattctcacccaaaaagcttaaagaaataataaagagagcgagagtcagaccctaaccattaatgaagaagcattatccccataaggcaaagttttgcttggtttcattttctacaattaggacaaatggccacatcaggaggaactagtctagaagtaccagtaattgcaaagtagttttcacaagttgaagtaaattgagcttcttgtatctctttttcttatctgattcttcaaattattaaatatttattaagtgacatttttatgagaagcactgcagtgaaaacagacaatttctaagtgttaagtgtacataaaaagcttgtaaagatgaaatggagccataatttgagtgtgtaactaaagagttttaattttattttattaatatgaatcttttcaatttattccctattgcttcaagaaattcattgaagaaatattcactgaatgactatgatgtgctatgtagctatctgagagattgttctgggctgagggaacagcaagtgcaaatgagggaacagtcctgacatatctggagagcaaggaagcccatgtggctggagcagagtatgctggacagggactcagtaggagaggaggtcaaagaagttactaaggactggaccttgtagggcctcacaggccactgtaattgtttgtgaagtgagatgaggtatggcagagttttggacagaggtgtgatattatctgaactgcactttaacaggatctttctggatactctaatgagagaagagtgaaggagtgctaagggtggaagcaggggtacaaactagggggcaagtgctataaatcaagtggcagatgatggtgccaccaaggcagaagcactggaggtattgagaagtataactgaatagatcttaaaagaagagtcaggttttctgagaatgggttgaagacaagaaataggagaggctgggcatggtgggtcatgcctgtaatcctagtactttgggaggctgaggcaggaggattgcttgaggccaggagttcaagaaggaggaaagtcaagaatgacatccaaggtaaatcacctgaggcaacttgaaggatgggattgctatagacagagaagactgggaggaacgagggttcagggaaaggtgagcttagtttggatgcactaaggcagatgttgagtagggagttggagatgtcatgaagaggagatgctgagctgcagatgggcaagtgggagatttcgcatatagacgggatttagaaacacaagactggacgagatcagcaagagaccaagtgttgctaaacaacaaaacacaacaaaaacagaaacctcaacacataatccttgagtgtttttatttcctagtgccaccataagaaggcaccgcagaccaggtgtctcaaacaaagaaatcaattgtctcacagt

SEQ ID NO: 13427 - DNA, 110585 bp, Human
  misc_feature (1)...(110585): n = A,T,C or G
acagtccctgggcttggtctaggcctcctcccctttcccgcagcctcagggctctggggattgctggtcaccaggtgtgcatcctccccacatgacaactgtgtggagaagaaggtctgtgtctattttactcatttaatagggagaaggctgagtggctgggggcagtgtgggactcaggggctctgcccattccttatcccaacagccagggatcgctgggccccccacctccctctgccttctgcccacaggtctagatgccttcatggtgactaagacaagggggcacttggggttgcccctttgataatgagtccagtgaccatctaggggctgagcagaggtgtgggtgcagccatggattcaggtgtggttggccacggattggtgtgctggaaagtgaaccccacacgtgtgtagactcctccctcggctcctgctcttcgtggaaacacaattgattacatgattgagcaagttgttcactaggtctttttaggaagggatgtagtatattctcaaagacctcatgcttctagcagagaggcaaagaaatgtgtgagcaattgtcacacagggagatctggatgcacccactgtgaacccaggtctcagggagcaggagggtgttctatattgtgggaacatgcaggacacacatgggagggggtatttgtgcccggctttgaaggatggctggctctttgcccagggggaagaggccagcagaatgcgctgacagttgggaaccactaggaactttcagttgaacctgctctgctgagccccctgtgccatcggtggacctgggccagggcggctgctgaactgggagctcagaggtaatctctctgaggagctttctaaatcagcaagcgtgtcacaggttgagattctagggatgaggtcctcaatgctgtcctcgattttaatgagcagccttttggccagtctgcactgggtgaagcagaagcaagacataaattgttaagataatttttaaagctgcttaattttggtaaaaacatagaacatagaatttaccatcttcaccaattgtttactatacaatatgttgttttgaacctctgaaaccctacctgctgtttctgtaataaaacctagcccaggccgggcacgctgactcatgcctgtaatcccagcactttgggaggccgaggtgggtggatcacctgaggaaaggagtttgagaccagcctggccaacaaggtgaaaccccatctctaccaaaactacaaacaattcgccgggcttggtggtgggcacccgtaatcccagctactccagaagctgaggcaagagaatcgcttgaacccaggagacaaggctgcggcgagccgacatcgggccgttgcactccagcctgtgcaataagagagaaaccccatctccaaatacataaatagataaagaaataaaaaataaaacccagcccggactgtaaccacgcccaccggggactggggaagtagtggaggggacgcgaacaggcccatggctgtgcccagggcggggtgagccagggaccccgcggcgcaagcggaaggagggagagtgccgcggacccaggcggggacaaggagacgccgaggccgctgaatattcctctgcacgtttcttcaccattaataaaaaatgctataatgattaaatgagtctgtcgtggaaggaatcgtgtcctggcaggagtggggcccgggcacgaggccaccaagctgccggagcgggtgaagaagggaagggacactagcatggaaactggatttcgtccagacaatgaaacgaagaggtggaacgcgcccagtgactacgcccagtagcattaaaatctggcttttcagaaccgaggtgactcattccccggtacattccccagtaactaacagtatataagccagcctttcagcacagaggtgatttcatcttccaggatccaccttgattaaatctcttgtccccagccctcctggtccccaatggcagcagccgccatcccagctttgcttctgtgcctcccgcttctgttcctgctgttcggctggtcccgggctgggcgagacggtgagctggtggatggagcctaagcggggcgggggccaaacctgagggactgtggactgcagcgggtttcagaggagggaaggcttctggaaggacaagggagatctccccgaactgcgcccccagctcagttcccctcctgggctccttcccgccgggtccactccccaaggctgttcttgccccagtaggggcgaaaaagagcagggtgaaaacgaggctggcaggagggtggaggggccagagggctgcgagggctaggtggggcccggattcctagtgcagcccggcagtcccacccgcctttcggaaggagaaaccagagcccccccgggaacagagctggggtcaggactgggtgaaggggggtaccacagggatacaatcacagacgcccccaccagccacaagcctgctctgctctcacctgctctctaccacacaaaccctccagcacccccaggactccctgcctttgttttccccgcacttttcctgtagacactcacctgcacccaggggctcagcagatacccgccacccctcccctcaccatccactgccaccacccaggtcacatcctcttactgcccacctcagcccagctggtcacccctgaggtctccccatccatgaagggtacctcaccacctcctacaccacgtcgcaccttctgcctcttgcctgaggacacaccccaacaaacacaccccaagctcccctcagaacctgtgcaggggggatgggaagcaccatttcctccaggatgaccctgggaactctggtgagtagaggcacccacttctgcccttggggcccagaccgcctgttcttcctacgggggtgtcagcgtcatagagaatagtcagtgtgtagacaggggtcagcaaaccctttctagaaagggaggaaggatgccctgtgatctttgcaggccatgggttctccgtctctgtgtccagtcctgtccctttgtagagcaacagcaggcaatggcaaccttcaaagaggggggaccagatttggaccctgtcctaggttgctgatcccagatcaggggattacagtgtcccagtgccccatcccctagggtgtcatctccaagtgatgtctctgatgtcagttggaaagtagaaggtggccctaccttgcctgtggcttctgggtggtgtggatgtgatgggagtgggggtcccatagttgggggcttattctcccctcctttgtgctgagtggcatccatggggaccatcaggtaccctccctgaagcctcaggtgtgagctgagggtgagtgggtgcagccacgtggtgtcctggggatcaggtccaactgcttgtgcaacttcttggttcccggtggccctgctcctgcccatcccagaagaaccacctgcatcttctcactgctgggcctaacttcctaatgacctagagggtgaggagcccaccagtaatgggcagctctgaggccttcaggaataggcatccctaagcttcattccattctggtgccttgtcatggggccttctttatatgcatggcaaaaggccccatctctgccaaggtgcagtactctacaggagccactgcttaatgttgcgatttccttgctgtgagtggcattgccttgtctctgaatattcacatggaatctctgttgtgattctccaattagacattgtgaccacatgtacctctaggatcttagggggtcttgggtcattgggcacttaaggtaggtccagcctcgctcatcattcatggattgtctatggctgcttttgagcttcaacagcagagttgagtagttacaatggagaatatattccctgaacacctttacatgtttacaaaattgcccttcacagcaaactctattggccataaatatctctggagaaggccacaaggactcactgtcctggctgcagggttaaagggtccttcctcactagaaactggtgtcttcttatagtcatgggttcagggtctgagaagtggcttcattctgcaaattaggcaaagcagcctcgttcttgatggactggctactttcagcctcctgatttggtttatctctgtttcttgtaattatttaaatccagcagtatctggggtgggtttccatctcttttggactttggacccctttgttctatgagccatgggcataactttgtataactgaggtccccagctggcattgtgacttctctaatcatttccatcattgcaccctccttgctcctgacagttgacagcctccacctggaatttggaatttcagaattgttcatcccattactctgggagcagatttcaggaacagcatctcctacccccaaccctggccttcagcaataggcatccctaagcttcattccattctggtgccttctcatggggccttctttatatgctgggtaaacaggagtcctccaggtttcccataagcacagtggatggacattgttctggattttcacacttagacccctctggcatgggcacttctctgagcctgtgatctctccctccactacctgccttagactttcagattttccatttcttgctgtgtggaccatctctttgtccaaggtttcaggaaggcctcctcatagcagatgcatgccatcaccaggggctttgccaacatgttaaatcctgtggccatgataattaactcttctttatccaacggggttccatcctcactctgttcaaccagcaccagcatccacaggggtggacccacaccctctcccacctcccgcagtccacgtgggctactgctgaagatcctctgccatccaggcccttcctcctctcttgctagagaggcctggcacctttctagcaaggtcacgtgttgactgatgtgggcagaggggcagtgggacatgtctggggacatgtggtttctcagcagacagagacttcctcctcctcctcctccttgtcctcatgcaaggggcgagcactcgccttaaacttgtagacaccacagttctggagggggcactccttcctgggccagcccagcctgccagaggcatcctcttattgacacagcgtggaggggggctaactaggggtcttttcctccccacccacccctcacctgcctttctccacagaccctcactctctttgctatgacatcaccgtcatccctaagttcagacctggaccacggtggtgtgcggttcaaggccaggtggatgaaaagacttttcttcactatgactgtggcaacaagacagtcacacccgtcagtcccctggggaagaaactaaatgtcacaacggcctggaaagcacagaacccagtactgagagaggtggtggacatacttacagagcaactgcgtgacattcagctggagaattacacacccaagggtaagtttcagatggcccaggacagcagggagcagatacagtggtaggttagaggcatttatagttttcatgtaaaaatacaaaagggtcctgggcacggtggctcacgcctgtagtcccagcactttgtgaggtagaggtgggccgatcacaaggtcaggaattcgagaccgcctgaccaacatagtgaaacactgtctctaccgaaatgcaaaaattagccaggcatggtggcgcatgcctgtaatcccagcaacttgggaggctgaggcaggaggatcccttgaacccggcaggcagacgctgcagtgagccgaggtggtgccactgcactccagcctgggcaacagagtgagactttgtctcaaaaaaaaaaaaaaaaaagccaggtgcagtggctcaagcctgtaatcccagcattttgggaggctgaggtaggcggatcacgaggttaagagatcgagaccatcctggttaacacagtgaaaccctgtctgtactaaaaatacaaaaaattagccgggtatggtggcgggcgcctgtagtcccagctacttaggaggctgagtgagccgagatcgcgccactgcactccatccagcctgggtgacagagcgagaccctttctcaaaaaaaaaaaaaaaaatacaaatgggaaggtcatcttacccctcaagagtctagaggcaaggccaagatgtagcagagagagtaaggccagcaaattgtaaggggaacaggatgggggtgcaaaatttgtcaagatcagagctgatctctctctgatgggggcagaacccctcaccctgcaggcaaggatgtcttgtgagcagaaagctgaaggacacagcagtggatcttggcagttcagtatcgatgggcagatcttcctactctttgactcagagaagagaatgtggacaacggttcatcctggagccagaaagatgaaagaaaagtgggagaatgacaaggatgtggccatgtccttccattacatctcaatgggagactgcataggatggcttgaggacttcttgatgggcatggacagcaccctggagccaagtgcaggaggtaacaggagaaaaagaaacggggatcttaaatgagatcagaaatggtgacctcaagaagttagttcttgagttcagcttcaatcatcccagtgtacacgtttatgttaaaatgacctcctcgtggggcgctcctcctggggttgctggcatgcctgtgccctcccaccctcctcttccttctccctcctgactcctattcctcactgcacttgcttctgctccccacactgtggatttctcaccagccttgaaactgcaggtgtcactgttttcagaactttttccttagtgtttcctcttttgagaatcacttttcctttcctttccctggtctggttctggaaatccatcaaaaccacttccaacaccagccagagatcctcccctccccaactctggggcatcacctcctcttcccccacagcaggagggtggggtgtgttgtcaccttgcttccctcagcagctgtgtgagctccctgaggacaagacacaccccgtctcccttcctaagccaggacctgtcatactggctgccccacaccaggggggaggggacaaaacttttgccttccaggatgacctagggtggcaggaactgaggaggtgtctcctcagatttggggcctggacaagggttgtcacttttgtgtttccatttcagcaccactcgccatgtcctcaggcacaacccaactcagggccacagccaccaccctcatcctttgctgcctcctcatcatcctcccctgcttcatcctccctggcatctgaggagagtcctttagagtgacaggtactgtgggcagaattggaagtggagcaaggagcaggtgggtgaggaggcaggatggggaaagagaattcccggagtcccgcccctccccgtggctgggaccttctcatcctaacatgagacaggtgaatgagaccttgtgttgcctgttggcaatgttggcaatgacctgggcagctcagccctgagttctgatggattctcaccttcagagtccagagggaaagggaggggcccataccaaggctcagggtctgttgagcttgagaaggtttagcaagttcaggcctgattcagagcaggttcctattcaggaagggtgtgtggcctgcaggcagcaggaattcagacatgggcagtcctcttaattgggttaggtgcatcatggtagctttacatgaggtgtgacaggggaagggggattccatctctgaggctaagagagatctgggtgtaatcccaggaggagggggctgggagagccttggtacacctaattgaaaaggagggagtgcagggctgccttcccacagaaagtggcttaggttccaggaattaaggtggaaggtgaagagtagaggctgctcaagagaaggatttttaaaaagtcagtcccatgtacccgtggggtttgagtctgggccctgaggcagctcccctgccatcacactcctgcacaccccagatcctgagcccagtcatagccctgccaggagcagagtggactcagaggaaggggcatctgagctgctgctggggttccacgggcaccactgggctggataaggaatggaaaaggtggaacagggacagtcaccttcagaactatgggtgctgctcccagtgtgaggtgatgctcaagaagaaggggaaagaaggatgtttgcctgcaggcccaccaaaggccaagggcacaggaatacagagccctctctttggaagtctgtcccaccccttgccatgttttagaccctgtcatcagatgataaagagggccttgagtgagggagcggacccatcactaccagcttcagacctgtgggcccctccactccatcccctggtcaggtgcagggcctgggctgactctgtgatgtgacaaaggaggaaagaggtaggtccaagctgcagtcgccagggttggggctcaagggaaaaataggtcccttagtgcagggggctctgagacatagagtgactagggaaagattaccgtggaaaagtgatccgggttctctgcctcttaaaccaacatttgggtcctttctgaaggttaaagatgataccaaaaagcccctgtgagcacggtcttgatcaacctcgcccttctgtctggccagctgcccaccacctacggtgtatgtccagcagcctccagcagatgatgatgacaccatggacccaatagctcattcactgccttgattccttttgccaacaatttaaccagtgattattcctaacatattatgcaattttctcttggtgctacctgatggaattcctgcacttaaagttctggctgactaaacaagatatgtcaacattttctttcttctctttttgtttggaaaatcaagtacttctttgaatgatgatttctttctttcattactgacatgattgtcagtaaaacaatcatgttagacttcagacctccagggattctttccatgtcctgaaagagaattgtttaattatttaataagaaaaaaatttatattaatgattgtttcctttagtaatttattgctgtgtactgatatttaaataaagagttatatttcccaaaaacctactgagtttagaattttgttgtattactcagtagagaattaatgttatttcatttttcctccatgatatggagtaataaatgagtgattctgccagactttgtgtggaaaaagagaatctacaaaacatggctgaaaaaaatcagagacaaaacaaatacatggaaaaatatttcatgctcatgggttggagaatcaatatagctaaaatggccatacttccaaaagcaatttatagatgcaacactatctctatcaataccaatgtcattttccacaaaattagacaaatctaatctaaaagttctttggagttaaaaaagagcccaaatagccaaaacaatcataagcaaaaagaacaaagccagagacaccacatagcctgacttcaaactataatataaggctacggtgatcaaaacagaatggtactggtaccaaagtagacacttagatcagtggaacagaatagacagctcagaaagaaaccttcacaccttttaactttcaacaaaatcaacaaaaaaagcaatgaggaaagagtcctaattcaataaatggtgctgggataactggctagccatgtgtaggagaatgaaactgaacctctacctttcaccatatatgtaaaataactcgacatgaattaaagatttaaatgtaagtcctaaaactataaaaatcctggaagataacctaggaaatgccactttggacatacagcctgacaaagatatcatgatgaagacaccaaaagcatttgcaaccaaaaacaaaaattgacaaatgtgacctcattaaactaaagcgcttctccacagtaaaagaaattagcaacacagtaaacagcctatagaatgggagaaatatctgcaatctatgcatctggcaaagctctaatatccagaatctacacggaacttaaacaactcaacaagcaggaacaaaattccaattaaaaaataagcaaagaatgtgaacagacactttgcaaaagaagacctgcaagtggccaacgaacatgaaaaaatgctctttgggaagccgcggtgggcagatcatgaagtcaggagtttgagaccagcctgaccaacatggtgaaactccgtctctactaaaaatacaaaaattagccagatgtggtggtgcatacctgtaacctgtaatggtgcatagtctgatgttggaactatgaaataccttggactggtactttccagtcttttccagcagatggcactgttcatctttcaaatatttcaataagcccagagggtttgccaacagcgagtttgtgccctgagctccttggcacacaacctgggatccacagccaagggctagagaagacaaaagagacattgacatcatggtggaagaggaatccataaagagttcatttttgaggactggggcagttcctcccaccctgcagatcaagatgccctgagggcaaagagcagaggggtactctggtggcccagcagttctgccctgggggaggattctcttctgctgcagtgaaaaccaacaggacgctgcttcatcccaaggggaccaggaagatagatcagagtgaggagctgtctgagtgtttcagatcacacagtgactgcctgcttgatggcttcagaactccttcatgagctgggagacagcccccaaggtgaaaggtgtgtgggcaggatgggctcgacatgacaactctcaagatgacacgcagtttctcccatgtgtttctgtgtgtctttttgtgtgcccgtgtatgtgcatggctgtgtctgtatttctgcatgcatttgtgtatgtgtgtctctgtgaatgtgtgtgcctgtgtggtgtgagtgtgtgtgagagattgtgcctgcatgtctctgtgtgtgtgcatgtgtgtgtgtgtgtgagataacatgcatgtatgaatgttgaattgattttctggttgacttgctgtggagggagtcagggactccagggggcttcctgcccacccctcgttccctgtagccagtagcacaaatggcgtaataaaaggtagtttaatttcatttcatgcaaatgtaaaacttttgtgcttccaaaagaactccaattagaagattaaaaaaaaacttccagaacgagagaaaatcattgaaaatcatatatctggtaatggactgttattctgaatatataaagaactcttccaactcaatattacaaagggaaataacccaatttaaatatatgcaaggaatttgaatagacatttctccaaagtgagacaggtatactacacggtggtctcaaaagaatagaaaattttgggcagcagtttcaggtgactagcaaaagaaatctgttgaaatatctgcagtggctctgggctgataagttgctgagaaacagcatgtggaccaagctgactaagaatgagtggatccaacatggccctggatttgacctaggtttcacctgggacctcattacatgctgataaacacactaaacacacactagccagctccctagcagttctgagaatacccatatttggtgtaaaaattcgaggcaccagagttctgagaatccctgtccttcttccaggaattttcatgaatattccaccccttggttgaagaaaccaggaaaggtggcagcaccaaacccccttgcacctgcctctctcttgagttcccctgcactccctttacttgagtgtgtacttttccttttacaataaatctccgtccttcctctattttcctactggtcttcgaattcacttccccaagcgctgccaagagccccgcaccggctagggtcgcggtccaaccggcgtttagggacctccccttgcccactggcatcagaagaagaatgcaaatggcagtgagcccaggaaaaggtgctcagtgtccacagacctcagggaaatgccaaccgcacccacaaggcgacgcctcaccccgctagaatgggtgaccccaaacactgtgaggctggagggggtggggcctgcgttccttacaaggcagagagcaggagactgagagttggtggagtgtagggctgtgcctgtgtcatcctcttcccattttcctggcggaggtttctctttgttctctggccctccctgcttccttcctctccctttctctggttctccctcccatccttcatttccaaccatcccaaggttttctccgccccacgacatgcatgctccgggtccccagcccagcgtagaaaccaggagccctggaccgcgagcggcgggatccgggaggcgacaacctgacgcccctgccggaccctggacactcaggacctagtgcgtcccggcgccctcctgtagcggccccagggcaaggaggatgggggtcctcgcggggcccacactgtcggagccccacagattcgagtgggacggtgaggtctacacactgagccggtgacaaagtccccgcgaggatggaggagggacctcgtgctcctcaccccaacaggccccgcatttccttgatccttctgacacgggaaccaagggtcccttgccgcgaccagcgagtcatcccaggtcttcgaaaggccgtttttttccggacgctgtggacccggaggcccgggggtatcggccggcagcggcgcacccactccggggtctccacagggcaggacctgggtccggagctcgggcgaagcggacgccctggcggagcccgcagaagccagaatggacgcggaggggtcgaaactgaaacccccaggagcgaactttcccccaaagtcatctgtggttgaaatcagcaatcgcctataacatccccggtgtgtcaacaccgtttggtaaatatctagaaccagtgcctcgtcactgaggcagccccgcgcgcccctgcttgggttccgcgtcccaggaccctcggggcccacaacagatcaggcgagcccatccggtgaccctccctggggctccggccccactctttcttacttcttcacctacatattttcacgtgtttcaggatcgaaaccatgaaaagtcatgtgtgaaagtctcccccgcccctgcctgcatccaatctcattggccacagcccggaatgagacatgattggattctttgaatctttccagggagtctttatgccatttcaaacgcatatgtatagatattcttcattcagacttggatattttttgctcttgatgaaacctgtctccctgtccttcagtttcccctcccactatagtggatgtttcaccatcctctgcccaagctgggtcatcacaatcacagacaagagtgtcgccagcattgccatccgtgacatgagatgctttaaaggtgcattaatttgcacagcaattctgtgtctgcaaatctattctacacaattaaattgagattcatgcaagcacagtttctgcagcatttagtttctctaaaagtaactgactggagaccatctggatcttcagacacagacactggtaacatttgttgtgatgcagtcattctatgtaatgtgcagagataaaaaggaaaagaatctgtatgtgcaggtattggaagatcttgaaaatgtgttattttgagatagaatctgcgttcagcagagtgcctatgggcttatatttgttttaaaaatcagcattgatacatgtacacatctctactgttagtaaagaaaacagtatttccataacttattgccagtctgtttgtccgttttaggaaaaatcaatatagctgaaaagccatggtggcagatattggtcatcacccgccaagattctacactgccttacacatggtcccagctgaggttgccagaggaacaggatgtggaatgcagtcacgtttcagtgaagaacctgaagtcaaactggaccaggtgtcttgtcttgatttctgcctcttcacccaacccccacctggtcaggcagtgaccctggaggagcagggacgatgcttggtgggcagtgaagatggggagccaattttgggagcatggtgaacatggagagtcgggaccccacagcaactggggaggagctggtgtgatgctgggagcactgggaagacagggagcctaggcacagcactcactgctcctcccatctgggacaggattggggtggtgatgagaaaagtttcctgagtagcacaattcccaagcatggcagaatggctcgccctggttgccactatgcccagcccatcctacactttatattctgtcaagagcaatttttaaaacactgtattcagaacatagacaaagataaccaaccacatggggagataaggtagcaataacaggaaccagctgaaatgtgcaacagagacagaaaatacatggaacctctagatcagtcctctgatagaaatataatgcaagccacaagtgtgagccacacagggaattttaaatattctagtgaacacattgaaaaaataaaaagaaacaggtgaaatatatttttacaacatttttaactcaatatgttttaactaaatttttttaaccaaaatgattatttcaacatgtcatcaatggaaaaatgaataatgagacatttgacattttcatactaaacctttggaatttggtgtgcaccatatactgacagtacttctcaatttaaactagttgtattgcaagctcttaatagcctcatgtagctagtaactgctgggttagactttgcagctttagattttagaatgatcttgccgggcgcggtagctcacccctgtaatcccagcactttgggaggccaaggtgggtggatcacctgaggttgggagttcgagaccatcctgaccaacctggtgaaaccccttctctattaaaaatacgaaaattagctgggtatggtggtgcgcgcctatagtcccagctactcaggaggctgaggcacaagaatcaattgaacccaggaagtggaggttgcagtgagccgagatcatgccactgtaattcagcgctaaccagcgagtgagactctgtctcaaaaaaaaaaaaaaaaattagaattatcaggcacggacttaaaaataaattttcctggttttcttgctctgttgttgctatggcatgtggtgcctgccagttacagctaaacagtcagttttgctgtttctaggcaggaaaatgctcgcatcacaagtaaatgtgccaggcatcccaggaggtttctctggtaatgtatattttcattagtcaattccagtcttaaaggtacaattctcctgactttttaacgttttcctagggtgccatcctgtatgtgaaatccaaaattgatgatttcttctcaaaggcagtgttaccataattcacaccatttagatatattataaaaaagtgtttaaatctatttaacattgttcattaagcttctgtcagaatcataaaaacatcttgtcatgcctgattaattcaactgagttcagttttgaaacagcactgctgttctacaatgtgctatttattgtttaagcctagaattcattagtgtttccaataactgaaagggatggagtattttactaagatatctgtcataaattgtaataaatttaagacagtgggccggttttatgaaatctataaaatacagaaatgataggaagtaaaaatgaatttaatatagttctagccctcattttgtctaaaagccaatgttcagtgaaaacattgttgtttttctctcctgcaaacctgaagcaagtaatgctagaaatgtgattttctacagaactgacaggttggtaagatgatgcatgactgaagtaatatcattcaactatttaacatttatagcctgggaacatgccttataatacggccaaatgcctacaagtttcaatatactcctaaagataagagactttaagctcctatgttcacaaaggagtattgtctgtaaattatgtctcagtaagtttaatatttatgaaaggtggtaggagagaagactaacagtagctgaataagagaaaaacaataagcttgtctgatctacaagtgcatctatgaaaaggtaggttaaactagaaaccattctccacctccttgagactgtgactaacagcctagaacagtacaaatccactggatgaagacaggaaataaggtcaggcttctggctccctcacccatattaccccagagaaacaatggaaggaagaaggaaacatttggccaacagactacacaacagcaaccctggttgcaagataacaatggagtattctttctaaaatatgaaggaaaagaacttcagcctagaattttttatccagtcaaattctcatttaaataggaaggtatcttttctgttgcagccataacaaattgccacatacttacctgcttaaatcagtacatctttattatttcacagtcctctaggttgcaagtctgagatggcttgattggtttctctgctcccagttcctcaaggtcaaggtcaaggtgtccacctgctgggctctggttgggaggttctgggaagcatctgcttccaagtgcactcaggttgatggcagaatccagtccttggacctgtgggactaaggtcccagcttccctgctggctgtcagctgcagcccttccctaactcccagaggcccctctccagtcttgctcatggcccccacatctcagagccagcaacagtgcatggaatccttctcatgcttagaatctctctgacattggacgcatctttcttggctccagcctgagaaaattctctgctttttagagctcatgtgatggcactgggcccactcagagaatccaggaaaatctctctattttaaggttaactgatgagtagctttaattatgactgtgcagagcctagactagcggtacctagactctcagtacctagactagcggtgcctagactaggagcagctggtttctctaggcccctcaccccttactctctccatccccttcttcctggccccccttttctttcccgtttgcattcccactttcatactccttccttccttgcttaaaatactggattttcctgcggctggtatgctccatgctcaatgaaacaggctaagacagtggttagttgtcctatcatcagtgttttctataacatatcgttctagaaaaggtacaggaaacttgaaggggcagcttccaaatcctacccactgcagtgtattagaaatattcgaaattatagaaaacctgaaggatatttgcctcctaaagatccaagttggaaatagttcagaggaaggtacctcaacagcaagagaaacacaggagatgcgacaagagaaccaaggaggacaagtgaccaaggaatccattccagattactgttatctcacaacaaggggaaatgtgaagttaggatcacagaaacaaggaagtgtagctaagaataaccgagaattacagctaggaaaattatcaggaaaatggggctggaggtggcacgtgaaagggataggaaaacatgctgagacttctaaaattaggaataaaacaaaaccaataataccaataaatgtgaatacatattggtatgagtcataggttaagggcagccaccctgagaagaaaactagaatgtataacttttaaaccaacagaaaagaaccctcagtatactaaatggaacacagctacggaggggaaatgccagcattaaaaaacacaataaatacatgtgcaccaggcacagtggctcacgcctgtaatccctgcactttgggaggccgaggtgggaggatcgcttgagctcaggagttcaagaccaccctttgcaatataggcagaccccatctctacaaacaaatacagaaaattagcccagtgggtggcgcatgcttgtagtcctggctactcggaggctgaggcagtaagatggcctgagcccaggagttagaggctgcagtgagctatgaccacgccattgcactccagcctggacaacagagagagctagtatcaaaaaaaaaataaaaaataaaaaaatggcatagctaaatcctaaacagtaataattaacaataaacgtgaattactaaactcatcacataaatcagcgaaactcccaggttggattttaaaatatcgaataatatacagtattttaaaaaggcaatgttaaatgtaaagattaaaaataaaaggtgctgtatctgccaagaaaggctactttgtttttttgtatttgtttcttttagcgactacaatatgctttatagttcttggaaaggactcagggtttggctttaaatcaggctgcacgctcttcatcagtctcacatctctctccccatgccaggctggctccagcctgcaatgctgcattacattccagggagacattcaggagcttacagaagcctcccctcctcctggcctccctgcagtccaagaacccccatgacccctgtttagggtccagcctggaactcaccgacccgacccaccctggaccatcctggcaccaggaacagaagctggatgcagacacccaactctgtgccagcacctgtgccactggggacctggagcccagggcgtgacacacccggaggaaacagagggcccccacgtgagtcaccgaggctctcgatgctgtcacagctccagtggccccgccccgcccacttgcaactccaggccctggggctggaaatacttggatcctggctccctctcagaccctaacccttcttttctccttcactttcctcctggcccccttatcttttcccaatgccattcctgctttcagactcattccttttttgcttaaatacaagattttcggctagggcgtagtggctcacagctttaatcccaacactttccgaggccaaggctggcggatcatgaggtcaggagttcgagaccagcctggccaacatagtgaaaccccgtctctactaaaaataaaaataaaaataattagccaggtgtggtggtaggtgtttgtaatcctagctactgagaaggctgaggcaggagaatcacttgaaccaaggaggtggaggttgcagtgaacgaagattgtgccactgcataccagcccgggcaacagtacaagattccgtcaaaaataataaaataataataataataataatgacaacaacaataacaaaggcaagattttcctggccatggtgcgccctaggctcagtcaaaccatatgaagacagcagtttgctgtccatcatcacactatgttttctagaagtttctatcctgatgaagcaccccagactggttgaaaaccaaagttactcttccttggaaaatctttgtggacacccaggtgggcatacaaatttccaagttgtggccgggagcagtggctcacacctgtaatcccagcactttgagaggccaaggcaggtggatcacctgaggccaggagatcgagaccagcctggccaacatggtgagaccctgtctctactaaaattgcaaaaattagccaggcacagtggcaggcacctataatcccagctacttgggaggctgaggcaggagaatcacttgaatccaggagccggaggttgcactgagctgagatcatcccactgaactccagcttgagcaatagagcaagacttcgcctcaaaaaaaaaaaagtagggacatggatgaagctggaaaccatcattctcagcaaactatcccaaggacaaaaaaccaaacaccgcatgttctcactcatagatgggaattgaacaatgacaacacttggacacaggaaggggaacatcacacaccagggcctgttgcggggtagggggagggggaagggatagcattaggagatatacctaatgtaaatgaccagttaatgggtgcagcacaccaacatggcacatgtatacatatgtaataaacctgcatgttgtgcacatgtaccctagaacttaaagtataattaaaaaaaaaaaactaaaacacgaaaaatgggcaaaaaattttaccaacctcaatgctgccaccttcaggcccctggaggttacatcctccgctccagctcccctctgcacctgtgctattcctcccagccccactcactcccacaactgtctcattcattcactggttcactcagcctccaaccacacttacatcatgtcaggctcaccaggtgatggagaaaaaaatcatcctctgtgggtctgaaaaacatgcctgagtcctgattgcgggtctcgctttcatttccaccccctcacagcacactcagggccatgaagaggccgcggcctgggttcagagctccagctctcctcagggtgggcctggcagttgctgacttcagggagggcggcagggctcacaactgaaataggagacctgccctgggtccttagcatgtgcaaggacagggttccttgtagaatctgctcatttcatctgtgttcatagcatttgtcattttccacatgcggacatccatgcccagaaagctgaagaaccttgcacaggaatattcagctgcaatatcagctgacttccatgtctgaatgcatgatctctaaatcacagccattacagtcacttttgggccacttctatgcccatcctgggctggcctgagtgtggtggccaaatgccggcagcaggggtgaggcaggagggcccaggtgtgcacagaggccccttctcctctcacctggctatcctgctggaggctctcctgctggcctccttctgccttcctcctgttcccccagtcactggcccaggtcacccagcctcacgagtggtgctgccagggtcttcccagtggcctacttccaggactaacccgggttccttgtccccagccctatgcatgggaggctcttctcacaacacagatccccagacccaccaagctatgcccctccgaagtctgagaactgctcacccccgtgtgtctgttggcctgcagaccgctctccatgtggcccttcctggacagtggctttagtgcatcaggcgagaaccttctaggctcctgtgtccctgctcagtcacagaggtggctgccctcccatgaccctgtcctgaagcagagacaggccctgggcttggtccaggcctcctcctctttcccacagcctcaggaccctagggattgctggtcaccaggtgaagttctccccacatgaagactcattcaatggagaacgggctgagtggccgggggtagagtgggctcagctctgcccactcctcaccccaggctaagccctcccttgccaccagaggccactgggctccccacctccctctggcttctgtccatagatctagatggttccatggtgactcagaggaggacgcactcgagtgtcccctttgaggatggttacagggaccatccagggactgagccgaggtgcggatacagccatggatttgggtgtggttggacatagatgggagtgcagcaaagtgagccccacccatgcgtagacccctactatcgggttctgctctccatggaaacacaattgatcacatgatggttgatcacagtaggcctctagggctttcttttcttttttttccaaaagtcataaagggatatagaatatactcaaagacctcctcatgcttttagtggagaggcaaagaaggtccgctttggactggggaggcggctgcgcgctggacagagagggtcggggactccgcgacgcaggcggagggagggggtgtgtcgctggcgcaggcggtgacggggtcaccgccgccactgtatattcctgttaagtttcttcaccttcctgtgcatcagtgtttacattggggtaatgataaatgctgtgttgaaaaattaaacgaggcagtcatggaaggcaccgtgtcctgccccgcgcggagcccggtgacgccgccaccaagccgcggggccgaggtggagggggagggttcgcccgccggggccgctgtcacgtgacgagccccggagcagggcggggtggagcatgcccaaacaaggcagccgtcggatcacgccccttggatcccagcctgcggcggggcggaacggggctggacggggcggagcggtccaattcactagcctgaatgtgaggcaccaggcgattcctccgcccatatccgcctcgaccccgactcccgtcccctgtgccccaggtccccaatggcagcggccgcttgccccgcgtttcttctgtgcttcccgcttctgctactgctgtccggctggtccgggtcagggcgggccggtgagttcggggatggagcctaatcgggggctggagcctaatcgggggctggggccaaacttggcgggctgtggactgcagcgtgtttcagaggaaggaaagcttctagaaggaccggcgcgatctccccgagcatcggcccccccgcccccggagttccccgctgcggctcctttacgctgggtccgcttcctgcggctgcagcttgccctgcagaccaggagggtttttaaagagcgcggaaaaggcaccacaggagggtggaggggccaacgggctgcagagggcagggtggagcggggatccctgatgcagctccgcagccctactcgccctcgggaagaagaaaccagagcccccgaaaccctagctggggtcaggacaggggtgaagcggggttccacagggatgcgatcacaaactcccccaccaaccacagaaatgctctgctctcacccgctctccaccctccagcacctgtagggctccgccctggaacttcccctgcaatttgctgcagacactcacctgcacccaggggctcaccagacacttcccaccattcaccacttcctcaccattcacttctgctactcaggtctcattctttcactccccatctcagcccagccctgtcaccccacaggcctccctcacctccccatccatgaaggggcccttagcacctccccacaccaactagcaccttgtccccttttgcctgagggcacaccccagcaaacacaccccaggctttctacagaacttaatgcaggggggacgggaaatcccatttccctcaggatgaccctgggagcgcccgtgagtagaggtgcccacttctgcccttgggtcccagacccgcctgttcttcctactggggagccagggtcatatagaatagtcactacgcagacaggagtcagcaaaccctttctagaaagaaaaggctgaagtcactttggtccttgctggccgtgagttctctgtctgtgtgtcaagtcctgtccctttgtagagcaacagcaggcaatggtaacctgcaagtaaaagggagagcagatgtggaccctgtcctaggttgctgaccccagatgagggcacatgctgtgtcctggcaattgctgccccatcccctagggtgtcatctccaagttgtgtaagttgaagagtcacaagtgtgtcctaccctgcctgtggcttctgggtggtgtggatgtgatggatgtgaatggaggttccatgggtccaggcctactgcccccatcctttgctgctgggtggcatcatcggtacctcagggcaatcagggaccctccctgaagcctcaggtgtgagctgagggtgaggcggtacagccacatggtgtcctggggatcggggccaactgcctgtgcagcttcttggttccctgtggccctgctcctgcccatcccaggagacccacctgtgtcttctcactgtggggcctatcttcctaatgacctaaagggtgaggagcccaccctgtgatgggcagctctgaggctgtgtggtcactgccctcccatagctggaggcccatctccacaggggcccaggaccacagcaggagccacttttaaatgaggggatttcactgctgtgagtggcacagccttgcttctgagcactaggggatcctgttgtgattctgcggttggcaattgccatgaaatccacatagcaccttttccaaccacacatgcctctgggatcttagggagtccagggtcaaatagccatattggtaggtccagcgtcacccctcatcacagagtgtgtatggctgcatcccagctacaagagcagagttgagtagtgacaggggaggtcatatgaccagcacaacctataatagttactacattaactacaaacactatccattcccggtagaaatccaggaaatgtgaaattaccatcgaatgggtctatgaacccagcacatccccctaagctggacctgacacaggtgtccatccgttactttgccccaaatgcacctcatgagtaacaggaagttaatgcttcagatctctgaaaggaggttggatcacacactgtgtccaccagaagtgtctgggtatttgctgtttcatggtgtacagttaccagagtgaatgcccatctggctctctgggggaggctgaaggagtcattgcagttgctgtggtgttgaaggggcccaccagggcctctgggctctccttctagtaatggactctgggtctgagatgtgactcagttctcaaagctgggcaaaggagctcggttatttcctggggtgactcctttcagcctccaggtcatccatccttgtgttttgtctttgtttgttgtagttatttaaatctagcagcatccgggttgagtttccatctcttttggattcttgacccctttgttctatgagccatgggcacacctttgtatgactgaggtccccacctggcattgtgacttctctaattatttccatctttgccccctccttcctcctgacagttgatggcctccacttgagatctcttatttcaggattttccatccccattactactgggagcccgtttcaggaacagcatttcctaccctcaaccccagccttcagcaacaggcatccctgggcttcctgatagactgctgccttctcctggggccttctttgtatgctgggtaatcaggagtcctccaggcttcccatgagcacagaggatggacattgttctggattttcgtactgcagccactctggcatgggtgcttctctgagccttttggctctttcctctacaccctgacttagaagttctggattttccacttcttgccctgtgaaccatccctttacaaggttccaggaatgcatcttcaaagcagatgggtgtcatcgccgggctttgccaaagtgttaaatcatgtgacccatgacaataatcacttgcttatctaaactgaattctgccctcaccccacccactgtgctggagcatcccagggcagcccccacaccctctcccacctcctgcagtccacatgggctgctgctgagggtcctcctcatccaggccttttcctgccacaacaggcctggcacctccaccacaaggtcatgtgctgactgatgttggcacagggcaggtgagacatgtctggaggggacatgtggtttcatggctgcaggaaccttcccctccatgtactcaagcaagggagatgctctagtctttaattagttgacatgacaggcttggctggggcacatcttgctctgccagcccagcccctcagaggccttcatttgcagtcaccataagggggaggaggggtctcagattccactttcctccacaccaaccctctcctgtgtttttcttccacagacacacactgtctttgctatgacttcatcatcactcctaagttcagacctgaaccacgatggtgtgaagttcaaggcctggtggatgaaaggccttttcttcactatgactgtgttaaccacaaggccaaagcctttgcttctctgcggaagaaagtaaatgtcacaaaaacctgggaagaacaaactgaaacactaagagatttctcccttctctcccacacaagcacactaagacaaactgaaacactaagagatgtgggggatttcctcaaagggcaactgcctgacattgaaatggagaatgtaatacccatcggtaagtttaaaatagtccaggacagcagagagcagacacagtagtgtcttagaggcatttattggtttcctgtaaaaaataaatcagaagtttgtgtcacccaagtggttgaggagcatgggccggatgcagcagagagagcaagtccaggagccaggaaaggaagcagggtggggctcaggatttgtcaagatcagagctgatctctttgcaatagggcagagcccctcattctgcaggccaggatgtcttgtgagcatgaagcccacggacacggcagaggatcttggcagttcctcttcaatggacagactttcctcctctttgactcaaacaacagaaagtagacagcacttcatcctggagccaagaagatgacagagaagtgggagaagaacaaggaggtgaccgtgttcttccataacatttcaatgggggattgtaagacatggcttgaagactttttgatatactgggaacaaatgctggatccaacaagtaagtgagaggtgaaaaaaggcagctctcttgagttcagatcttatcagcccgttgtgtgagtgtgtgtgtgtgtgtgtgtgcgtgtgcgtgtttaagtgagtgtgaacatgaccccctcatggggggctcctcctgggggtgctggcatacctatgctctccatcctcctctcccttcttcccccgactcctcttcctcactgcacctgcttctgctcaacccactgtgcatttctcaccagcctcaaatctgtgggtgtcatagtgtttctagacctttttcattagtgttccttcctcctagaatcacttttcctttcctctccccctgtctgtgtctgtatatccatcgaaaccacctagaatgccagccccgagaccctcccctccctggccctggggcatcatctcctcttccgccacagcaggagggtgggctgtgctgtcaccttgcttccctcagcagctgtgtgagctccctgaggacaggggacacccccctcccttcccaacccaggaacggtcacagcagcttcctcacagcattgtgggacaaaagctcttccaggatgagttgaggggggcaggagctgaggaggcatcccctaagatttggggcctggacgagggttgtcactcctgtgtttccatttcagaaccaccctctctgaccccaggcacaacccaacccaaagccatggccagcaccctcagtccctggagcctcctcatcatcctctgctttatcctccctggcatctgaggagagttctttagagtgacaggtaatgtgggcaatattgggaggggagcaagaggcagatgggtgaggtgggaggatgcagaaggagaattcccagagtcccacccatccccatggctgggaccttctcatcctgacatgagacagatgaatgagacctagtgtcacctactggcaatgacctgggtagctcagccctgagttctgatggattctcactgtcagaaccagagggaaagggaggggcccataccaaggctcaaggcctgttgagcttgagagagtttagccatttcaggcctgtttcagagcaggttcctattcgggaagggtagtggtgtgtggcctgcaggcagcaggaactcaggcatgggcagtctgcacagtaggagaggagcagcatggctgcttcaccaaggatgtcaagggaaagggcgtccctggaggaggctaagaagagagtgatctgggagaatcccaggatgagggagctgtgagggccttggcccacccagttcctaaggctgcattcccagagaaagcagctcgggtcccagcagttaaggtggaaggtgaagagtagagcgtgtccagggtgagatttaggaaaaggccaggccccttggacccatgggagtccttgctgggccctggggcgatgcccctgccattccgcctcttgcacactccagatcctgagccagctgatggccctgcctggagcagagtggactcaggcaggggagctaagctgctgttggagttccatgctcaccactgagcttggccaggaatgaatggggcagggcaaggacagtcccattcagagctatgggtgcagctcccagggtgaggaaaggctgagagtgaagggaaaagaaggtggtttgtctacaagcccacctaaggccagggaacatggatccagagacctctctttggacagggctcccccaggtcctctagacccttctatgagagggtggagcagtccctgagtgagcgtgcagacccctcattcccagcctcaaggagggtggaggctggaacagggtacagagccaggggtagggttggagggaaaaacatgttccttatttgggggagaggctccaaaatggggagggtctgggagggatcacccaggagaacagacccaggtttttctcagccacttaaaccaacacatcatctttcctcaaggtggaaggtgatatcaagaagcctctgttagcctggtctgggtcctgctctcccttcagggaggccgcctgtctactcaccactgtgcctttctggaaagcaggagttcaagccttagcaagcccagaggcccccagcagatgatgaggacattgtcggctcaacatctcaggccactcattaccttcgctcatgatcccagcagccatttttcttaacaccttctgccactttctctcggtgctaatggatggaactcctgcacaagttttaactgaacaagaaatcccagcaaaaaagcattttctttctacttttttgattgtggaaaagcagacacttctctgaagcatgaccttattcttccaaacagtatcgcttattcttccagtgcatgctggacttcagacctcagggatcctttcgatgcactgaccaagaattgtattaattttttttatttttatggttttttacattttctcatcctgtcaaccatactggagtgaagtggcatagtcttcactcactgtaatctccagctcctgggctcaagtgatcctctagactcagcctctagaaatagctgggactacaagcgcatgccaccatgcccggcacattgttttatttttaggtagagattgggtcttcctatgttgctcaggctagtcttcaactcctggcctcaagcaatcctcccaccttggcctcccaatgctctgggattacaggcatgaaccacagtgcctgttgtagaaattttaaattatttaatacggaaaagtattacattcatgattattttatttagtaatttattagcctagatttatagttaaataaagatgtctattttcaaagaaccttattgactttggaattttggtttataacccagtagagaattaatggaatttcattattctgccatgttgtttttagtaatacaactagggatgctgctagatatcttttggaaacagagactttaaagatcactcttaatttacaagcaggctggctgtcagtctatttacaagcagcctggctgtcagtcttcactactgtcctgatgccctgggggctggcagatattcctgcctctatccctgcttccagaatgtgatgctttctggtttggccccagcccactccacgctcggcagtggcttttctcatcattcttcagccctgaccacgctcacttctagtagaagaaatcctcaccacagatgcatctctatttgtaaaagttattctattcccccacagatgaaagatcaggagcaaactatataaagaactcctagaaattaataaagtgcacctaattcttgagcaaatgctctgagcagttcagagatgctgaagaaacctgtgaaagctttcatagctctgacacaatcaagagaacagtggtctacccctgcacacccaccctactgataattttttaaatctgtctctaccaattggtggacaggaaatggaatatcagagacttcttacattgtaggtaggagtccagattgaatcactactttgacgtctactcaggcagtatccaggacagcggacgctgtgctcatcccactaaccagcaatcccagagtcagttcggggctccaaacgttccagagagcatggagatactagactgctgaccgtgctgttctttgccatagcaaagagttagcaatgaaatatgctagtacagtacaggatgcttttcaatgctgatgaaagatttctcttttgctctacatcagactacaaaatctgaactggcaaaaatgaaccaatccaaatgcaggatgaaaatgttaaacttttccaacatgttagtgaggattgcagatttacacgcaataaaaataatcacatcaatttagatcactttccatatttccaaaaatatacagatctaccactgggacaaatagaacaccataacgtatatatttaggaaaataagggggtaggaaatgcccacatatatcagctccctggtgattaaagacattcttagaacaattgctgaacccggagtggcatctgagcatgaggtggtcgtaatgtctggagtgaaatctaatttggagtttgcacagtggttatctggagattgtcctggtttgcaaggaaaccacagtaaagtatggggcataaggtggcatcattaagatggggcatcagtgtgacagctcactcttaagtagtgcaggcagagaagttctccgtaatgtgcttgcaaccactctgttcattctgattgtttcatatttcttttactagttgaagatagaaattgaagaaaaacttacttttcagaaattgatgtgaatacctccataaatggctgcagagctcctccccttcctgcaaagccagggcctccaggcatttccttctcatccctcagcctcaggcagcttctcctgccccctcctcctctgcaggcagcccccaggcccctctagagaatgaagcagctcaggcccagagtcccttcatcacctaaatatatggcctaatccagatgagactcagatctgtgaagggttggatttccatgggcacaggagctgagggagggttctccttccgcgtggggcttgctttaccacacagccatcgatggtcgcccaggcctgagtctgcagctgtacctcctctccatttggttcatccatgtggtcacttcatttaaccacaactgaggaatccccagcagatcctcgtgtcagtcaccacggaggcatctagacctgtgggcagaaatatgagggacatgaagagcccagtggcccctggctggtggggagggcttagcctggggtgaggactgggcagagcccctgagtcccactcttcccacagccgctcagccctttccccattaaatgacaaaaagtaagcactgacctccctctccacacagtcttcatgtggggatcaccttcacctggtggccatcaatccctagggccctgaagctttgggaaagaggaggaggcctggaccaagcccagggcctgtctctgcttccggacaggggcataggatggcagctacctctgtgactgtgcagggacataggagcctagaaggttctcgcctgatgcactagagcctctgtccaggagaggccacatgaagggtggtctggagaacaacagacacacgggggtgggcagttctcagacttgggaggggcagagcttggtgggtcccgggatctgtgtgtgagaagagcctcccatgcatagggctgaggacaggagcccgggttagtcctgggaggaggccagtgggaaaggccctggcagcccccaccccgaggctgggtgacctgggccagtgactgggggaacaggaagaagacaaaaagctggcaggagagtcctgggcagcacagccaggtgacaggaggaggggcatctctgcacacctgggccctcctgcctcacccctgctgcaggctcctggccaccagactcaggcccacggaagctgggaatggaagcagccaggtgactgtaatggctatgatctagcaattatgcacctcctccagcaaccacggggacccaggacacagttatcaggaatccagagtccttttcaaactcacagaggttggtttttctctccttcatcaagtgaacctgacatgatttaagggtggctggaggctgagcaagcaagtgaatgaaagagacagttgtgggagtgaatggggctcagaggaaaaccccaggtgcagaaggggagctggcgtggaggttataacccccagaggcctgaaggaggcagcaggaaaatcctagctgaagaataaggcaagacaaaaaaagaaaaggcattcaaataggaaaagaacaagccaaagcacctccctttgccatgatgtgattccatacatagaaaacccgaaagacggctggtcatggtggctcacacctgtaatctcagcgctttgggaggccaaagtgggtggatcacgaggtcaggagtttgagaccagcctggccaatattgtgaaaccccatctctactaaaaatacaaataaattagcagggcgtggtggcgggcaactgtaattccagctacgtgggagactgagacaggagaattgcttgaacccaggaggtggaggtttggagtgagccgagatcgcaccactgcactccagcccgggcaacagtgcaagactccatctcaaaaaaaaaaaaaaaaaagaaaacccgaaagactctgtcaaaaggctcctggaactgatgcatgaattcagtcaagtttcaggataccaaatcaatgtacacaatcagtagcattcttatgcaccaacaacattctagctgagaatgaaagcaagaacacgatcttatttacaacagccacaaggaaagtgcagtacctagtagttcatctacctgaagagatgaaagatctttacaagagaactacaaaacactgctgaaaaaaatcagaggcaacacaaataaatggaaaaaatatttcatgctctttgattggaagaatcaatatagctaaaatggccacacttcccaaaacaatttatatatgcaaagctatctctattaaaataccaatattatttttcacagaattagaaaaatctattctaaaatttgtttagagccaaaaaaaaaagaaagaaagaaagaaaaaaagaaaggaagctcgaactgtcaaaatcctaagcaaaaaggacaaagccagaggcatcacattgtcagacttcaaactatactataagactacagtgaccaacacagaccaacactggtacaaaaatagacagttagatgagtggaacaaaatagagagcgcagaaataaacctgcacacctaaagccatctaatcttcaacagaaatgagtaatgggggaaaaactccctattcgacaaatagtgctgggatatctggccagccatatgcggaagaatgaaactgaacccctacctcttcccacatatgtaaaataactagatatggatgaaagatttgaatgtaagtaccaaaactgtaataatcccggaatataacctaagaaataccaatgcggacatagggcctggcaaagatttcatgaagaagacactaaaaacaattgcaacaaaaaaaattaacaaatggggcctcattaaactaaagagcttctgcacagaaaaagaaactagcaacacagtaaacagacagcctgtagaatggggaagactatttgcaaactatgcatctgacaaaggtccaatatccagaatctacaaggaacttaattcaacaagcaagaacaaaaaacccaattaaaaaatgggcaaagacatgagcagacacttttcaaaagaagacatacaagtatccaacaaacatgaaaaagtgctcaatatcattaatcatcagataagtgcaaatcaaaactgcaatgagttaccatctcttaccagtcacaaagtcagagatggtggtgaggctgcagagaaaaagaaacagacattgttagtgggaaagcaaacttgttcagccactatggaaagcagtttggagatttctccaagaacttaaaatagaactaccattcaatcccacaatcccactactcgggatatatccacaggaaaagaattcattttatccaaaagacacctgcaccaatatgttcattacagtgctactctcaccagcaaggacacagaatcaatctaagtgcccagcaacagtgaattgaatgaaaaaaaatgtggtacatagacaccatggaaatctatgcagccatgaaacacaagaaaatcatgtccttttcagcaacatggatggaactagaggctattatcctaagcaacctaatgcaagaacagaaaaccacatactgcatgttcccattggaaactagcagctaaacattgaattcacatgaaccatggacactggagatcactagatgggagggagaggagaggcacctgggctgaaaaaaacacttgttaggtgccatgtttactgtttgagcgatgggatcattgggacaccaagcctcagcctcccaaaatctacccatgcaacaaacctgtatgtgtaccctttaatcaattatataggttgaaattaaaatgaataaataaaataaaatgacataaggccaaaaaaatggggttaactgaccagagttaaccccatttttctctgcactatgaacccaaacccagcttaaaaaaataaactctagtcatttaaaataatcataagttctgtgatgctgattgtataaaaattatacatgaaagtgccaaaaccctaaaattaaacactgtataatggaattacagatgatttccatcttcttctttatacccttactactttttctccattttcaagtgacattttttgtttatcctcaggaaatccttgctgtcagccttctccttctgcacccacctcctccttttccactgtccacctcagcccttcctctggcctaggactgtggcttccttggcactgaaagcacaagagctgcattcagcctcgggagagagaatgacgcagggcaggttgtggaggtggtctcggcattgcagaggaacctaacagctctggtcctctattgcagacggctgcgtttctccaccaggttagctacaaccaagtcaaccttgcccctttcctcattgttttttttttttttttctaattcttcccttcgtacttaaactttatattcttcctcctaacatttctttctacttcttgtctgcacaatatatgctgatttattacgcccagaaaacactggactcaccatgtccatgacagctgcaaagccacagtctccacttgctgaaggggcacgctggtcttggagccattcaaaagccccagccccagagaactctatttggtctatctgggactcagtggaaaagctccattcattgggtttgtcctcctttgacctgctgaggtctctttctaggggaaaagccagatcttcagagcattggctaaaagcaatcattccaactatacaacctcaccgtttgcatgtagggcaaacaagaggctagtgggagaaattgagagaaagatttggggaatgagatgtgcataggggctggcacgtgcccaggaagcacctgagaaggccacatctctgatctttggctgacctggaggttctgtgcgggcaggaagtggagctgcagtggtgacatcagctgcccgcctgagtgcggcaggggcaggagtgcaccacacacacaaagccctcagcactggggagagactcgccggctcaaggcattgatgcaaacctctgtccaacctcacctaactgagcagagactcaagcctcaacatagagtcccaccgtgtcctctggccccctccaatcctctcgtccctcccatcctcctgctgttataggagataagaaagaaatcatttaggtagatagggtaaaaatagtccacggcaaaaaattttccttctaacaaaaaacagctcagaaattgctctctttctaaccccaagcagttcaaagaaatcacttctcttctaacaagagcagtctagaagatcaataaaacacaggtaagcaactcgggcacacaacttcccctgcgcaggcgccgctcaccagcagcctcaaagcaagcaggaatgggatccgcgcggaagccgcacttttggagccccaaggaccccagctgtaaggtcacgtctcggcaggagctgggtgtaaagtcctccccgcgcccagcaccaggctgtaggaggaaaccatcagccgcctctgatttcccctcacctcaagctcggagataataactgtcccctgccgcgatggggtggagttctcacgcgtcttccaaaggcagttccgcccgcgggtcccgctaggcgcccggtgcctgctggtgggacatcggcggccgctgggcgctccctgcggggcatcaggcaatcgggacgggaccggagctcgggcgcagacggtgccacgggagcgcgcagaaccctgagggatgctgccgggcggaactgaaacccctcgcaatgaactttgaggaaaggctttagcggttgaaatccacaaaagcctttaatatcctccctgaggcgcgcaagagacaaaaatgactttagagcgactccgacccgatttcaccacccacagacacacaaaaaccaaccacacagaaaaagtacaaaacccaatccgtgctctttgtgaaacactcatttaagacaataaagaagcagcgctcagatgggagaaaagatttgctaacaatgaagtgaaatgatctcctggaaaggatgggaagcaggagacaggaggagtgaaacgtcaggacttttctccgcgcttcggctccacccgggtgaccaaagccccacacggctcagcgggaagctccgcagtttcccctgcgcggcgaacaccggtgtcctcggcattccgtcgccaggtcccggtcccaaaggcgctggccgagggccccacgttgattcattgcattctggctctgcttctgctgcaggactgtccctggacggcgcgagccggtgagttccaggaatgggtcggagaaagaggagagggcgtcgcggaggacggatctttctgaccgcgccgcacccttctcaattccccatgcagggctccttctgcccctgtcgcgtccctggggctgcttctcccggcccgagaaaacacagtggcggaaacgagaccagaaactaagggcagtgaaacagctggtcgcctggaataaatgcttggtctcgcggccaaggaaatcaaggacggggacgcaaatccacggagtgagattggagcaggagttttatgggagaaaggaaagaacagctctctgtcacagagaggtgtcccgaacgggttgccaggttgtagtaaaaatgtcagagtttttataaatgggccagtgaggagggggtgtcttatctccatagggcccgaagaagcggttaggaccaggtgtgccatctgcatagggcagagtctctagcagcccacaccccattctttgatcatacagtcaggctcttggtttgtgttgctctgcgctgcttacctgcctgtgacaaaaggggatgaagagtttctgtgcctgttcccaggcgccttcttgcagctgcaggcatccccaccccatgcgcgcttccggcttccctatctcagtgtgcctaaagaaatggacaggggccaggcgcagtggttcatgtctgaaatcccagcccattgggaggctgaggccagtgaatcacctgaggtcaggatttcgatatcagcctggccaacatggtgaaaccccgtctctactaaaaatgcaaaaattagctgggcatggtggcgggcgcctgtaatcccagttacttgggaggctgaggcaggagaatcgcttgaacccgggaggcagaggctgcggtgagccgagatggcgcgactgcactccagcctgggcgacaatagcgaaactccgtctcaaaaaaagaaaacaaaagaaaggacaggaatgtgctcattgaggctccgtttccatcttctgtatgtgaagttcggtcattatccaggaagctcccccttctgtgcctattatgtgctccttctgtgaggtgcttatctgtgttttacagcctgatcttctaggatgctctttgttagaagccaagtgatttctttgaactgcttgagcttagaaagggagcaatttctgaggtgctttttgttcggaggaaagttttttgacggggactctctttaccctatctacgtaaatgatttctttctatcttctataacagcaggaggatgggagggacgagaggattggagggggcagaggacacggcgggactctgtgttgaggctggaacctccactgcgccctggggctgaaggagcctgagctaccaagacacaggcatgaccagaggtgagggaggggatgtcgcagaaacaggagcacacacatcccggacaaacacagatgctctgttcccaccggctctccaccacacaaaccctcccgcactcccagggctccctgcccttaaacttcgccctgcacttggtgcactcacctgcaaccaggggcccagcagacgcttccctcccaatcccctcaccacccactgccgccaaacaggtcacatcctttcaccttcaatctcagcccagcaatgtcaccccacagggctcctcctagtcatgctggtgtgcctgtgctctcccatcctcctctcccttctccctcctgactcttcttcctcactgcgcttgcttctgctccactcactgtggatttctcacgagcctcgaaactgtgggtgtcattgtgttttcagacctttctccttagtgttccctctcttgagaattacttttcctttcctctccctggtctgtttctagaaatccatcaaagccacctccaatgccaatgaccaagcttttcgaacactcagctatcggttttgttgagttctccaatgtttttctcttctctacttcatttatttacattctaattcctattcattgttcgtttattttgagtagatggcttcttttttgagtttcttcaagtgaaatattaggttctcaatttgagattactcctttgtttcttttctctttctcaatatattcacactgacagcaatgcatttccctctaagaactgctttagctacttctcataagttataatatgctgtgtttttgttttaatttatcttattttctgattttttgtgattttctttttaatcatttagttttaaaagagtgtttcagaaaaaatttttgtcttaaacaccacattgcttgatattattaatttcaggctgggcattgtggttcacacctgtaatcccagtactttgagaggcccagatcagaggactgtttgagcccaggagcaagaccagcctgggcaacaaatcaagaccctgtttctagaaacacagacaaaaaatcgttaatagcaatttcaactgtctttctttactattggtgtgctttgtcttttttatacttttactttcaaccgacttgtatctttggatctacattgtatctttagatcatttataaaatgcattctgtcaacctctgcttttgcttttgagtatttaatagtttgagaggtaatggaagtattgctaaggcagaatttacacctgtcaccttgttcttacttttccatatgtatttattgtattttttagtagagacagggtttctccatgttggtcaggttggtcttaaactcccaacttcaggggatttgcccgcctcagcctcccaaagtgctgggtttacaggcatgagccactacacccggccccttaattatttttaaaatgttactttcttagtggttttcctgtggaatagcaattaatatcttaatttatcacaacctagattggataaaaagcaactttttatcttattttatgttattttatttttgaaacagggtctcactctgtgacccaggctggcatgcagtggaatgatcataattcactgtagccttgacctcctgggctgacccaggctggcatgcagtggtatgatcatagctcactgtagccttgacctcctgggctcaagcaatatttcttacttggcctcccaaagtactgagagcaaagatgtgtgcctcatgcttaattttaataggatgaaaaatctcttctccagtattgctctgctccctcctgcattttaaggtggaaaaatgataaatataaaaagtatatggtatgggtcctgggcagaatcatcccacccccacccccacctccctgacaagatgcaggtccgagtccctggaacctctgcactgggttacatggaaaggggaatgaaggctgcaggtggagctgaggttgcttatcatctgtcctggagatggggtaattctctggatttcccaggggtccattgtaaccacaggatctttatacaggaagatggggacagaagagggagaacaagacagagggcaccctgaggatccagcctggtggagctccatttgaaggtggggaaatgggtcctgtgtcatggatgtgggcagctggagaagctggaaaaggtgaggaggagacaggttctctccaagagcctcccaaagaaacacagctctgacagcgcagtgatgttagcctcgaaagaccattcagacttctgagctccagaaccataggagaatttaagaaaatcaatgtgtgtttttgttttgttttgttttgtttttgagttagagactcgctctgtcaccaggctgtagtgcagcggcatgatctcggctcagtgcaaccccgtctcccgggttcaaatgattctcctgcctcagcctcctgagtagctgggactacagccacatgccatcatgcctggctagtttttgtattattagtaggacggggtttcgtgatgttggcctggatctcttgacatcgtgatctgcccaactcagcctcccaaagtggtgggattacaggcgtgagccaccgtgcctggatgaatgtatgttgttttaaaacactaaatttgtagtaatttgtaacaacagctattgaaaactaatacagtctgatttaaagtggtccttgctttaggaagaaaaaattcaggtgaagaaggtccaggattgctcaggcaggtggaaatactgcattttgaaaaagatacttttacatttaaaaatggttaagatggaaactttcatgttacatgtattatatcacaatttaatttgtgtgtgtgagcatgtgtgtgacagagtcttgctctgtcaccagtctggagtgcagtggcacgatcatagttcactgaaatctcaaccccctgggctcaaggcttcctccccactcaaagtgggagagtgcagggcagggtagtctgagcctcctgctggtcatcctacacttgctgtttcttatgccctggcagaaggctcagtagtattcacactcctgactttaccatcccctgcggtagattggtccagaggccgagtgggtcttggctgtgagtgcaaccggggtgagtcatcctgccaggtttggaaactatgatattcaggaaacttttctcatcatccaccccaatccggtcccagatgagaggaacagtgagtgctgcagccaggctccctgccttcccagtgctcccagcatcacatgagttcctccccagatggtgtggggtctgggctctctgtgttcaccatgctctcaccattggctccccatttcacggccctcccagcatcatcccagcccctccagggtcactgcctgaccaggtgggggttgggtgaagaggcagaggtcggggcaagacccctggtccagtttgactttaggttcctctctgaaacgtgactgtattccacatcctgttcctccagcaacctcagttgagatgatgtgtagggcagtgtagaatcagggctggtgatgaccaattcctgccaccatggctttttaactatattgatttttcctaaaacggataaacagactggcaagaagttatggaaacactgttttctttactaatagtgcagacatgtgtacgtatcaatgctggtttttataacaaagataagcccataggcactctgctgcacgcagattctatcccaaaataacagtttgaagatcttccaagacccacacatacagattcttttcctttttatctctgcacaatattgcacagaatgactgcatcacaacaaatgtaaccagtgtctatgtgtccatcttcccagcagttcctgcacagatgccgctgaagagaggtgccagggaagggcagagaagaggcagtctgtcccttaacataaggctgattctctcgaactgtgcgaccggcagaagcagatgtgtgtgaactggacacagattgaagaatctgcccctgttgaggtggatgggcctgattgttgtcccccagcgtcctaaaacttgtatggacttggataatgaggaggcttgggctgagatgtgagtcctgttggagactccctctctacctctcaccgtggtccctctcaaatacccaacggaattccaacttgaaggattgcatcctggtggagctgaacttgcctgccaaagatgtgtccgacctgcgttcctggctccctggttcagagactacctttctcaagggctctgtgcctgtgctgggaaggaaacaaccatgggaaggaaacaaatgtgtataaactgctgtcaataaatgacacccagcccttccagctcaaaaaaaaaaaaaaaaaaagacacccagcccttccagctcaaaaaaaaaaaagaaaaagaaaaagacacccagcccttccactcaaaaaaaaagaaaaagaaaatgacacccagcccttccagctcaaaaaaaagaaaaagaaaaagacacccagcccttccactcaaaaaaaaaagacacccagcccttccactcaaaaaaaaaaaaagaaaaagacacccagcccttccactcaaaaaacaaaagaaaaagacacccagcccttccagctcaaaaaaaaaaaagacacccagcccttccagctcaaaaaaaagaaaaagaaaaagacacccagcccttccagctcaaaaaaaaagaaaaaaaaaaaagacacccagcccttccactcaaaaaaaaaaaaagacacccagcccttccactcaaaaaaaaaaaagacacccagcccttccactcaaaaaaaaaagacacccagcccttccactcaaaaaaaagacacccagcccttccactcaaaaaaaaagacacccagcccttccactcaaaaaaaaaaaaagaaaaagacacccagcccttccagctcaaaaaaaaagaaaaagaaaatgacacccagcccttccagctcaaaaaaaagaaaaagaaaatgacacccagcccttccagctcaaaaaaaaaaagaaaaaaaaagacacccagcccttccagctcaaaaaaaagaaaaagaaaatgacacccagcccttccagctcaaaaaaaaaaaagaaaaaaaaagacacccagcccttccagctcaaaaaaaaaaagaaaaagaaaaagacacccagcccttccagctcaaaaaaaagaaaaacaaaaagaaaaagacacccagcccttccagctcaaaaaaaaaaaagagaatgaaataaatatactactttttcaattcatgtgaaatattttcttaaacggtgattaaattgctaggtcatgaatatttctttcttggtcctaactacttaataaatacattcttcggtatttcttttgttttggggttgtcttgaaaatgttacggaggcaccttctggattttccctggaccgctcaaggccatattcgcgggctctgcctcctgcggggaatgctcacttccttgaagccaggactcatatgtcaccttctttagagaccttcctgttcagactactgaggacctgggaggtcccctcccagtctccttcccacaaccttgttccccgcccccagaatcatctgtcaccttcctacacccgatgcaatgcccctgctcattaggttcacctgctgtccccactggagcagggattttgtctgttttcctcagggaagcatccgcagcacagcccattgttggtgctgaggctgtacttaccctgtgagtgaataaatgagaggcagtgattggggcaggggcctctttcctgtccattcattcactacactttagatggtaacttacgacatggtgggaccagtgttttctgggcacaacaaatcagtgtacattgtgaagtcaagaagtagaaagaaatgttaggtggaagaatatgaattttcaagaagcagttgggaagagtgagacaaaaaccaaacaagaaaggggcaaggttggcttggttgtagctaacatggtggagaaatgcagccgtctgcaatggagactgggcgctgttagactcatctgcaatgctgagaccacctccacaacctaccctgcatcatcctctcctgaggctgaatgtagctcttgtgccttcagtgccaaggaagccatagtcccaggccagaggaagggctcaggtggacagtggaaaaggtggtaggtacagaaggggacccctgtaagcaatgagttcctgaggataaacaaaaaatgtcacttgaaaatgggacaaaaaagaaaggtataataacaagatggcaattatccataattccattacacagtgtttaatgttagggttttggtataatcatatgtaatttttataacattatggtcatataccttacacttattttaaatgactagagtttatttttttagagcagggttagagttgataatgcagagttctctctcacccctgtcagttaaacccattttttgtttttgcctcatgtcattttattttctttattcatttttaatttcaactctttttatagattaaagagtacacgtgcaggttcgttacatgggtcaattgtgggaggctgcggcttggggtcccaactatcccatcacccagacagtaaaagcggtacccagtgggtggttcttcagcccacatgcccctcctccctcccctgtctagtgatctccagtgtctgtggttcccatctttatattcatatatatttaatgtttagccctcctcttataaacgagaacctgcagaatgcagttgtctgttctgttaagtcacctaggataatggcctccagctccatccatgttgctgaaaatgacatgattttgttgtctttcgtggctgcatagatttccatggtgcatacgtaccacgcttccttcattcagtcccctgctgctgggcacttagattggttctgcgtccttgctcatgagaatagcactgcaatgaacatatgggtctatttgattgaataaattattttcctttagatatatccccagcagcaggactactgggttgaatggtagttctattttaccttctttgagaaatctccaaacttctttccgtagtggctggactagtttgctttcccagcaacagagtctaagtgttcctttttctcctcggcttcaccaacatctgtggtttttttgactttttaagaattgccgttttgggccgggcgcggtggctcacgcctgtaatcccagtactttgggaggccgaggcgggcggatcacgaggtcaggagattgagaccatcctggctagcaccgtgaaactccgtctctactaaacatacaaaaaattagccgggcctggtggcgggcgcctgcagtctcagctacacgggaggctgaggcaggagaatggcgtgaacccgggaggcggagcttgcagtgagccaagattgcgccaatgcactccagcctgggagacagcgagactccgtctcaaaaaaaaataaaaataaaaaataaataaagaattgccgttttgactggtatgagatggtagctcactgtggttttgatctgcatttctctgatgatgattcatattgagcatttgttcatgtttgtccgccacttgcaggtcttctttgaaaagcgtctgttcatgttctttgcttactttttaatagggttttttcttcttgcttgttgagttgtttaaactccttgtagattctgcatattagacatttgtgagatgcatagtttgcagatatttctcctactctataggctgtttactgtgttgctagtttcttttgctgtgcagaagttctttagtttaatgagatcccatttgccaatttttggttttggttccagttgcttttggtgtcttcatcatgaaatctctgccaggtcctatgtccagagtggtatttctaggttatcttccaggatttttatagttttaagacgtacatttaaatctttaatccatgttgagatattttacatatatggtgaaagacaggggttcagtttcattcctctgcacatgactagccagttatcccagcaccatatgttgaatagagagtctttccccattgcttatttttgttgattttgttgaaggttagatggctgtaggtgtgaaggtttccttctgagctctctattctgttccactgatctaagtgtctatttttgtaccagtaccattctgttttgatcaccatagccatatatatatatatatatatatatatatatatttttttttttttttttttttttttttgagacggagtctcgctctgtcacccaggctggagtgccgtggcgcgatctcggctcactccaagctccgcctcccgggttcaccccattctcctgcctcagcctcccaagtagctgggactacaggcgcccaccatcacgcccggctaatttttttgtatttttagtagagacggggtttcatcgtgttaaccaggatggtctcgaactcctgacctcgtgatccgcccgcctcagcctcccaaagtgctgggattacaggcgtgagccaccgcgcccggcaccatagccgggcaatgtgatgtctctggctttgttctttttgcgtatgattgttttggctatttgggctcttttttaattccagagaacttttagattagatttttctaattttgtggaaaatgacattggtattgatagagacagtgttgcatctataaattgcttttggaagtatgaccattttagctatattgattctccaacccatgagcatgaaatatttttccatgtatttttgttgtctctgattttttcagccatgttttgtagattctgtttccacacaaaatctagcagaatcactcatttattactccatatcatggaggaaaaatgatataacattaattctctactgggtaatacaacaaaattccaaactcagtaggtttttggtacatagaactctttatttaaatatcagtagagggcaacaaattactaaaggaaactcattaatataattttttattagatatttaacaaattatctttcaggacatggaaagaatccctggaggtctgaagtctaacatgattgttttactgacaatatcatttggaagaacagggtcatcattcaaagaagtaactgattttctaaacaaaagcaaaagaaagaaaatgttgacatatcttatttagtcagccagaactttaagtgcaaaaattccatcaggtaacaccaagagaaaatagcataagatgttaggaataaccggtggtaaaattgttgacaaaagggatcaaggcagtgaatgagctattgggtccatggtgtcatcatgatctgctggaggcctctggacatacacagtacgtggtgggcaggtggccagccagaagggaaagtttgatcgagaccgtgctcacaggggctttttggtttcatcttcagccttcagaaaggatacaaatgttggtttaaatggtgaaggagaacccggatcacttttccaggtctggaaactcagtgacacccgcagtttcaaggctggtgagaaatccacaaggaggggagcagaagcaagtgcagtgaggaagaggagtcaggagggagaagggagaggaggatgggagagcacaggcacccccaggaggagccctccatgagggggtcttgttcacactcactcaaacacacacacacacacacacacagacactggactgattagatctgaactcaggacagctacctttgttttcttcccacttacttgttctcttcagcattttttcccagtgtatcaagaattcctcaagccaagtttccgtctcccagtgaaatcttctggaagaacatggccacatccctgttcttctcccacttctctttcatcttcttgactccaggatgaagcactgtctactttctgttgtttgggtcaaagaggaggaacctctgtccattgaagagaaactgccaagatcctctgctgtgtccatgggctttgtgctcacaagacatcctggcctgcagggtgagaggctctgcccctttggaaagagatcagctctgatcttgacaaattgtgagccccaccctgcttcctttcctgtctgctgcccttgctccttgacctctcaagtgatataaacctgatttatttgtttatttttaattaattaattatttttttaactaggctaagaacattattaacctttgtttcaaactttattctcaggcttctttggcttaattagctgcaaagaataaattgtgtatatgcaaaaactgaaaagagctcagtgtccaagaggcttgggctcaaaagtattagacacctagattttatcacatccataaacaaacatttcttaaaaagcagtcataatataaaatagcagttcctagtaacttattcaagttttatcttcagaagttgactcaattcagtttgcctcatccttgaaagcctcataaaaattctccacaagatctggaacttcatcatcatcatcctctccagttgcaaatggtgctgttccatccacagattgtttgggcagagcttcagccagtctccttaaactagccagactgtctacaccaagctggattaagatgctgggtagcatttctgtcagctgctttgtcttagcatggcctgtaatggtgaaagtgttccctgccagagatgtctgaacttcagggttgttaaagtggatcactgttccttggtttgtaaacatattcacctcttcaataccagagatattgtttacccctaacttctttaaggagaactgaaagtttttatcttctgctgtggctgttctatgaaccaccttcttctttctgcaagcaggtcctttcccaccaatgcacacttgtgcctgcagtttggcaagtttttcctggttcgtgattgtttctttcatcttgtcggagtggataaggggccgcatgggagactagggttggtgttcaggttgtctcaggtggaccaactgagattaggcacacacaagctgggatgcccacctgatttatttgttgcatgaacacattaaaggtttctaagctattatagtgtctgctccctcctgtcctgggccattttaaacttaccactggatattcaattctccactcgaacgtcaggcagttgctctttgaggaaatccaccatgtctcttagtgtttcagtctgttcttcccaggcttttgtgacattgactttcttccccagagaagcaaaggctttggccttatggctaacacagtcatagtgaagaaaaggccttttatccacctgatcttgaacttcacaccatcgtggttcaggtctgaacttaggagtgacgatgaagtcatagcaaaggcagtgtgtgtgtatggaagaaaaacacaggagggggatggtgtggctgggagtggaacctgagacccctcctcccccttatggtgactgcaagtgaaggcctttgaggggctgggctggcagagcaagacgtgccccagctaggactgtcatgtcaactagttaaagactagagtgtctcctttgctagagtacaaggcgaggaaggtccctgcagccatgaaaccacatgtcctcccaaaacatatcccacctgggctctgcccacatcggtcagcacatgaccttgtcatgtcagcagccaggcctgctgtggcaggaaaaggcctggatgaggaggatcttcctcagcagaccctggggactgcaggaggtgggagagggtgtgggggctgccctaggatgctccagcacagtgggtggggtgaggacagaatccaatttgtatcataaagagattattgtcatagtcacaggatttaacacattggcaaagcccctggtgatgctgcccatctgctatgagatgcattcctgaaaccttggaagagggatggttcacaaggctagaagtagaaaatctagaacttctaaggtagggcgtagaggaagggatcacaggctcagagaagtgcccatgccagaggggtgtcagtgtgaaaatccagaacaatgtccgtcctctatgctcatgggaagcctggaggactcttgtttacccagcatataaagaaggctctgggagaaggcagcagactgtcaagaagctcagggatacctgttactgaaggccagggttgggagtaggaaatgctgttccctaaatgactcccaggagtaatgatctgaaataactgatcccaggtagaggctgtcacctgtcaggaggagggaaggccaaacaacctgcagtctgatgtccaaggaggaaggaagcaagaacccgcagggaaggcagagagaagccagagagctccgccaacagagtcaccccaccctctctcacctgctctcatctagcccagctggcaacccatggtatggtgcccacccacactgataggggtcttcctctccccatcccccgactcaaacgtcagtctcctctggcaacaccctgacagacacacccagaaagagtacattaccagccatctaggcatcccttatccaatccactggacacctaatattcaccatcacagtcccacagaccacactctcatccacactccaccccaaccccaactccctgcgctctgcctctggcaggggtgaaggatccagtctctccctgtcttcactgtgattatgatgacagccatcctactaggtgtgaggtggcatcttcttgtggctgtgatttgcatttccgtaatggctattgatgttgagcctcttttcatgggcttagtgaccaatgtatacttctctggagaaatgatcattcaaaaactttccacatatttatattgcattatttctctttacaatattgagttgtaaagagtgctttatatatttgggataccagtcccttaccagatatgtaatttgcacatattttttccatgctgtaagttgtcttttcactttctaaatgacattctttttgaagcaaagaagttttacctttagaataagtcaaatgaaactatttttcttttgtcaatattgccttagcatacactactttagcagtcttagccaaaccccaaggcacaaagatttacttccatgttttttttctttctttcccttccttcctttttcctttttccttccttccttcttccttccttcctttccttccctttccttcctaccttcattccttcttttcttccttccttcctttccttccctttccttcctaccttctttccttttcttccttccttcctttcttcctactttccttccttccttccttccttcctttcttcctactttccttccttcattccttccctccttccttccttcttttcttgacaaagtttcactcttgttgcccaggctggagtacaatggtgtggtcttggctcacttcaacctctgtctcccaggttcaagcaattctcctgtctcagcctcccgagtaggtgggattacaggcacctgccactatgcacagctaatttttgtatttttagcagaaatggggtttcaccatgttggccaggctggtctcgaactcctgacctcaagtggtccacccccctcagcctcccaaagtgttgggattacaggcatgagccaccacacctggccatccagccccattcttgagggcttttctctcataccctaataacctatcaaagcctccctctcctagtacacattaggcactatgtttaggggcacatagacattcagtctctagcgccacctctgctgagtcctgtctccatggaaatgaggaagctgaacagcctcctccacacagtctccccttgactgccattgcctcagagtgacagtgagtaactcactaagaccaatggctgggctttcttggggacagttccagggactagtttcttgttcgtgtctggggatccttccctgcttctttgcacctcttgtggttttttgagatgaaacggaatgtttacaagaatacaatgtgacagctctgggaatcagatgtcccctctcttcaaggtgtgttactgctgcttgtttagtgactttcctggatggatcttataacatctgtattccctgtcacaggtggaccctgaagtctctgctcagttaggtgaggttggatagaggtttgcatcaatgccttgagccggcgagtctctccccagtgcggagggttttgtgtgtgtggtgcactcctgcccctgctgcactcaggcgggcagctgatgtcaccactgcagctccacttcctgcctgcacagaacctccaggtcagccaaagatcagagatgtggccttctcaggtgcttcctgggcacgtgccagcctctatgcacatctcattccccaaatctttctctcaatttcccccactagcctcttgtttgccccacatacaaacggtggagttgtatggttgcaaagactgcttttagccaatgctctgaggatctggcttttccctagaaagagacctcagcaggtcaaacaatgacaaacccaatgaatggggcttttccagtgagtcccagataggccaaatagagttctctggggcaggggcttttgaagggctccaagcccctggtgccccttcagcaagtggagacttgtagctgtggccttgtagctgtcatggacatggtgagtccagtgttttctgggcataataaatcaggatatattgtgcggacaagaagtagaaagaactgttaggaggaagaatataaattttcaagtacgagttcggaagtattaggaaaaaaacgaggaaaagggcaaggttggcttggttgtagctaacctggtggagaaacgcagttgtctgagatagagtactcgagctgttaggttcctctgcaatgccaagaccacctccacaacctgccctgcatcctcctctctcccaaagctgaatgcaactcttgggccttcagtgccaaggaagccacagtcccagaccagaggaaggcctgaggtggacagtggaaaaggaggtggtgggtgcagaaggagaaggctgacagcaaggatttcctgaggataaacaaaaatgtcacttgaaaatggaaaaaaaagtgagggcataaagaacaagatggaactcatctgtaattccattatacagtgtttaattgtagggttttggcactttcatgtataattattatacaattatcatcatacaaatttttatacaattatcatcatacaacttatgattatcttaaatgactagattttatctttttgagctgggtttgggttcatagtgcagagttctctcgctctggtcagttaaacccatttgtttttggccttgtgtcattttattttatttattcatctttaatttcaacctatataatacaaggtacatatacaggtttgttacatgggtagaatttgagaagctgaggcttggtgtcccaatgatcccatcgcccagacagtaagcatgatacccaacaggtgtgtttttcagcccaggtgcccctcttctctccccggtctggtgatctccagcatctgtggttcatgcgaatttaatgtttagctgccactttccaatgggaagatgcagtatgtggttttctgttcttgcattaggttgcttaggataatagcctctagttgcatccatgttgctgaaaaggacatgattttcttgtgtttcatggctgcatagttttccatcgtatctatgtaccacattttttttcattgaatttactgttgttgggcacttagattgattctctgtccttgctggtgagaatagcactgtaatgaacatattggtgcaggtgtctttttgataaaatgaattcttttcctgtgggtatatcccgagtagtgggattgcgggattgaatggtagttctattttaagttcttggagaaatctccaaactgctttccatagtggctgaacaagtttgctttcccaccaacagtgtctgtttcttttgctctgcagcctcaccaccatctctgactttgtgactggtaagagatggtaactcattgcagttttgatttgcacttatctgatgattagtgatactgagcattttttcatgtttgttggccaattgtaggtcttcttttgaaaagtgtctgttcatgcctttgcccaattttaattgggttttttcttcttgcttgttgaattgtttaagttccttgtagattctggatattggaccttcatcagatgcagagtttgcaaatagttttccccattctacaggctgtctgtttactgtgttgctagtttctttttctgtgcagaagctctttagtttaatgaggccccatttgtcaatttctgtttttgttgcaattgtttttagtgtcttcttcatgaaatctttgccaggccctatgtccacattggtatttcttaggttatattccaggatttttacagttttagtacttatatttaaatctttcatccatattgaattattttacatatatggggagaagtaggggttcagtttcattcttctgcatatggttggccagatattccagcactaattttcgaatagggagtctttcccacattgcccatttctattgaagattagatggcggtaggtgtgcaggttgatttctgggctctctattattttatttactaaataaaataatcatgaatgtaatattttcatattaaataattaaaaatttctacaacaggcactgtggttcatgtctgtaatcccagagcattgggaggccaaggtggtagcattgctcgagaccaagatttgaagaccatcctgggcaacataggaagaccctacctctacctaaaaataaaacagtttgccagtcctggtggcatgtgcctgtagtcccagctattctagaggctgagtctagaggatcacttgagcccaggagctggagattacagtgagtgaagactatgccacttcacttcaatatggttgacagaatgagaaactgtaaaaagccataaaaatgaaaaggattatcacaattcctggtcagtgcatcaaaaggatccctgaggtctgaagtccagcatgctattttactagcgatactgtttggaagaataaggtcatgtttcagagaagtgtctgcttttctacaatcaaagaagtagaaaaaaaaatgccttttgctgggatttcttgttcagttaaaacttgtgcaggagttccatccattagcaccgacagaaagtggcagaaggtgttaagaaaaatggctgctgggatcatgagcgaaggtaatgagtggcctgagatgttgagccgacaatgtcctcatcgtctgctgggggcctctgggcttgctaaggcttgaactcctgctttccagaaaggcacagtggtgagtagacaggcggcctccctgaagggagagcaggacccagaccaggctaacagaggcttcttgatatcactttccaccttgagaaaagatgaagcattggtttaagtggctgagaaaaacctgggtctgttctcctgggtgatccttcccaggccctccccatttcggaacctctcccacaaataagaaacatgcttttccctccaacactacccctggctctgtaccctgttccaacctccaccctccttcaccacaccacagagccagcccaggtcctgttacagcccaggggggctcacaactgaggctggtaatgaggggtctgcaccctcactgagggcctgctcctccctctcatagaagggtctagaggacctgggggaaccctgtccaaagagagctctttctatccacgttccctggccttgggtgggcttgtagacaaaccaccttcttttcccttcactctcagcctttcctcaccctgggagctgcacccatagctctgaatgggactgtccttgccctgccccattcattcctggccaagttcagtggtgagcatggaactccagcagcagctcagctcccctgcctgagtccactctgctccaggcagggccatcagctggctcaggatctggagtatgaaggaggcagaatggcaggggcatcgccccagggcctggcaaggactcccatgggtccaaggggcctggccttttcctaaatctcaccctggacacgctctactcttcaccttccaccttaactgctgggacccgagctgctttctctgggaatgcagcctttggaactgggtgggccaagaccctcacagctccctcgtcctgggattctcccagatcactctcttcttagcctcctccagggacaccccttcccttgacatccttggtgaagtggccatgctactcctctcctactgtgcagactgcccatgcctgagtttctgctgcctgcaggccacacaccatcccgaataggaacctgctctgaaacaggcctgaattggttaaaccctctcaagctcaacaggccttgagccttggtatgggtccctccctttccctctggcctctgacagttagaatccatcagaactcaaggttgagctgcccaggtcattgccaacaggtgacagcaggtctcattcatctgtctaatgtcaggatgagaagttcccggcctctgggactctgggaattctccttccacatcctcccatctcacccatctgcctcttgctcccctcccaatattgcccacagtacctgtcactctaaacaactctcctcatctgccagctagaatgaagcagaggaagatgatgagaaggctccagggactgagggtggtggccatggccttgggttgggttgtgcctggggccagagagggtggttctgaaatggaaacacaggagtgacaacccttgtccaggctcaaaatcttaggggatgtctcctcagctcctgccaccccaggtcatcctggaaggcagaccttttgtccccctctgctgtggggcaacctctgggacaagtcttggggtaagaagggagagggggtgtcccctgccctcagggagctcacacatctgctaagggaagcgaggtgacagcacagtccaccctcctgctgtggagaaagaggaggtgatgtcccagggccagggaggggagggcctcaggccctggcattggaggtgattttgatggatttacagaaaccgatgaggggagaggaaagaaaaggtgattctaggaggaaggaacactaatgaaaaagatgtggaaacactatgacacccacagatttgaggctggtgagaaatgcggtgggtagagcagaagcaggtgcagtgaggaagaggagtcagggggaagaagggagaggaggatgagagagcacaggcatgccaggacccccaggaggagccccccatgagggggtcatgttcatactcactcaaacacacacacacacgcactcacacacatacaccagctgataagatctgaactcgagacagcttccatttatccccctctcacttacttgttggatccagcatttgttcccagtacatcaaaaattcttcaagccacatcttacaatcccccagtgaaatcttctggaagaacatggtcacatccctgttcttctcccacttctctgtcatcttcttggctccaggatgaagtgctgtccactttctgttgtttgagtcaaagaggaggaacttctgtccattgaagaggaactgccaagatcctctgccgtgtccatgggcttcatgctcacaagacatcctggcctgcagggtgaggggctctgccccattgcaaagagatcagctctgatcttgacaaagcctgagccccaccctgcttcctttcctggctcctggacttgctctctctgctgcatccggcccatgctcctcaacctcttgggtgacacaaacttctgatttatttttcatatgaaatcaataaatgactctaagttactactgtgtctgctccctgggccattttaaacttaccaatgggtattaaattctccacttgaatgtcaagcagttgccctttaaggaaatccaccacgtctcttagtgtttcagtttgttcttcccaggtttttgtgacattgactttcttccccagagaagcaaaggctttggccttgtggttaacacagtcatagtgaagaaaaggcctttcatccaccaggccttgaacttcacaccactgtggttcaggtctggacttaggagtgatgatgaagtcatagcaaagacagtgtgtgtctgtggaagaaaaacacaggagggggttggtgtggggggaaatggaacctgtatcccctcctcccacttatggtgactgcaagtgaaggcctctgaggggctgggctggcagaccaagacatgccccagccaggactgtcatgaaaactagttaatgactagagcgtctcccttgcttgagtacacggaggggaaggttcctgcagccatgaaaccacatgtcccctccagacatgtcccacctgctctgtgccgacatcagtcagcacatgaccttgtggtggaggtgccaggcctattgtggcaggaaaaggcctggatgaggaggaccctcagcagcagcccatgtggactgcaggaggtgggagagtgtgtgggagctgccctgggatgctccagcacagtgggtggggtgagggcagaattcagtttagataagcaagtgattattgtcatgggtcacatgatttaacacgttggcaaagccccagtgaagatgcccatctgctatgagcatgcatttctggaaccttgtaaagggatggttcacagggcaagaagttgaaaacccagaacttctacatcagggtgtaagggaaagaatcaaaaggctcagagaagcacccatgccagagtggttgcaatatgaaaatccagaacaacgtccatcctctgtgctcatgggatgactggaggactcttgtatacccagcatataaagaaggccccaggagaaggcagcagactatcaagaagcccaggaatgcctgttgctgaaggccggggttgggggtaggaaatgctgttcctgaaatgggctcccagtagtaatggggatggaaaatcctgaaataagagatctcaagcggaggccgtcaactgtcagcaggaaggagggtgcaatgatgtaaataattaaagaagtcacaatgccagtgggggacctcagccttaaaaatgtatgcccatggctcatagaacaaaggggtcaaggatccaaaagaaatggaaactcaacccggatactgctagatataaataattacaacaaacaaagacaaaacgcaaggatggatgacctgaaggctgaaaggagtcaccctaggaaataactgagctcctttgcccagctttgagaactgagccacatctcagacccagagtccattgctagaaggagagcccagaggccctggtgggctccttcaaccccacagcaactgcaatgactccctcagcctcccccagagagccagatgggcattcactctggtaactgtatgccatgaaatggcaaatacccagacactcctagtagacacagtgtgtgatccaacctcctcccagggacctaaagcattaacttgctcccctattactcatgaggtgcatttagggcaaagtaacagatggacacctctgtcaggtccagcttagagggatgggctgggttcatagacccattcgatggtaatttcacatttcctggatttctaccgggaatggatagtgtttgtagttaatgtagtaactattataggttgtgctggtcatatgacctcccctgtcactacttaactctgctcttgtagctgggatgcagccatacacaccctgtgatgaggggtgacgctggacctaccaatacagctatttgaccctggactccctaagatcccagaggcatatgtggttggaaaaggtgctatgtggatttcatggcaattgccaaccgcagaatcacaacaggatcccctagtgctcagaagcaaggctgtgccactcacagcagtgaaatcccctcatttaaaagtggctcctgctgtggtcctgggcccctgtggagatgggcctccagctatgggagggcagtgaccacacagcctcagagctgcccatcacagggtgggctcctcaccctttaggtcattaggaatataggccccacagtgagaagacacaggtgggtctcctgggatgggcaggagcagggccacagggaaccaagaagctgcacaagcagttggccccgatccccaggacactacatggctgcaccccctcacccttagctcacacctgaggctttaaggagggtccctgattgccctgagggacctatgatgccacccagcagcaaaggaggggcgcagtaggcccagaaccataggacctccattcacatccatcacatccacaccacccagaagccacaggcagggtaggacacacttgtgactcttcaacttacactacttggagatgacaccctaggggatggggcagcaattgccaggacacagcatgtgccctcatctggggtcagcaacctaggacagggtccacatctgctctcccttttatttgcaggttaccattgcctgctgttgctctacaaagggacaggacttgacacacagacagagaactcacggccagcaaggaccaaagtgccttcagcctttcctttctagaaagggtttgctgactcctgtctgcttagtgactattctatatgaccctggctccccagtcggaagaacaggcgggtctgggacccaagggcagaagtgggcacctctactcaccggcgctcccagggtcatcgtgagggaaatgggatttcccgtcccccctgcattaagttttgtggaaagcctggggtgtgtttgctggggtgtgtcctcaggcaaaaggggacaaggtgctagttggtcgggggaggtgctaagggccccttcatggatggggaggtgagggaggcctgtgtggtgacaggggtgagctgagatggggagtgaaaggatgcgacctgggtggtgaaagtgaatggtgaggggaagggtagcaagtgtctggtgagcccctgcgtgcaggtgagtgtctgcagcaaagtgtaggggcgaagttccagggcagggagccctggggctgctggaagctttgtgtggtgaacagcaggtcagagcagagcagggctgtggctgatgggggagtctgtgatcgcgtccctgtggaactcccctttacccctgtcctgaccccagctagggttcgggaatctggtttctccttccctagggccagtggggctgcgggtctgcaccagggatccccgccctaccttgccctctgtagccttttggtccctccaccctcctgcaattccttttcagccttctttgacactccccctggactgcggtgctagcagcagctgcaggaagcggactcggcggaaaggagccccggaggggaactgagtgccttcagccaggcacgttcggggagacagcgatgttcggggagaccgcgatgttctgggggatcgcgatgttcggggagaccgcgatgttcggggaggccgcgatgttcgggtagaccgcgatgttctgggggatcgcgatgttcggggagaccgcgatgttcggggaggccgcgatgttctgggggatcgcgatgttcggggagaccgcgatgttcggggaggccgcgatgttcgggtagaccgcgatattcggggagatcgcgctggtccacccagaagcctcctggcctatggggcaagcagcagccgcaggaagcggacccggaggaaaggagccgcggaggggaactgagtgccttcagccgggcatgttcggcgagatcgcgatgttcggggagatcgcaatgtttcgggggatcgcaatgtacggggagacggcgatgttcgggggtaccgcgatgttcggggggaccgcgatgttcggggagaccgcgttactcggggggacggcgatgttcgggggggatcacgatgttcggagggatcgcgatgttggggtagaacgcgatgttcgggggcatcgcgccggtgctaccagaagcctcctggcctgcggggcaagcagcagccgcaggaatcagacccggcggaaaggagccgcggaggggaactgagtgccttcagccgggcatgttcggcgagatcgcgatgttcggtgagatggcaatgttcggggagatcgcgattttcggggagaccgcgatgttcggggagatcgcgttgctcggagagagggcgatgttcggagaggccgcgatgttcggggagaccacgatgttcggggagacagcaccggtccttccagaaacctcctggcctgaggggcaagcagcagccgcaggaagcggacccggcggaaaggagccaccgaggggaactgagtgccttcagctgggcatgtctggggagatcacgatgttcggggagatcgcgatgttcggggagacagcgatgttcgggggcaccgcgatgttcggggagaccgcgacgttcggagggaccgcgacgttcggggagaccgcgatgttcgttcagggagatcgcgccggtccttccagaagcctcccctcctctgaaacccgctgcagtccacaacctcccaggtttggcccccgccctgcttaggctacatccccgaactcaccgacccatcctgcccgggaccagccagacagcaggtgcagaagcgggaggcacagaaggaacgcggggctggcggccgctgccattgtagacctggagctccgtggacaggaggcgctgatggttcccttcgaggctcacaccacggctgtttataaagctgcccagcccggcccgccgcgcgcagggatacactgggcgggatcctaggcatgcacttttttggggatgctccaccccgtcacgccccgggctcgtcatctgacagcggcctggctgacgcaactctcccctccgacccgcccccgcggcttggtggcggcgtgcgcgggccccgagcgggccaggacgccgttccttccgttccttccatggccccatcaaataatttttcaacacagcatttatcattaccccagtgtaaacactgatgcacaggaagatgaagaaacttgcataggaatactcagtggcggcggtgtctccctgtcaccgcctgcgccagcgacacccgccctccctccgcctgcagtcgcgaagtccccgcccctctccgtccagggcgcagccgcttccccattccggagcgaaccttttttgcctctccactaaaagcatgaggtggtctttgagtatattctatatccctttatgacttctggaaaaaaaaaaaaagaaaagaaagaaagccctagagggctaccgtgatcaatcatgatgtgatcagttgtgtttccatggagagcagaagccgagggaagagtctacgcatgcgtggggctcactttgctacacacccttctgtgtctaacaacacccaaatccgtggctgtatctgcacctcggctcagtccctggatggtccctgcagccatcctcaaaagggacgcccgagtgcatcctcctctgagtcaccatgaaaccatctagatctgcgggtagaagccagagggaggtggagggcccagtggctcttggccgcaagggagggcttagcctgcagtaaggactgggcagagcccctgagtcccactttgcccccagccactcagcccattccccaatgaatgagaaaaataggcacagacctcccactccacacagtcttcatgtggggagaccttcacctggtgaccatcaatcaccagggtcctgaggctgtgggaaaggggaggaggcctggaccaagcccagggcctgactatgcttcaggacagggacatgggatggcagccatctctgtgactgagcagggacacaggagccaaaaggttctggcctgatgcactagagcctctgtccaggaggggctacatgaagggtggtcggcaggacaacagtcacacgggggtgggcagttctcagatttgggaggggaatagcttggtgggcccagggatctgtgtgtgagaaaagcctcccatgtacagggctgggggcaggagctcaggttagtcctaggaggaggccactgggaagtccctggcagcaccacccctgaggccgggtgacctgggccagtgactgcgggaacaggaggaaggcagaaggaggctggcaggagagccccaagcaggacagccaggtgacaggaggaggggcctgtgtgcacacctgggccctcctgcctcacccctgctgcaggcatccggccactagactcaggcctgcccaggatgggcatagaagtggcccaaaggttattgtaatggccgggatctagagatcatgcattcagatatggaagtcagctcatattgtggctgaatattcctgtgcaagcttcttcagctttctgggtgtggatgtccgcatgtggaaaatgacagatgctatgaacacagatgaaatgagcagattctacaaagaaccctatccttgcacatgctaaggacccagggcaggtctcctatttcagttgtgagccctgccaccctccctgaagtcagcaaatgccaggcccaccctgaggagagctggagctctgagcccaggccatggcctcttcatggccctgagtgtgctgtgagggggtggaaatgaaaacaagacccaccatcaggattcagacacgtttttcagacctacaaaggatgatttttctctccgtcagctggtgagcctgacatgatttaagggtggttggaggctgagtgaaccagtgaatgaatgagacagttgtgggagtgaatggggctcagaggaaaagcacaggttcagaggggagctggagtggaggttgtaacccccagggtcctgagggtggcagcatcgaggttgtagacctcatggctggcacaagttggtaatactttttttgtctttttttttttttttcttgagactgagtcttactctgttgcccaggctggagtgaagtgggatgatctcagttcagtgcaaccgcctcctccagggttgaagcgattcttttaactcagcctcccaagtagctaggattacagggcctgccactgtgcccaactaatttttgcaattttagtagagacaggtctcaccatgttggctaggctggtcttataaactcctggcctcaggtgatccacctgcctcagcctcccatagtgctgggattacaggtgtgagccactgaaactggccaagacttggaaatttgtatgcccacctgggtgtccacaaagattttccaaggaagagtaacttggttttcaaccagtctgggggtgcttcaacaggatagaatcttctagaaaaacatagcataatgatggacagcataatgatagacttcagctggtttgactgagcctagagtgcaccagggccaaacgaatcttgccttttttttttttttttagacagagtctctcactgtcgcaggggctggtgtgcagttgtgcaatgtcggctcgctgcaacctccgcctcccaggttcaagagatcctcctgcctcagcctccccagtagctaggattacaggtgccagccaacacacccggctaatttttttgtatttttagtagggacggggtttcattatgttggccaggctggtcttgaactcctgacttcgtgatctgcccgcctcagactcccaaagtgctgggattacaggcatgagccacagtacccagccgaaaatctgtgctttaaacaaataaggaacgagtctgaaagtgggaatggaaatgggaaaagataagggggccaggaggaaagagaaggagaagagaaaggttggggtctgaaagggaacaagaatccagacatttctggacccatggcctggagttgcaagtgggcggggtggggccactggagctgtgacagccttgagggccggggtgactcacacagggaccctctgcttcctccaagcatatcacaccctgggctccaggtctccagtggcacaggtgctggcgcagagttgggtgtttgcctccagcctctactcctgctaccaggctggtccggagtgggtcggatcagtgagttccaggctggaccctaagcaggggtcgtgggccaacatgggagatcttggactgcaggggtggggggtcaggaggaagggaggcttctggaagtttctaaaggtctccctggaatttaatgtggcattgctagctggagccagcttggcatggggagagagatgtgggactgatgaaaagcgtgcagcctgatttaaagccaaaccctgagccctttccaagaacaataaagcatattgtagtcgctaaaagaaacgaacgaacaaataaagtagcctttcttggtagataccttccatttttaagctttacatttaacattgccttttgaaaatagtgtatattatttgatattttaaaatccaacctgggagtttcactgatttatgtgatgagtttagcaattcagctttattgtaattattactgtttaggatttagctatgccatcttttttgtttgtttgttttaagatatgggatctccctctgttgcccaggctggagtgcaatggcgtggtcatagctcactgcagcctctaactcctgggctcaggccatcttactgcctcagcctccgagtagccaggactacaagcatgcgccacccactgggctaattttctatatttgtctgtagagatggggtctgcctatattgcccaggctggtcttgaactcctgagctcaagcgatcctcccacctcagcctcccaaagtgcagggattacaggcatgagccactgtgcctggtccacatgtatttattgtgttttttaatgctggcatttcccctccatacctgtgttccatttagtatactgagggtttttttctgttggtttaaaagttatacattctagttttcttctcagggtggccgccgttaacctatgactcataccagtatgtgtcacatttattggtattattggttttgttttattcctaattttagaagtctcagcatgttttcatatccctttcacgtgccacctccagccccattttcctgatagctttcctagctgtaattctcggttattcttagctatacttctttgtttctatgatcccaacttcacatttccccttgttgtgagataacagtaatctggaatagattccttggtcacttgtcctcctcggttctcttgtcgcatcacctgtgtttctcttgctattgaggtaccttcctctaaactatttccaacttggatctttaggaggcaaatatccttcaagttttctgttttgaatatttctgatacaccatggtgggcaggatttggaagctgccccctcaagtttcctgtaccttttctagaacgatatgttctagaaaagactgatgataggacaactaacggctgtcttagcctgcttgtttgagcctggtgcataccagcggcaggaaaatccagtattttaagcaaagaaaacatgattatgaaaatgggaatggaaatgggaaaggaaggggggccaggaagaaggggatggagagagtgaggggtgaggggcctagagaaaccagctgctcctagtctaggcaccgctagtctaggtactgtgagtataggtactgctagtctaggctctgtacagtcatcattaaagttactaatcagttgaccttaaaatagagagattttcctggattctctgagtgggcccagtgccatcacatgagctctaaaaagcagagaattttctcaggctggagccaagaaatatgcgtccaatgtcagagagattctaagcatgagaaggattccatgcactgttgctggctctgagatgtgggggccatgagcaagactggagaggggcctctgggagttagggaagggctgcagctgacagccagcagggaagctgggaccttagtcccacaggtccaaggactggattctgccatcaacctgagtgcacttggaagcagatgcttcccagaacctcccaaccagagcccagcaggtggacaccttgaccttgaccttgaggaactgggagcagagaaaccaatcaagccatctcagacttgcaacctagaggactgtgaaataataaagatgtactgatttaagcaggtaagtatgtggcaatttgttatggctgcaacagaaaagataccttcctatttaaatgagaatttgactggataaaaaattctaggctgaagttcttttccttcatattttagaaagaatactccgttgttatcttgcaaccagggttgctgttgtgtagtctgtgggccaaatgtttccttcttccttccattgtttctctggggtaatttgggtgagggagccagaagcctgaccttatttcctgtcttcatccagtggatttgtactgttctaggctgttagtcacagtctcaaggaggtggagaatggtttctagtttaacctacctttcatagatgcacttgtagatcggacaagcttattgtttttctcttattcagctactgttagtcttctctcctatcgcctttcataaatattaaacttactgagatataatttacagacaatactcctttgtgaacataggagcttaaagtctcttatctttaggagtatattgaaacttgtaggcatttggccgtattataaggcatgttcccaggctataaatgttaaacagatgaatgatattactccagtcatgtatcatcttaccaacctgtcagttctgtagaaaatcacatttctagcattacttgcttcaggtttgcagaagagaaaaacaacaatgttttcactgaacattggcttttagacaaaatgaattctaggactatattaaattcatttttacttcctattctttctatattttataggtttcataaaatcagcccacagtcttaaatttattataattttgatagatatcttagtaaaatactccatccctttcagttattggaaacattaatgaattctaggcttaaacaataaatagcacattgtagaacagcagtgctgtttcaaaactgaactcagttgaattaatcaggcatgacaagatatttttatgattctgacagaagcttaatgaacaatgttgaatagatttaaacacttttttataatatatctaaatggtgtgaattatggtaacactgcctttgagaagaaatcatcaattttggatttcacatacaggatggcaccctaggaaaacgttaaaaagtcaggagaatagtacctttaagactggaattgactaatgaaaatatacattaccagggaaacctcctgggatgcctcgacatttacttgtgatgtgaacgttttcctgcctagaaacagcaaaactgactgtttagctctaacgggcaggtcccatgtgacatagcaacaacagagcaagaaaaccaggaaaattttttgctcaatggatttttttcattatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacaccaaatatgggcattctcagaactgctagggagctggctggtatgtgtttattatgtttatcagcatgtaatgaggtcccaggtgaaacctaggtcaaatccagggccatgttggatccactcattcttagtcaccttggtccacatgctgtttctcagcaacttaccagcccagagctgctgcagatatttcaacagattccttttgctagtcacctgaaactgctgcctaaaatttcctattcttttgagaccaccgtgtagtatacctgtctcactttggagaaatgtctattcaaattccttgcatatatttaaattgggttacttcattttataatattgagttgcaagagttcttttatgttcagaataacagtcccttaccagatacatgattttcaattattttctctcattctgcaagttttctttttaccttctaaatggagtcctttttgaagcacaaaagttttacatttgcataaaatgaaatcaaactaccttttattttgccatttttgctactggcctacagtagttaagcatttgccaaatccagggtcacaaaaatttactgctctattttcttctgagacaatcatagtttcatgtcttagctggacatctgccattcatctagagctagtttttgtgtgtgctgtaaggaaggggcccatctcattcttctgcatgtggcatccagttgtcccagcaccattcactgtagtgtaggatgcacctgcccaaccttctgtccctcctcctgcacttggggtcagaagtgcgtcctgctgaacggttctcccagggtttccaccaatgaaatcccctcatgtgaatcccatgtaggcatctacttctcagaggacctggactaaggagtgggtttaccagaggaaatcatatttcatgagatggaacattctgggaatactggcactcagcatacccctttctacatcaaaagaaggacattgcatgatatggtcatttgggtcccacaagtctgtcaacttagcttatttgtgtttaatttgttttgttatttcttcttctgttgttgttttgttgttgttttctttgagacaggctctcactctgccatccagtctggagtgccgtggcaccatctcaactccctgcaacctcaaactctcaggctcaagtcatcctcccaccttagcctcctgaggggctgggactacagtcacatgctactacacctggttaatttttaaagttttctgtagagacagggtctcaccatgttgccacggctgatctccaactcctagcttcaagctatcctccagcattggcctcccaaggttctgagatcacaggcatgagccaccactactggcccaaaaagttatggcattttagttttacttttcacatggttgtatgacattatgtagatttttaaaattctgtataagtaatttgggcaatgctatataataaaatgttttctttagccacagcttcctgaaaataggaggggcattaaaatgcgcatttgtcaaatcttgaagaagtttcaaatctttagggtgattctgacctctcatcttggttgacacaataatccataaaaacaagtaaagcacccactgtgatctggaaggggtagggagatgaaagtattgataagccaaagtgacagcctctttggtagaaatgatcctgcctatatatctcatgccccacaaaagagggtcctgaatttgccacttctccagagctccatgcagtccttgaagcactctctggctgtctctgcaagttgctgaacagctcctcctgctttctgtggggccgcggaggctgcaggtcccctaggcccaggggttgtcttgcgcacctggtcccaccaagggtgcacccaccaccatgggaggtggaggggaccaggtatagctgcttctgcccctactcctctcctgaccagccaatcttaataggatgaaggagtagggatgagtggagccatggaggttggtgctggaaagaacagaaatgaagacctttgtccaatcccttaaattatgtggatccctgtctgagtactagcagccctggggtagtccgatgattggattcctcccatgcattttaaaccccatagtatggcaaccattgtgctaggtgctgggtttacatgtgggtgatggatgtgtccggtcctcaagtcacttagaatcgagggacagaaacaaacacccacatggctgctgctgctgatgtgatgtcctcgccgccattggggctatcggggggcagaagagggggtaactcattctgcctggagagttgcatggaggcttctcaggagatggcatttcagactgttcttgtaggcataggaagaatacagcgtggccaggtggcctcgagaagacagggcatccagcagatggacaagcatgaggaggaggcctggggatacaaatatcacagaactttggagagctgtgagacgtctgcactaacgaaccctcagttactggggtagactctttccacagggaggagggaatgtcagaagacagggaacaaggggtgggcaggaacccccctggagtccctgtctccctccatagcaaatcaagcagaaaatcaattcaccattcatatatgcatgttatcacacacacacacagacacacatgcacacacacagagacatgcaggcacagtcacacacacacactcacaccacacaggcacacacacacacaaacaaacacacatacataaatgcatgcagaaatacagacacagccatgcacatacacgggcacacacaaagacacatagaaacacacgggagaaactgcctgtcatctcgaaagctgtcatgtcgagcccatcgtgcccatgcaccttttacctcgggggctgtctcccagctaatgaaggagttctgaagccatcaagcaggcagtcactgtgtgatctgaaacactcagaaagctcctcactctgacctatcttcctagtccccttgggatgaagcagcgtcctgttggttttcactgcagcagaagagaatcctcccccggggcagaaatgctgggccaccagaccacacccctctgctctttgccctcagtgccaaagagctcagggcacaaactcgctgtcagcaaaccctcccgacttattgaaatatttgaaaaataagcagtgctgtctgctggaaaacactataaagtaccagtccaaggtacttcatagttccaacatcagactatgcaccattacaggttacaggtatgcaccaccacatctggctaatttttgtatttttagtagagacggagtttcactatgttggtcaggctggtctcaaactcctgaccttgtgacctgcccactgcggcttcccaaagagcattttttcatgtttgttggccacttgcatgtcttcttttgaaaagcgtctgttcacattctttgcttattttttaattgcaattttgttcttgcttgttaagttccatgtagattctggatattagagctttgccagatgcatagattgcagatattgctcccattctataggctgttaactgtgttgctaatttcttttactgtggagaatctctttagtttaatgagatcacatttgtcagtttttgtttttggttgcaaatacttttggtgtcttcattatgatatctttgccaggccctatgtccaaagtggcatttcctaggttatcttccaggatttttatagttttaggacttacatttaaatctttaattcatgtcgagttattttacatatatggtgaaatgtagaggttcagtttcattcttctgcacatggctagccagttatcccagcaccatttgttgaattgggactctttcccattgcttatttttgttgattttgttgaaggttagaaggtgtgaaggtttctttctgagctctctattctgttccactgatctaagtgtctattttggtaccagtaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggcttactccctactcaatattggagagtgtggggcaagatagtctgagccactagctgagccgtcctcttgttactgtttcctatgccctggcagatgcctcagtagtattcactcctggatttaccaagccctgtgttagactggtccaggggctgagtgggtcttggctgtgagtgcaactggggtgagttattctgccaggattgggaactgtgttactcaggaaacttttctcatcacccaccccaatcctgtcccagatgggaggagcagtgagtgctgtgtccaggctccctgtcttcccagtgctcccagcatcacatgagctcctccccagatggtgtggggtctgggctctccatgttcaccatgctcccaccattggctccccatttcactgctctcccaggatcatcccagcccctccagggtcactgcctgaccaggtgggggttgggtgaagaggcagaggtcagggcaagacccctggtccattctgactttaggttcctctctgaaacgcgactgcattccacatcctgttcctctggcaacctcagttgggatcacctgtagggcagtgtagaatcctggtgggtgatgaccaattcctgccaccgtggcttttcaagtatatcgatttttcctaaaatggataaagagactggcaataagttatggaaatactgttttccttactaacagtagatacgtgtttatgtatcaattctggtttttaaaacaaatataaacccataggcactctgctgaacacagattctatctcaaaataacacactttgaagatcttgcaatacctgcacatacagattttttcctttttatctctgcacattacatagaatgactgcatcacaacaaaagtaaccagtgtctgtgtctgaagatccagacggtctccagtgacttttagagaagcgaaatgctgcagaaactgtgcttgcatgaatcacaatttcattgtgtagaatagatttccagacacagaattgctgtgcgaagtaatgcacctttaaagcatctcatgtcataggatggcaatgctggcgacactcttgtctgtgattgtgatgacccagcttgggcagaggatggtgaaacatccaccgtagagggaggggaaactggtacaggcttcctgaaggacagggtgacagggttcatcaagggtcaaaaatatccgcgtctgaattgagaatatgtatttatattcgtttgaaacggcataaagactccctggaaagatgagaagaatcaaataaactttcctccctggcgtgtggccaatgagagtggacgcaggcaggggcgggggagcctttcacacatgacttttcagggttttgattctgaaacaggtgaaaatgtggaggtgaagtagtaagtaagagtggggccgagagtcccagggacggtcacacggtgggcccgcctgatctgttgggggccactagggtccggggaggggaacccgggcagctgcgtgcggggctgctgcagtgacgaggcaccggttctagatatttacccaacggtgttgtcacaaaggggatattataggtgatttctgatttcaaccgcagatgactttcggagacagttcgcatatgcggtttcagttttcaccctgctgcgtcctctccgggttctgcgcgctcctcccaggacgcccgcttcgcccgagctccggacccgggtcctgcccggttgagaccgccgagtgggtgccacgctgcccgccgatgctcccgggcctccgggtccacagcctccggacaaaacggcctttcgaagacctgggaggactcgccggtcgcgacaaggaaccgtggcaggagacaggaaatgcggggcctggtggggtgaagagcacgaggttcctccttcatcctcgcggcgactttgccaccggctcagtgtggagacgtcacagtcccgctcggatccctggggatccgacagtgtggcccccacgaggacccccatcctccttgccctggggctgctgcgggagggcgcccatggcgcactaggtcctgagtgcccaggatccaacaggggcttcccgttgtcgcctccccgaccccgccgctcgcggtccagggctcctggtttctccactgggctgggggccccgagcatggacgtcttgaggcagagaaaaccttgggatggttggaaatgaaggacgggagggagaaccagagaaagggagaggaaggaagcaggtagggccagagaacaaagagaaacctccgccaggaaaatgggaagaggatgacacaggaacagccctacactccaccaactctcagtctcctgctctctgccttgtaaggaacgcaggccccaccccctccagcctcacagtgtttggggtcacccattccagcggggtgaggcgtccccttgtgggtgcggttggcatttccctgaggtctgtggacactgagcaccttttcctgggctcactgccatttgcattcttcttccgatgccagtgggcaaccggtggtccccaaactctgatgagacctcgaccccagccggtgtcgggctcttgacaccgcctggggaaatgaattctaggaccagtaggaaaatagagaaaggacggagatttttttgtaaaagggaaagtacacactcatgtaaagggaatgcaggggaactcaagagagaggcaggtgcaagggggtttagggctgccacctttctgggtttctttaacaaggggtggaatattcatgaaaattcctaaaagaaggtggagactgctcagaactgtggtgccacccatttttacaccaaatattggtgttctctgaattgccaagacgctggtgtgtgtgcgtttagtatgtcaattagtgtataatagggtcctaggtgaaaccgaggccaaacccagggccatgttgggtccactcattcttagccagcctggtccataccctgtcttttagggtcttatcagcccagagcctctgcagatatttcaacagattccttttgctagtcacctgaaactgctgcctaaagtttttttcttcttttgtgaccacactgtattatacctgtctcactttggagaaacatctttttgaattctttgcatatatttaaattgggttattttgctttataatgttgggttgcaagagttctttatgtattcaggataccagtcccttactagatatacgattttcaaatgctttctctcattctataaggatttttttaacctaaatggagtcctttttgaagcacaaaagttttacatttgcatgaaatgaaattaaactaccttttattttgtcatttatgctactggcatacagtacttaagaagcattagccaaatccggggtcacaaaaatttactgctctgctttcttctgagactttcatagtttcatgtcttaggtgaacatctgccattcatctagaactagtttttgtgtgtgctgtaaggaaggggtcagcctcattcttctgcatgcagcatccagttgtcccagcaccattcactgtagtgtaggaggcacctgcccaacctcctgtccctccctcctgcacttggggtcagaattgcctcctactgaacggttctcacagggtttgcaccaatgaaatcccctcatgtgaaacccatgtaggaacctgcttctcggaggacctggactagggagtgggttcaccagaggaaatcatatttcatgagatggaacattctgggaatactggcactcagcataccctttaattcatcaaaagtgaaaaatcacattatttggtcatttgggtcccacaattcttctgtcaatttagtttacttgggtttatattttttgttgttgtttctgctgcaattgttgttgttttctttgagacaggctctcacactgtcacccaggctcaagtgatcctcctaccttagcctcctgaggagctgggactacagtcacatcctactacacctggtcaattttttaaattttctgtagagacagggtctcaccatgttacttgccatggctgatctccaactcctagcctcaagtgttcctccaacattggccttccaaagttctgggattacaggcatgagtcaccaattctgacccaaaaagttacggctttttagtttttacttttcacatggttgtatgacattatgtagattaaaattccatataagtaacttgggtaatgctatacaataaaatgctttattcagccacagctttctaaaaatagatgtggcatcaaaatgcgcattcatcaaatcttgaaggagtttcaaatctttagagtgactctgaactctcgttttggttgacacaataatccataaaaacaaataaagcacccattctgatctggaaggggtaacgaggtgaaaatattgataagccaaagtgacagcctcttttgtagacatgatcctgcctaaatttctcatgcctcacaaaagagggccctgaattccctgcttctccagagctccacgcagtccttgaagcactctctggctgtctctgcaagtggctgaacagctcctcttgctctctgtgggtctgtggaggctccaggtcccctaggcccaggtgctgtcatgctcaccaggtcccaccaagagtgcaccccaccgtggatggtggaggagaccaggtatagctgctcctgcccctacccctctcctgaccagccaatcttaataggaggaaggagcagggatgagtggagccatggaggttggtgctggaaagaacagaaatgaagacctttatcccatcccccaaatgatggggatccctttctgagttctagcagccctttggtagtctgatgattagattcctcccatgcgtcttaaaccctatcgtatggcaggcactgtgctaggtgctgggtttacacgtgggtgatggatgtgtccagtcctcctggaacttagaaaccagatatgtccagtccttcaggcacttagaatccaggtacagaaacaaacatctacgtggctgctgctgctgatgtgttgtcctcgagatggttggggctagaaagggcagaagagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatagaactttggggagctatgagaagtctgcagtaatgaacccttagttactggggtagactctttccacagggaggagggaatatctggaaggaaggtagggaaggaggggtgggcaggaacctgtcctggggtccctgtctcccttcacaggaaatcaagtcaccattcatacatatacatatagcatacactcccacacacacacagacacacacatagagatatgcacatgtggtctcacacacacagagagacatgcatgcatagtctcacacaaacacacacagtcgcatgcacagtctcacacacacactacacaggcacacacacatatgcacacacacaggcacacagacacacacatacaaacatacaaacgttcatgcacaaatacagacacacacacacacgcacgtgcacacacagacatacataaacacacgggagaaagtgggtgtcatctcgagagttcttgtgtctgtcccatcccacccactcacctgtcacctctggggctgtctcccagctcatgaaggatttctgaagccatcaagcagtatgtcactgtgtgatctgaaacactcagacacctcctcactctgaccttccttcctggtatccttggctctgggatgaagcagcgtcctgtgggttttcgcggtagtaaaagagaaacctctcccctggggcagaactgctgggccaccagagagcacccctctgctctttgccctcagggcatcttgatctgcagggtgagaggaactgccccaatcccctgaaataaactctttattgatctctcatccaccatgatgtcacaattgtctcatccaccatgatgtcacaattgtctcatccgccatgatgtcacaaactcactgtgagcaaaccctctgggcttattgaaatatttgaaagattagtggtgccatctgctggacaccgcaggaagtactgatccaaagtattttatagtttcaacatcagactatgcaccattgctttagatgacattgtagttttacaatctgtgatttcaacagttgctgtgataaaaaaccaagaatccctgcaaaaataggtatgaaataggaaatcagggtggctgtgtccaatctgcttccaaagtttgagaagttgttcagtgcccagtaggtacacatgtccattagtaaacatttgtgcttatttaagaaagaaataaacatactactttttcaatttatgtgaaatattttcttaaatggcaataaaattgctaggtcataaatatttattgtttgctcctgactacttaacgaatacattcttgggtactctttttttatagggttgtcttgaaaatgttacaaaggcaccttctggattttccctggaccactccagtacatttcatgggctctgcctcctgcaggaaggcatgaagccaggacacacatgttacttttttgggagtccttcctgtttagcctgttgaggacctggagactcccttcccactcttcctctccattaccttgctccccaccacctgaatcatctgtcactttcctacacctgatgcaatgcacctgctcattacgttcacctgctgtccccactggagcacggattttgtctgttttcctcagagaagtatccacagcacagctcactgttggttctgaggctgtacttaccctgtgagtgaataaatgagaggcagtgagtggggcagcggcctctttcctgtccatttgttcactacactttagatggtaacttaggatgtggtgtagaccagtgtttcctgggcacaataaatcagaatatattgtgaagacaagaagtagaaagaaatgttaggtggaagaatatgaattttcaagtaggagttgggcagagtgagaaaccaatcaggaaaggggtaagtttggtttgcttgtagataacatgtggagaaatgcagccatctgcaatggagactgggcgctgttagattcgtttgcgccaagaccacctccactacctgcccttgtcctactctctcccgaggctgaatgcagctcctgtgccttcagtgccaaggaagccatagtttcaggtcagaggaagggctggggcggaccctggaaaaggagagggtgggtacagaaggggacagctgggagcaatgagttcctgaggataaacaaaaaaggtcacttgaaaatggaacaaaaaaggaataaagaacaaggtggaaatcatctgaaattccattatgcacagtttaatgttagggttttagtagaatcatcttcaatttttataaaattatgatcatacaccttataattattttaaatgactagagtttatttttctagggcagggttagagtttatagtgcagagttctctcttgcctgtgtcagttaaacccacttttttttgcctcgtgtcaatttgtttattcatttttatttttaaattttactttaagttattggatacatgtgcagaatgcgcaggtttgttacataggtatacatctgccatggtggtttactgcacctatcaatccatcacctaggttttaagccccacatgcattaggtatttgtcctaatgctctctctccccttgcccccaaccccctgacaggccccggtgtgtgatgttctcctccctgtgtccatgtgttctcattggtcaactcccgcttatgagtgagaacattcggttttctgttcctgtgttagtttgctgagaatgatggtttccagcttcattcatgtccctgcaaaggacatgaactcattctttttttttttttttttttttttttttgagatggagtctcaccactctgtcacccaggctggaatgcagtggcgcaatctcggctcactgcaagttctgcctcctaggttcacgccattctcctgcctcagcctccccgagtaactgggactataggtgcctgccaccaaacccgtctattttttgtatttttagtagagacggggttttgccgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctttctctatttcctactggtccttgaattaatttccccggcaatatcaagaatctggacactggctggagtcgaggtcccaccggcgtttggggacctccccttgcccgctggcatcagaagaagaatgcaaatcgcagtgagcccaggaaaaggtgttcagtgttcacagccctcagggaaatgccaatcgcacccacaaggggacgcctcaccccgctgaaatggctgatcccaaacacagtgagggtggagggggtggggcctgtgttccttactgggcagagagcaggagacggagagtcggtggagtgtgggggctgtgcgcgtgtccccctctccccattttcgtggtgggggtttctcattgttctccggccctgtttccttcctctccctttctgccgccctccctccaatccttcttttccacctatcccaaggttttctccgcctcacgacgtccatgctagggcctcccagaccagcggagaaaccagcagccctggaccgcaagcggcggggtcagggaggcgacaacgggaagcccctgccggaccctggacactcaggacctagtgctgcccgggcgccctcccgcagcagccccagggcgaggaggatgggggggtcctcgcaggggccacactgtcggagccccacggatccgggcgggacggtgaggcctccacactgagccggtggcaaagtccccgcgaggatgaaggaggaaccccgtgctcctcaccccaccaggccccgcatttcctggctcctcctgtctcaggaaccgcctgtcccttgccgcgaccggcgagtccttccgggtcttcctgaaacagtttcgtcccgaggctctggatctggaagcccaggggcatcgtccgggagcggggcacccactgtgggtctccgccagccagcactcaggcccggagctcggggacagcgggcgccctgggaggagcacacagaaccatatcaaggcttaggtcctgtcgagctctagagggtttagcaaattcaggtctgtttcagactgtgtctctggtcataaggaacccccacggtgcgtggtgtgcagacagcaggagctcaggcatgtgcggtcctcacatttgagtggggcagcagattggtggctccagatgctgtgtgtcaaggagaaggagattccatccactggagaagagcagaggaactgggtgtaaccccaggaaggagaggctgccaaggactgtgtcgacccagaggacaatgctggagttaattcccagggaaggtgcctgggtcacagcctttaaggcagacgctgactgaaaagactgtatacaagtaggaggtcaggtctctgggaaccctcagaatacggctcagtcctggggcaatgcccctgccatccggcctcctgcacactccagattctggccctgcctggagcagagctgactcggagacaggggtactgagctgctcctggagttccaaggtcactgctgagctggaccaggagtggatggggcggggcagggacagtctcattcagagctttgggtacagccctagggtgagaagaggctgagagagaaggggaaaagaggatattgcctgagtggctgggggcagaatgggacccaggggctctgtccagtcctcaccctaagctaagccctccacagctgccaggaaccactgggaccctcacctgtctctggtttctgccaccacttccagatgccctcatgataattaagacaaggatacaattggggtttccttttgaggatggctgcagggaccgtccagggactgagcagaggtgtgggtgcagccatggatccaggcatcaatggttggccacagatgggtgtactgcaaagtgagctccacgcacgcacagacccctcccttgcctcctgctcccatgggaaacacaattgatcacattccaattgagcaacagtaggccactagggcttttttccctcaaaagctgtacacagatctagtatagtctcaaagacctcatgcttctagtagagaagcaaagaaatgtgtgagcatttgtcacacagggagatccggatacgctccatcactgtggatccaggcctcagggagcaggagggtgttccttcatgtgggaagatgagggacacacatgggagggggtatttgtgcgcggcttggaaggatggctggtccttgcccagggggaacaggcccaaagcaagcgctggcagttagtagctatggggagctttcatttgaacctgctctgctgagtcccctgggccatccccacacctggtggggcactgttctaaggggagctcagggtcaatctctctgatgtgctttctaaatcagcaaggtgcctcacaggttgtgattttagagacaaggttttcaatgctttgcattaaaatgcaaagattttaatgagcagagtctttttgccaatccgaattgggcagatcccagcaagacacatatttttaagacaatttttaaagctgtttaattttggtaaaaaagtagaacataaaatttactatcttaaccaattgtttagtgtacaatatcttctttgaagcctctgaagacctggtgcttctgtaataaaatctagccccgggccaggcgtggtggctcacccttgtgatctcagcactttgagaggccgtgtcgggctgatcacttgagcccaggagtccaaagccagcctgggcaacatggtgaaaccccgtctccaccaaaatacaaaacttaaccgggcttggtggcgcgcacctgtggtcccagctacttgggaggctgaagcaggagaatcgtttgaattcgcgaggcagaggttgcagcgaacccagatcgcgccgctgcactccagcctgggcggcagagcgagactctgtcacgaagaaaaaaaagaaaagaaagaaaaaccaaccaaccaaacaaacaaacctagcccaggctataaccacgtccactcgggatttgggatgaggccgcggggatgggactgggcttggatctgcgcacaggacggtgggttgggagcactctgcaacgcagggagagggaaggcgggtgtcgcaggtacaggcgaggacagggagaccctgtcgcggctgaacacttctgtgcattttcttcacctttctgtgcatcggtatccacattggattaatacaaaatgaaaaaattgcggtgatgattacatgagggggtcatggaaagaagcctttggcaggactggtcccgggcaggcagccagcaaagtctgactggctgaagcagggggaagtgcgcgagcgctgcagtagaaagtggggtagacttggatgagcaacttggctgagagacacctgattggctagcggctcagcaaagggggtgtgtttcctccgaggggcggggcagaaggagtgctagagtttagggcttactggagtttagggctgcattcagacgggctgcattcagacagcctgcgagccgccaggtgatccacgggctgggcttcgcttctgctgtcccctgcgatccaactccccaatggcagcggccgccagccccgcgttccttctacgcctcccgcttctgctcctgctgtccagctggtgcaggaccgggctggccggtgagttcggggatggagcctaagcggggcggaggccaaccgtggggggctgtggactgtgggcttcagaggaggggaggcttctggaaggacccgtgcgatcaccccggactgcgcccccgctcagtttccctccgcgtctccttcccgccgggtccgttcccagaggctacttatcctccgaggggaggagctggtcagagaggaggctggaaaggaacccccggagagtggaggggccagagggctgcagagggcgacgtggagcggggatccctagtgcagcccggcagtcccacccgccctcgggaaggagaaaccagagcccccagaatccgagctggggtcaggacaggggtgaagtggggttgcacagggacacaatcacagacactcccaccagccaccagcctgctctgttctcacccgctctcaaccacacaaaccttccagcacccccagggctgcgtgcccttgaatttttccctgcactttcctgtagacactcacctgcacccagcggctcagcagacacttcccaccctcccctcaccatccactgccaccacccaggtaacatcctcttactccccacctcagcccagctggtcaccccagaggtctccccatccatgaaggggccctcgcgacctcttacaccacgtgacaccttctgcctcttgcctgaggacacaccccagcaaacacaccccaagctccccacagaacctgtgcaggggggatgggaagcaccatttcctccaggatgaccctgggaactctggtgagtagaggcacccacttctgcccttggggcccagacctgcctgttcttcctactggggcgccagcgtcatagagaatagtcagtgtgtagacaggggtcagcaaaccctttctagaaagggaggaaggatgccctgtgatctttgcaggccttgggttctctgtctcagtgtccagtcctgtccctttgcagagcaacagcaggcaatggcaaccttcaaataggggggaccagatttggaccctgtcctaggttgctgaccctagatgaggggattacagtgtaccagcaaatagtaccccatcccctatggtgtcatctccaagtggtgtctcaggtgtcagttggagagtagaaggtggtcctaccttgcctgtggcttctgggtggtgtggatgtgatgggagtgggggtcccatggttcagggtctactctcccctcctttgctgctgagtggcatctatggtccacgggggccatcagtgaccttccctgaaacctgaggtgtaagctgagggtaagggggtgcagccacgtggtgtcctgggaatcggggccaactgcttgtgcagcttcccggttccctgtggccctacttctgcccatcccaggagaaccacctgtgtcttctcactgccagacctctcttcctaatgacctagagggtgaggagcccacccgtaatgggcagctctgaggctggatggtcacggcccttccatggctaaaggccccatctctgccaaggcccagtactctacaggagacactttttaatgttgagatttccttgctgtgagtggcgttgccttgcctctgaacattcacatggaatctatgttgtgattctccaattagacattggaaccacatgcacctctaggatcttagggggtcttgggtcattgggcacttaaggcaggtccagcctcgctcattcatggattgcctgtggctgcctttgcgcttcaacagcagagctgagtagttacaatggagaatatattccctgcacacctttacatgtttacaaaattgcccttcatagcaaactctagtggccataaatacgtttggagaagcccacaaagaatcattgcacttgttgcggggttaaagggtccttcctcactggaaactggtgtcttcttctagtcatgggttcacggtctgagaagtggctttattctgcaaattaggcaaagcagccttgttcttgaaggactggctactttcagcctcctggtcatccatcatttgttttatctctgtttcttgtaattatttaaatccagcactattcaggttgggtttccatctcttctggatcttggacccctttgttctatgagccatgggcatagctttgtatgactgaggtctccagctggcattgtgacttctctaatcatttccatcattgcaccctccttgttcctgacagttgacaacctccacctggaatctgttatttcgggatttttcatcccattactactgggagcccatttcaggaagagcatctcctacccccaaccctggccttcagcaataggcatccctgagcttcatcccattctggtgccttctcatggggccttctttatatgccaggtaaacaggagtcctccaggcttcccatgagcacagcagatggacattgttctggattttcacactcagacccctccagcctgggcacttctctgagcctgtgatccctccgtctactgcctgccttagattttcagatttttctatttcttgctgtgtggaccatccctttgtccaaggtttcaggaaggcatcctcatagtagatgagcaccaccaccaggggctttgccaacgtgttaaatcctgtgaccatgataattaactcttctttatccaactgggttccatcctcactccgtcccaccatgcaccagtatcctcaggtgcagctcccacaccctgtcccacctcccacagtccacgtgggctactgctgaagatcctctgtcatccaggcccttcctcctctagcactcctggcacctctctagcaaggtcctgtgttgaccgatgtggacagaggggcagtgggacatgtctggggacatgtggtttctcagcaggcagggacctcctcctcctctttgccctcatggaagtggggagcactcgccttaatcttgtggacaccacagttctggaggaggcactccttgctgggccagcccagccctccagaggcttcctcttattgtcacagtgtggaggaggggtatctaggggtcttttcctccccacccacccctcacctgcctttctccacagaccctcactctctttgctatgacatcaccgtcatccctaagttcagacctggaccacggtggtgtgcggttcaaggccaggtggatgaaaagacttttcttcactatgactgtggcagcaagacagtcacacccgtcagtcccctggggaagaaactaaatgtcacaacggcctggaaagcacagaacccagtactgagagaggtggtggacatacttacagagcaactgcttgacattcagctggagaattacatacccaagggtaagtttcagatggcccaggacagcagggagcagatacagtggtaggttagaggcatttatagttttcatgtaaaaatacaaataggaaggtcatctcaccccgcaagacgtctagaggcaaggccaggatgtggcagagcaagtaagaccaggaaattgcaagtggaagaggatgggggctcaatatctgtcaaggccagagctgatctctctttgatgggggcagaacccctcaccctgcaggccaggatgtcttgtgagcagaaagccgaaggacacggcagtggatcttggcagctcagtttcgatggacagatcttcctcctctttgactcagaaaacagaatgtggacaacggttcatcctggagccagaaagatgaaagaaaagtgggagaatgacaaggatatgaccatgtccttccattacatctcaatgggagactgcacaggatggcttgaggacttcttgatgggcatggacagcaccctggagccaagtgcaggaggtaacaggagaaaaagaaatggggatctccaatgagatcagaaatggggatctcaagaaactaattcttgagttcagcttcaatcatcccagtgtacacgtttatgttaaaatgacctcctcgtggggtgctcctcctgggggtgctggcgtgcctgtgctctcccaccctcctcttccttctccctcctgactcctcttcctcactgcacttgcttctgttccccacactgtggatttctcaccagcctcgaaactgcaggtgtcactattttcaggcctttctccttagtgttccctcttgagaatcacttttcctttcctcctctggtctgtttctggaaatccatcaaaacctcctccaaggccagcctcgtgaccctcccctcccgcaccctggagcatcacctcctcttccgccacagcaggagggtgggctttgctgtcaccttgcttccctcagcagctctgtgagctccctgaggccaagggacaccccctctcccttcctaccccaggaactctcccaggggctgccccatagcagaggggacaaaacctctgccttccaggatgacctgggtcagcaggagctgaggaggcatctcctcagatttggggcctggacaagggttgtcactcttgtgcttccatttcagcaccacccaccatgtcctcaggcacagcccaacccagggccacggccaccaccctcatcctttgctgcctcctcatcatgtgtctcctcatatgctccaggcacagtctgacccaaagccatggccaccaccctcagtccctgcagcctcctcctcatcctcccctgcttcatcctacctggctgctgaggagagtcctttggagtgacaggtatgggggcagaattgggagtggagcaaagggcaggtgggtgaggagggaggacagggatggagaattcccagagtcccactccctatggctgggaccttctcatcctaacatgagacaggtgaatgagaccttgtgttgcttgttggaaatgacctgggcagctctgccctgagttctgatggattctcaccatcaaaggccagagggaaaggcgcagtggtgccataccaaggctcagggtctgttgagcttgagagggtttagcaagttcaggcctgattcagagcaggtttctgttcaggaagggtgtgtggcctgcaggcagcaggaattcagacatgggcagtcctcttaattgggttaggtgcatcagggtagctttacatgaggtatgacaagggaagggggattccatctctgaggctaagagagagatatgtgtgggcggcaagccacccaggtgccaaggcaagagactgaaggcacaagctgttccagtataataaagaaaatacttaaaataagaatagttgtattagacgtagaatacagacatgattatctatgaatattatcaatcattagtctgtagtgttactcttttttccaatgttataataatctctgttccacaattataacccaggaaaaaccaggccatgcagagacaggagctgaagggacacggtgagaagtgaccagaagacaagagtgtgagccctctgtcatgcccagacagggccagtagtgggctcctcagtctagcagtagcgccagtgcctgggaaggcacttgttacttagcagaccgggaaaaggagtttccctttccccgggggagttagagaagactctgctccaccacctcttgtggaaggcctgacatcagtcaagcctgcccgcagccatccggaggcctaaacgtctaccctgtgatgctgtgcttcagggtcacgctcctggtccactttcatgttccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgaagtccgagaaatacatagaagaaacaatgacgtaagctgtcctctctctctccgcctcagctaccaaatagcgaagcgccccttgtctggtggacacgtgactcgcgtgactttacctatcattggagacgactcacactccttaccctgccctcttgccttgtatacaataaataacggcgcagccaggtattcggagccactacaggtctccatatcttgatggttccctgggcccagctgtcttttcttccgtctctttgtcttgtgtctttatttctacgatctctcatctccgcacacgaagagaaaaacccacaggccctgtagggctggtccctacaactatgagtgtaatcccagaaggagggggctgggagagccttggtacacctaattgaaaaggagggggcgcagggctgccttcccacagaaagtggcttgggttccaggaattaaggtggaaggcgaagagtagaggctgcacatgaaaaaaatttttaaaaagtcagtcccatggacccatggggttcgagtccagaccttgaggcagctcccttgccatcaccttcctgcacaccccagatcctgagcccgctcatggccctgccaggagcagagtggactcagacacgggggacctgagctgctgcttaagtccatgggcaccactgggctgga

SEQ ID NO: 13428 - DNA, 8461 bp, Human
gcccccagggccatgaagaggccatggcctgggctcagagatccagctctcctcagggtgggcctggcagttgctgacttcagggagagctggaggcctcacaactgaaataggagacctgccctgggtccttagcatgtgcaaggacagggttccttgtagaatctgctcatttcatctgtgttcatagcatttgtcattttccacatgcagacatccattcctagaaagctgaagaagcttgcacaggaatattcagccacaatatcagctgacttccatatctgaatgcatgatctctagatcccggccattacaataacatttgggccacttctatccccatcctgggcaggcctgagtctgttggccagatgcctgcagcaggggtgagtcaggagggcccaggtgtgcacaaaagcccctcctcctgtcctgcttggggctctcctgccagcctccttctaccttcctcctgttcccccagtcactggcccaggtcacctggcctcggggtggtgctgccagggccttcccagaggcctcctcccaggactaacctgggctcctgcccccagccctgtacatgggaggctcttctcacacacagatcctgggacccgccaagctctgcccctcccaaatctgagaactgcccacccttgtgtgtctgttgtcctccaaactaccctccacatggcccctcctgcacaggggctctagtgcatcaggccagaatcttctaggctcctgtgtccctgctcagtcacagaggtggctgccctcccatgactctgtcctgaagcagaaacaggccctgggctttgtccaggcctcctcctctttcccacagcctcaggaccctcgggattgatgatcaccaggtgcaggtgatcccaacatgaagactgtacggagtgggaggtctgtgccgatttttctcattcaatagggaatgggctgagtggctggggcctgagtggcactcaagatctctgtccactcctcatcccaggctaaagccctcccttgcggccaagggccactgggcccatcacctccctctggcttctgcccacagatctagatgtttccatggtgactgagacgaggatacactcgggttgccgctttgaggatggctgcagtcaccatccagggacagggcagagatgcgcgtgcagccatggatttgcgtgtagctggccacagatgggtgtacagcaaagtgagccccacgcatgcgtagaccctccctcggcttctgctctccatggaaacacaattgatcatttgatcactgatcacggtaggccactagggctttcttttctttcttttttttcccagaagtcataaagggatatagaatatactttattctatatatattctatatattcctcatgcttttagtggagaggcaaagaaggtctgctccggactgggaagcagctgcgccctggacggagaggggcggggactccttggcgcaggctgaaggagggcaggtgtcgctggcggaggcagtgacggggggacacagccgccactggatatccctgtgcaagtttcttcgctttcctgtgcatcagtgcttacattggggtaataataaatggtgtgttaaaaaattaaatgaggcggtcaagaaggaatcgtgtcctggcccgcgcggagcctggggtggagggtaagggttggccagagggggccgctgtcaggccacgagcccggggcgggacgaagcggagccacagcaggcataggctccccgggtcccagcctggggtggggcggggaagggcgggacggggcgggatagggcggagcatccctccaaacgtgggcaggcgtaggctcccctggatcccggggcgggacgggacgggacggggccgagcacactcaatcactagctggcatgcgagggccgaagtgattcatacgctggtctccacatcgactgcgccttgtgtcccgggcgctcctggtctacaatggcagcggccgccagccccgcgatccttccgcgcctcgcgattcttccgtacctgctattcgactggtccgggacggggcgggccggtgagttcggggatggagcctaagcggggcgggggccaaacctggggggctgtggactgcagcgggtttcagaggagggaagccttctagaaggaccggcgcgatctccccggactgcccccacgctcagttccgattcgctgctctttttcgccaggtccgcttcctgcggctgctgcttgccctgcagggcaggaggggggtcaaagaaggcgaaaaaagaaccgcaggagggtggaggggccaaaaagctgcagagggcgaggtggggaggggatccctggtgcaaccccgcagccccactcgtcctcgggaaggagaaaccagagcccccggaacccgagctggggtcaagacatgggtgacaccagcgtcatatagaatagtcactaagcagacaggagtcagcaaaccctttctagaaaggaaaggctgaaggcactttggtccttgctggccgtgagttctctgtctctgtgtcaagtcccgtccctttgtagagcaacagcaggcaatggcaacctgcaagtaaaagagaaacctgaaatggaccctgtcctaggttgcagactccagatgagggcacatgctgtgtcctggcaattgctgccccatcccctagggtgtcatctctaagttgtgtaagttgaagagtcacaagtgtgtcctaccctgcctgcggcttctgggaggtgtggatgtgatgaatgtgagggggagtcccatggttcggggcctactgctcccctcctttgttgctgagtagcattaacggtccccaggggccattcagggaccctccctgaagcctcaggtgtgacctgagggtgggggggtgtagccatgtggtgtcctggggatcagagccaactgcttgtgcagcttcttggttccctgtggccctgctcctgcccatcccaggagacccacctgtgtcttctcactgtggggcctatcttcctaatgacctaaagggtgaggagcacaccctgtgatgggcagctctgaggctgtgtggtcactgccctcccatagctggaggcccatctccacaggggcccaggaccacagcaggagccacttttaaatgaggggatttcactgctgtgagtggcacagctttgcttctgagcactaggggaccctgttggattctgtggttgggaatagccatgaaatccacatagcaccttttccaaccacacatgcttctgggatcttagggagtccagggtcaaatagctgtagtggcaggtccagccacacccctcatcacagagtgtgtatggctgcatcccagctataagagcagagttgagtagtgacaggggaggtcatatgaccagcacaaactataatagttactacattaactacaaacactatccattcccggtagaaatccaggaaatgtgaaattaccattgaatgggtctatgaacccagcacatccctctaagctggacctgacacagaagtccatctgttactttgccccaaatgcacctcatgagtaacaggggagcaagttaatgcttcacatccctgggaagagctcggatcacacactgtgtccactaggagtgtctgagtatttgctgtttcatggtgtacagttaccagagtgactacccatctggctctgtgggggaggctgaaggagtcattgcaattgctgtggggttgaaggagcccaccaggggctctgggctctccttctagtaatggactctgcgtctgagatgtggctcagttctcaaagctgggcgagggagctcagttatttcccggggtgacaactttcagcctcctggtcatccatccttgcattttgtctttgtggtaattatttaaatctagtagtatccgggtggagtctccatctcttttggatcttggacccttttgttctatgagccatgggcatagctttgtaagactgaggaccccagctagcattgtgacttctctaattatttccatcattgcaccctccttcctgctgacagttgacggcctccacttgagatctcttatttcaggattttccatccccattactaccgggagcccatttcaggaagagcatctcctacccctgaccctgggcttcagcaacaggcatccctgagcttcttgacagtctgctgccttctcctggggccttctttatatgctaggtaaacaggagtcttccaggcttcccttgagcacagagggtgaacattgttctggattttcatactgcagtcactctggcatgggcacttctcttagtattttgttccttcctgtacaacctgccacgtaagacctgggttttctgtttcatgcggtgtgggtcattcctttttccaaggttccaagggcaacctactagcagctgaccacattccagggaacttaccatgtcttgttacccataataaatgaactcatccttatccaatgttaactacatcgtacccactgcaccacgctccaacatcctcagggtgccctcccacactctcccgcctcttgcagtccacctgggctgctcctgcagatcctgccatctaagtccttcttcctgtagtgggcctgccacctccctggcagggtcctgtgctgacggatgtgagtataggcctgggcagagtggggagatagacatgttagcgacccatggttcctccacaggcagagaccaccgtccaggaagagaaatccatgctctgccagcccagcccttcaggaaaccctcttgctgtcacagtgtttggggtctttcccccaccccaacactctctggtgttttttctttttttccatagacgctcactctctctggtataacttcaccatcattcatttgcccagacatgggcaacagtggtgtgaggtccagagccaggtggatcagaagaattttctctcctatgactgtggcagtgacaaggtcttatctatgggtcacctagaagagcagctgtatgccacagatgcctggggaaaacaactggaaatgctgagagaggtggggcagaggctcagactggaactggctgacactgagctggaggatttcacacccagtggtgagtgaaagagaccaaggacagaagggagcagactgtgggctcaggggctgttctgtgtgtggggagaagaaattagacatgggacctccatgaagcccagcagcaagggcaggacttggaggagacaacaggaccagatgagaatggtctcagcataggaggatgtgggacagggaagagaatttgtaaacaccagggctgatctctttctgattggggcaggacccctcacgctgcaggtcaggatgtcttgtgagtgtgaagccgatggatacatccgtggatcttggcagttcagcttcgatggacggaagttcctcctctttgactcaaacaacagaaagtggacagtggttcacgctggagccaggcggatgaaagagaagtgggagaaggatagcggactgaccaccttcttcaagatggtctcaatgagagactgcaagagctggcttagggacttcctgatgcacaggaagaagaggctggaacccacaggtaactgacaggggagcactgggagcatgttggagatgccatcgagttacacccttgtctgtcagtgtctgagtatggtgggtgtgggtgtatgggtgtgagtgggtgtgagtctatgtatgtgtgagtgtgagtgtgtgtttgagtgagtgtaagaacatgaacccctcatgggggcctcctccttggggtgcctatgctctccctcctgactcctcttcctcactgcacttgcttttgctccactcactgtggatttctcaccagcctcgaaactgtgggcgtcattgtgtttctagacctttctccttagatttccctcctcctaggattacttttcctttcctctcccttggtttgtttctggaaatccatcaaaaccacctcgaatggcagccccgagactctcctgtcccggccctagggcatcacctcctcttccgccacagcaggagggtgggctgtgctgtcaccttgcttccctcagcagctgtgtgagctccctgaggacagggagcaccccttctcccttcctacccccaggacctgtcacagcagctgccccacagcaggggagacaaatcctctgccttcccggatgacctggggtagcaggagctaaggagccatctcctcagatttggagcgtggacaagagttgtcacttttgtgtttccctttcagcaccacccaccatggccccaggcttagctcaacccaaagccatagccaccaccctcagtccctggagcttcctcatcatcctctgcttcatcctccctggcatctgagaagagtcatttcgagtgacaggtactgtgggcaaaactgtgaggggaacgagagacagatgggtgaggtgggaggaagggaaaggagaatttccagagtcccacctctccccatggccgggaccttctcgttctgacatgagacaggtgaatgagacctggtgtcgcctgtttgcaatgacctgggcagctcaaccttgagttctgatggattctcaccatcagggccagagggaaagggagggacccatatcaaggctcagggccagttgagttcaagagggtttagacagttcaggcctatttcacagcaggtttctatctgggaagggtagtggtgtgtggcctgcaggcagcaggaactcaggcatgggcagtctgcacagtaggagaggagtagcatggccacttcaccaaggatgtcaagggaaggggtgtccctggaggaggctaagaagagagaaacctgggggaatcccaggacgagggggctgtgagggccttggcccacccagttcctaaggctgcattcccagagagagcaccttgagtcccagcagttaaggtggaaggtgaagagtagagcgtgtccaggatgaggtttaggaaatggccgagccccttggacccatgggattcctggctgggccctgggacgatgccactgccattctgcctcgtgcacactccagatcctgagccagctgatggccctgcctggagcagagtggactcagctagggcagctgagctgctgctagaggtccgtggtcaccactgagcttggccaggaatgaatggggcggggcagggacagtcccattcagagctatgggtgcagctcccagggtgaggagaggctgagagcgaaggagaaagaaggtttgcctacaaacccacccaaggccagggaacgtggatccagagacctctctttggacagggctcccccaggtcctctagacccttctatgaaagggaggagcaggccctgagtgagggtgcagacccctcattaccagcctcaggtctgagcccctatgggctgtaacaggacctgggctgcctctgtggtgtggtgaaggagggtggagtttgggaaaggctgcacagccaggggtagggttggagggaaaaacatgttccttatctgggggagaagctctgaaatggggagggcctgggaaggatcacccaggagaacagacccaggtttttctcagccacttaaaccaatgcttcatctttcctcaaggtggaaggtgatatcaagaagcctctgttagcctggtctggttcctgctctcccttcagggaggccgcctgtctactcaccactgtgcctttctggaaagcaggagttcaagccttagcaagcccagaggcccccagcagatgatgaggacattgtcggctcaacatctcaggccactcattaccttcgctcatgatcccagcagccatttttcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacagggtttcaccttgttagccaggatggtctcgatctcctgacctcatgatccacctgcctcggcctcccagagtgctgggattacaggcgtgagccaccacgcccggccagccatttttcttaacaccttctgccactttctctcggtgctaatggatggaattcctgcacaagttttaactgaacaagaaatcccagcaaaaggcattttctttctacttctttgattgtggaaaagcagacatttctctgaagcatgaccttattcttcgaaacggtattgctagtaaaatagcatgcaggacttcagacctcagggatcctttc

SEQ ID NO: 13429 - DNA, 57761 bp, Human
  misc_feature (1)...(57761): n = A,T,C or G
acaagtagactgtagagagacatgggaaggtgcttaacaataaggcacaactgaactaactcttgtttattaagtattaatttaagcttccttttaatctagcatagattttttaaaccagttgtggttttcccactgtattataaataaaaacaaaccttcataagtcaacttgtccttctcacttaccaataagtccctgtttgctctatttacctttatgcgtcttttacttctttggctttcccagaagatcacatagtggtcatgtaaaaaatatttttagttcagtaactattaaatgaaccagcaattatctccttctattccctggaattgctatcccagacactggagatacagcagtggacagttctccatcctacatgagagatgttacataggaggtatttatggtatttatattaataaggacaccacaagtgtgcagataacattccccactcaacaacttctggtttccttcaaaatctctccaagaaggcccaaatctcgcaaattactatttctgaaaatccaaattacaagctttcagtcataggtaacttctgcacatggaaatgatttattttgggagatgtgacattatcactcatcaaattaggagacttttaaagccctaccactttcaagacacctggctgaatttaacttggtagcagccagattcgcagatggaatactgtgtcaggaactcttagtaattcatttatcttaatacttctaaattttgcaagtttgtctagactatacttcttttttttcccatttgaataccaaaggatgaaatcttattctaagttttcaaaagacctggaaggaatccactcataacatattttaaaacaaggaattggaatgagcccaagatgagggctcagacagctaagttttgggcccagcatagtcagtaactatcagggtaacttgaagaggccacttaatctcaggttcttctgtagtgcattgtaccttccctccccggagcccagagttctatcaaaggtaatatgaatgggtatttggaaagggcactaaacctcacatggatgtaagatcctttcatgtgttccttcaatgattgaaatgtttcttcctacgttcaccagccacttcctaattctcaagtacaatgcactactttcagttctttatttacttgaactttgtgtaacaggtgacatcatggacaattccctccttttttccttcattctctagtttaccttttcctggtttatttcctatcttgtgggttactcgttttcagggttattctttctctgtccatctctcttaagcagacaacattccacacttagtgttggtgagttccaatcagaattctatcctgggttttgtttttttccacctaagtgcgtctggacttttgatatcacctatccgggtaatcattttagaaaatagtgttgccttaatataggcaaaggctaagccaatctatcttctaattaatttggagagggctttctttcatttgtagcaattgatgcttttcatctaacaattacaatatatttgcatatttatcattggaactgtctctgcttgttttaaaccctgtgaaaactacgccctgcttttcaggaatgcttagaatgacttgtatgtactaggaaaacttgtttacaagtgagcacccagagatgactcttcacttattccttcattgttcctgctaggattgtgtactcgcctttgcatttttcgatagagctgtcaacgcgatctactgcagttaaaggttagcaaacaagacaggcaagagctaatggggcggggtgaagacccgcgtgcaagaaggctggcttcaccagataaagaagacaactgtcctccattctgtccttttttgcacgcaggctaagaggcgttcaccatctctacgtcaggcttcaaagaacagctcccttgcaattttgctgatacccccattccttagcttggaaccggaggggcggtgagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtaagaggaccctggggagggggctccctggccgggcgacagggaggcgcggtgcccctgcggctgctgcgccttcttgtttgtgcgcgtggtcaggtggccgccgccctgcgctctgcagcaggcactcgggaggctaggaagggcgggactgccccagctcccggagcgcctgcggctccccacgccccccggccgggtgcaagggcgcggcgcgttccgcattccgggtgcgcgcggctgtggtcaggtgggcctacccagccacgcacccgccgcggtcccctgggcagagctccggaggcgcacggctggcggagcgcaccccggggagggcgccagagccggctggggcccagctcaggaatccagacacgaccaaatgacctcttcctcttttcaactcacggattgaaaaacacactaaacttcccgaatatagaggaactgaaaaatgtatggctgtagcaggcgaaccgtgtatgtttatttattcagaggatcgtagtattgtttttttaatttggcttgatgactttaacatactttgacattctttgagtatacacctttaattaatttacataaaaacctttaaacgtacataaaatatttctagtatttcctccaccttgttttctagttactttctttaaattcagacaaagaaaaaaagttgcatttctgatcaaatgctgtgtgttttttcccacaaatttcttacatttgtttggctcttatctgtatacgttaatttttgtttacctcagatcgttgtattctgactataattatatataatatataaaacttgcccagaatctggaagaaaagaaagtaattatgaaatgctgtgctatttaataatgttggaagtggacatttcttctgcaggttctctgagcacacctgggcagaggctgataacggtgttaaactgtgttttgtgttgtggacaggccttataggctactttgagaagttggcctcagactcgtgactagttaagaattatgctcttaacttcacagtttctgtagaggttaatatgataccatattaactgattaacatcataatttttcctcagatatgttacttatgttgctcttgataacaaaatcaatccttattttggttatgaccccaaactttaagtgctgatgattgaaaagtaaattatagaaaatattcacagtaagtctgagtgaagtttgctgtgattccatttaatttgcaagtttcatgtgtgaaagtatgaaaaaaacaatcctcggtattgtgaactaaaaccaagtagtacaaaaggtcagtgatgaaagagctaaggccaaagaatacagttaatgtagtttttgcagaggatacttatgtagacagagcaccctcacattccttgagcatttactatgcaccaggcactgtagattacacaggatgacaaggtcatctctctcctgtttatattccagaagtagctcctgtttgtattccagaggtgtagggataaataataaacagtgattaattcgacttttgagtattgtgaagcagtaagttagattgacaaagagtgaccagtggtgagttctcactttcatatcagagtggtcacaaaggtttctctagcatgtgatgaggccttgctggggagaaggagccagtcacgtggagatcatgggaagagccttctagaaataggaaatggcacccagcaaaggcccaaggcagcaagaagcctgggaccttcggtatctgaaagaaggcactggaattttatgttttggaaatggtaatatttaccctcacgctgggtgtgtgttcttaggaggtgggtacattcattcattctacaaatgtttgttaagcacttgtgatgtagccaggcagtgagaatagtgcagtccacaaaacagacaaaaaaatgctcaccccccacccctcagaacttacttggggtagagggtatagagaagtccagttgtttatgctgatgctaatgattaagaaagtgaaattgactacttctttgcccagggtagatttatagagcatgagatatatgctaaatggaaatcttaaggattctacagtatatcggattttaactgggagtagtgtttgacacttcaagattaaattttaacattccttttgttcattcctttgtgttctttagaagccgtcttgagaagactctcatctgagtgttgcactttgattctcccttcctgtttttctctttatagtgtttgtatatcttcatagaaagatgattattgcaatgtggagattagcactgtgcaatagatctttctgtgataatggaagtggtctatgaatgagctgtccaagctgctggccactagccacacagaatttttgaacatttgaaaggtgtctagtgtgactgaggaactgatttttttcatttaacttaattttaattaattttaattttttaaaaacgagagctacaatgtaatttaagtgatacacaatataaaatggtgtaaattgtcacatgaaaaaatgaaatgtagagtaaaagtgtagtttcttactgcaatcagttatcttgttagcagcttaaaataacctgtaataagatttttttgcttttattattttaatcgacagataatgatttacatatttgtggatacatgtgatacatcagtagatgtgtacaatgtgtaatgatcaaatcagggtaattagcatatccattacctcaaacatttaacatttctttgtgttaagagcattcacaattcattctttcttctaagtatttgaaaatatgcaataaattgtaattaattgtagtcaccttttaggggtatagaacactagacttcattcctcctacgtagctgtattttggtgttagttaaccaacctttggctatccccttcccgccatccttctctgcttctagtaaccactataattttaacagcccatttagttagtggctagtctgttagtacaggtctaggtaatgaattatataattattattctgagcaattaaataggaattctgagtgggctttcaaaagtattcaacaagagtactttagtgcgtagcagctctgggctaggtaatggagactgatgtggaaagcagacatctgaataactcagcatccatttagcctatatgcagagatcataagcttttaatcaatttgtagctacctatcctgcctgtctatgcttgtatatatattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgttgttgccttttagataccacttattagcagaaataatagagaaaaggagtaagctattcctctgtgttaccttgatcaactcatgtagttatcccaaacatattccttcatcttaggagtgggaatagcaaaacttcatatggggcatgcagaaaagtggtaaatttggtttttcttttgtctttttttattttattttattttattttattttattttattttattttattttattttgagacgagtctcgctctgtcgccgggctggagtgcagtggcgtgatcttggctcactgcaacctccgcctcctgggttcaagcgattgtcctgcctcagcctcctgagtagctggcactacaggcgcatgccaccacacccagttaatttttttagtagagatgagatttcaccatgttggccaggatggtctcaatctcttgaccttgtcatctgcctgtcttggccttccaaagttccgggattacaggcatgagccaccgcgcccagcccaaatttggtttttctaactgagttcacctgccctcaattttgttatacaaggaagcagtatggcttagtgtttaaaaaatgtcggctctgtggttattttcaaatatttgctcctttgcttataatgataatgaggcataatgatatgcctcagtttcttcatgtaaaaaaatcacattagcaattatacccacatgataggcttataagaattaactgagaaaataaatttaaaagtcataagcacaatgcttaggaaatgtaagtcctggatgagtgttggccattgttaactttgttttattttacacatctttcttctctatcttttgcaaattgcttttcattcttcacacatgattcctggctagatacagtggctcaaacctgtaatcccagcactttgggaggctgagactggaggatcgcatgagcccaggagttcaagaccagtctgggcaacaaagtgagacccccatctctataaaaaaatcaaaaaattagtgggatgtggtggcaggtgcctgtggacccagctactcgggatgctgagatgggaggattgcctgagcctggaagtcagggctgcagtgagtcgtaatcacaccactgcactccagcctgggtgctcctgtctcaaacaacaacaacgccaaacaaagaaaaagtaaaacaaaactcataattccagtcaatctaagtagcacctctttgggtgaatgaagccacttgccaattgtctcaccagcaggaactttctcacatttagtagcttgaggaaagggatgaagaaaattgattgtgtttgtgactaagtgattgattttccagagaggaaaaaaggtggccttgaaagaaaacagtgagaagacttgggctacactggtgtgagttttaagggtaaggaaaatgctgtagaatactgtccttgacttgatggaactctttatgggagagagagtaggcctcaggtgtgcttgcatggttttgagacaggtgatgagtttctcttggtcttgtgctgatgctggtcctgcagctgcaagaacagatcataactttcctctgtgtagggtggaaaagcatttgttctctggatgtgcattatctcattttgattctggcagtgggcccaaatgctaagtgtcttgcccaaagtagaaatttccagttgctacttccatggtgtgccgcacaggcaatggctgagttcttgtagcttcacagacatgtagacacgagagaaagccaagggtacgagctggagacatggatgtgcgactcattcaggtatagattaaaatggaaccatgtatatggaggagcatccccagagattacatgaataacaaactgaacattttttcattcaatgtgtttgttttggcttgtaagccagtttttccagagatctacttgatagagggaaaggagaaaggaagatgtcattgaaccaagagaaaattgtctttctccataccttggaatattatttggcaataatgaaggaatattatttggcaataatgaaggaatgaaggactgatatatgatacagcacagatggactttggaagcatactaagagaaagaagctagtctcgaagaacacattgtatgattccattcctatgaaatgtccagaatagcaaagctataaagatacaaagtagattagtagtcacctttggccagtgaggttggggagaaatggagagcgattgctaatgattacaaactttccttttagcgtaatagaaatgttctaaaagtgatgattgtacaatgttgtaaatatattaaaaaccattggcttgtgtacttcaagtaggtgtattgtattgccatatctcaataaattatatctcaataaagccattttatttatataaatttaaggggtgcacatgcagttttgttacatggttatattgcatagcgtgaagtctgggcttttagtgtaatcatcacctgaataatgtacattgtacgcattaagtaatttctcatccctcaccctcccatccttttgagtctccaatgtcttcttattccactctctgtccatgtgtacacattatttaggttccacttacaagtgagaacatgcagcatttgacttttttctgagtcatttcacttaagataatggcctccagttcatctgtgttgctgtgaaagacataacttcagtcttttttaaggttgaatagtattccattgcatttatatacactacattttctttatccattcaggaatgttaatagacacttgatgggcacttaggttaattccaaatctttgttcttgtgaatattgctacaatagacatatgagtgcagattatctttttggtataatggttttttttttcttttgggtagatacccagtaacgaggttactggatcaaatattaattctatttttagttctttgatgacttgccatgctgttttctgtagaggttgtactactttacagtctcaccaacagtgtgtgtgttcctgtttctctgcattcttgccaacatctgtacttgtttgactttttttcttttttttccgttcaagatgtgtttgtggatgaatttttaatagccattctgactgttgtgagatgatgtctcattgtggtattaatttgcatttatctggtgcttactgatgttaaacatttttcatgtgcttcttggccatttgtatgtcttcttttgaaaaatgtctattcatgtgctttgccccctttttaatggggttatttgtggggttttttgttgagttgtttgagtttcttgtaaattctggatattaatctcgttggatgtgtagtttgcagatatttttctcccattctgcaggttgtctgttcattctgtttattatttcttttgctgtgcaaaagctttttagtttaattaaatctcattttgtctgttttttgtcttgttgcctgtgcttttgaggtcttagtcataaattcttttcctaaaccaatgtccagaagagttttccctatattttcttttagtattttaatcgttttaggtattacttttaagtctttaatccatcttgagtcgatttttttttttatatgttgacagataagggtccagtttcactcttccgcatggggcgatccaattttcccagcaccatgtattgaaaagggcgtcctttcctcagtgtatgtttttgtcaactttgtcaaaaagatcaattgactgtagatatgtgactttacttctgacttctctattccattccattgttctatgtgtctgtttttatatgaatatcatgctgttttagttactatacccttttagtataatttgaggtcaggcaatgagatgcctccagctttgttctttttcttaaaattgctttggctattcaaaacctgtgtttttttttttttttttttttttttttttaagtgacttggagatgcatttaaaattgcatggtttcaaggatgttccggatggtgttggtgtcattgaatccccatgtctactcttgttctgtctgggcccaagtccaaggctacctggaaggaagtttattcctgtctccccactgtagtggtccagctgtctgactttaggtttgaatttaccctttaatgaaattgcttttggatccatctctaggatttggtgagacccagagagcccagaatagatcagctgtacctgagagggaagttggagaatatctaaaagccaccaggactttcagcgtggccaggcacattcaaagtgcaccagagttccaggcatagaaccagtactgttctaatggtctcaacagttcagctgttgtacttcctgccaacactgtcccttagagcaaagacacatacttcactgtggcttcttctctaccagaaatcttctgtggcattagttctatgtggtagcaagcatggatagccttggcatcagaaccctgggactgaatctcacctccacctgtgggtgggttgggttaccattacttaatcataataagcccgctgtttgctcatcattaaaacaagaataatgccacttaattgaaggaggttgtgaaaaaattagtctgtgaaatactttttgtgtcgcagatgtgcgagaaatgttaggccattcctctctttccctttatgttgttttccccttgtcccagctgtgaatcatctgatccagggttggccaggaaccttcccttccttttgtaaataccatactgcatgtggcctttccacgtgctctgggtctctccaccccagccttcacgtccttgcctttgttgttctgcatactggtcataaccaagcatccaaatcctatgtttctatttcataaattctttccagacaaggatgatggtcattttttctttttgtagcccttctcattttagcctagcacgtgatcttttatggatttgtggggttttttgttggtttgcattattaactttatccttcctcctaaatgacaaacttgatttgagcagatactgtgtcagtgtgttttgttttgtttgcatctcccaggtgcttagtttaatgctgggcatgtaccaggctcttagtagagagctagcttacaaattgaccaccaacaattttgcagtattccagtgcatattcatggaaaagatggggtggcggtagttgaaattctttgctgtgcgcagttctgtatgcagggacattccttttcaaccttctttccaaaccctgattggagtggtgtggattgaagaggtagagaatgtcatctcacctgcctcctgtggcagtatctcagtgtctcttctattctgagatgctggctgctgaaaggggagagtcattcgttctccttcctctgtcaggaaggtttgataaacattttatatgacatttgcttcgcagtagttggctctgctatttcagatttaaccttttccattaaaattagagccctattaatcatacattcctgagcaggtcctgtgtgtgtgttaaattagatattaaggttggtacaaaagtaattgccatttttaccattacttttaatggcaaaaaccacaattaaaagtaatggtaaaaactgcaattacttttgcacaacctaatacagtgaaatttctggggatagcctgaagtctgtgttccatttaataaatatttaaatgcctgtttgtgctaagagttgttttaaatattggagaaagataaataagcatgtgggccctgccttataattgtttggagtttagttaaggaaaaaatatgtaaacaactaaaattatatacaggtaagggatttaataatttttcttgaagagatcaaagacgttttcaaaggaaatatgcaatttgaaccttattttaattgtttgatgtgtttaacatgactctgtcctttgaagtccagtttttttttttttagtagacatgagagttttgctatttgatgtgtcactttgccagatttcaactctattagattaatcaagtttgtccttgtaacttcacagattgttaatttggaaaatgtaagccagtaacttaaaaaatatatctgtgtgacttttatattatttaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttgtgagttgagttttaaatggacttcactatttgtatccactcttaactgaacttggtggaggttcataaaaggacaactctgctgattgagagagggaggagcattcctctaacaacaggttttaaagggctcgaactctttagaatgaatgcaagagaattatatttgagataacacttactgcatttttctataggaagtcagggccaggcacataatacattatttcattaaataaaataaagatttaaaaggataatggattcttatatctgctttaaagctatctggttctagatgagatgatgagacctgatgactcagtctcataggtttggaaccaggtagcactaccaagggcttaaggaacataaagtttattaaaaataaaatctgactggatatggattaggttaatcttatgatgggcaagtatgtggtaccttattaaggagcaagaggaactaaggagaggacgttttaatctattgaggaaggtattttagaaaatcagacctgcattccccacatattcttttttttttttagagacagcctcactctgtcgcccaggctggagtgcagtggtacgatcttggctcactgcaagctccgcctcccaggttcacaccattctcctgcctcagcctccccagtagctgggactacaggcgcccgccaccacgcccggctaattttttgtatttttagtagagacggggtttcaccgtgttagccaggatggtctcgatctcctgacttcgtgatcctcccgcctcagcctcctaaagtgctgggattacaggcgtgagccaccgcccggccaaattattctttgctatacttgtcagagatagattaccagtagactgatgcagtgtggcacttcattcggaagtattcatcgtcaggatatgtattaaaaaaatcattatagcagatttgagtggataggtttttatttttttatttttttttacttttttttgtttgtaaattatggttaatcagataccttgggtgattctagtcttgctctcagggtttggccctcggggcattacctgaactctttcatccttcggagtatgttaatatagttttattcttcagcctagttccttacaaggctattctttttaacagaatgttaacacattgcagaaatagtgttttcaaatgaccatactctgtttctttatctaatcattaactcctcaacagctgttcctctacctgaattatttaaatgagatgctagtgtgttttaggagcaaagagaataaaactagactctaaaaaggtgctgctgtgcacagtggtataaaataacccttattctgatttggggtgatttctgggttttttacctatttctggaagaacaaggaagtgcacagtgccaggcaccacgttgtccacagcagggactgtaggaatggtacattgagaactgctgcagtttgtcacaggccaccggcgttggctctgctttgctcctctggcatcagatctgttctgatggtggccacagaagagcctctttccttttcttttttttttttaatggctcccttgctgctggttagaaatagcactggtctgccccaagtgtatctggctacctgtgcaaaaattaaggaagtttataattctaattacatatgtggaaaattaggacctttatgcaagaaaggaggccaagaggcctttctccaaagaagaggataagcatcctgtgttgggaaagctaaacagtgttaggaattgaggatgaggaatgactgtcctgtactgagattgtagaagtagcaagcagtaggtagtatgaaagatacatggattgaagattgtgtgtgaacatgaactggaaggagaaaagagttgacttaaatcaggccatgttccctaagaaagagatcagttgatccagaggatgagaagtgacagattgggccagagttgaatatttatggcaggttggtagctaagtgtgcgagtacatccggggcagtattggatcatgtgaaggtctggctatgatactccacagtctatgtgaagagctgttaagaagactgggactgttggcagggcatggtggctcacacctgtaatcccagcactttgggaggccgaggcaggcagatcacgggaggtcaggagttcgagaccagcctgaccaacatggagaaaccctgtctctactaaaaatacaaaattagctgggcctgttgtggcatatgcctgtaatcccagctacttgggaggcagaggcaggggaatcgcttgaacctgggaggcggaggttgcagtgatcacgccattgaactccagcctgggcaacaagagcaaaactccatttcaaaaaaaaaaaaaagacagggactgttcatgcaggtgaaggtacagtcaccatctgcagatgtttgaatcactgtcatatgtgaaacagaagccatatgtcctgcatgaacataggggcctccacaaatgtacggaagctacaggtagtcagatttcaccttgagaaggaggaagggcttttgaataatccaagttgttaaggtagaattgcctccctcaggaggagtgagattccttatcagtgaccagaaaaaggatggtcagatatttctcagacttattaataagaattttaaacataggaataatggttcagactaagagggttttaattttgatattctattgtgattcattcaacaaataatttttgggatacatagtacttgctagatactgttccaaactgtaggaatgtagcagtaaacaatctataaggtcctgctctcattgtagtttacagtgtagtaaggagaaataatgagcaacttaactttctgtaaagaaaatatagtgaaagtgaggtgagagcaagtgactggggaagctacctttactttagatggtctttgaatgaggatgaggagggactggtagtgagaagattcagagaaagggcatttcagacagaaggaataactagcattaaaaattcaaaagcagacctgggcttgaaatactcagaaaatagggaaaagggaaaaagctagtgtggctgaagcacagcatctggggcaagagtgccaggagatgaaaccagaggggtctggcgggtcagctggggccttgcaggtggttcaggaagttgagatttcattttaagaggcagtggaaatcactggaggcatttaagcagaggagagacataatcagatctacactgtgaaaaaattactttggctgctgcttagaaaatagacattgagggaatagcagggaggtatgctggtcatcacagaggtctggggagagctcggatgctggcttgcaccagggtgatggcagtggggatggagagaagcaatgagtgtgttttggaggtagagccagcgggacttgctgatgcatgtgggtagggatggtagaggaaggaaggagttaaagatgactccatagtttttgcattgagcaaccgactaggtggtggcaagtgtgtactgaaacgggagggactacagttcaggacaagtaggggagagttttgttttgactaagtatattttgagatatcatttagatatctaagtggagatatcaaacatctactttagatacaggaatttggaagtcagagtgtcctcagagtataaatggtatttaaaaccataggtgtaaagtaatcacgtaagagtgaggaaagagaagaggcctggaacattaaaaaatgtggaaatcaggaaggtagcatgaagaatctaaggagtgacctgtgaggtaagataaaaatcaagatgtggtagatttctagaaattaaagaatgtttcaagaatgagtgaggcattatctctccctaatgctgctgagagactaagataaaagcagataattggatttggtaaactggtgactttgaaaagaacattctcatagccatattgcaagtgtagatggaggaagggaaggagaagcacccactctttccattttaaagagactttccagattttctcctcatctctgcttatgtcattgatcaggtggctacacctagctgccagagaggctgaaaacatcttagcaggatttcagtgtgctcactaaaattggggattattctatttgagaaagaaggatgagagaatcaatatttagtaggcaactagcagactctgctatgaaagtagaaagaggatcaaagaaagggttccattttacactgcaacagagaaattctggtaagcgtataattgcaaaggaaatgttttgaaagtgagggcatgggaatggaccactagcaagttcacatttcatccaccgtatagaggtgaggctacgtgtggtacagatggaaacatggtgggcaaacatgggagatttcctgtttgagtgggtctgttcttaaatgaaatgggaagcaaggtcatcagatagagaatgggcgggaaagaagggggtttagcaaatgtgttgagtatacatttaagatttggggccatgaatttagtgaaaccagtcatcactgtactttttctaattctgagattcaatgtctaaatgaaggggagtttagattagataaagtattgttaaaaatctaactactgtcaagtatgtgtactgataagggctatgcagaaatcacgtggaagtgaaaggcagaagtgtgaaatttcagttcacttttttccccatttggtaatgctaataatactgggtgcgattgaataaaatgatactttgcaccacatttaggttctcttcacactacatttgcaacttttgaaattgtgtcagtacaattatctgattttacaaaagaaacctaaagagaagatgctgtaagtaaggtaacctgtaattagaatatgagcatctgttaaactaaagctaaagtcttcttgagtgttgcagtgggaaagtttattttcacattagttttgatgaaataaataaacacttataaaatattaagttttatggtttagtttatacccccaaaaaaggaaaatggcagtcaaaaatatttttaaaccatttttttggtttaagaccatctgcagtcttttgaatttgtttcaccagtaaagcatttaaaccatattataatgatataatttatattaagcataaaatatttaaatattgtaaatgcttacatgtaaaataaattagaaatttaattatattaaaataataaaactggtaaatagttataacaaactatgactttattacaggctctgtagacagtttaaaatgattaagaaaatatttgtatcctatgagagaaagcgttgactccgtaacagtcaacaaggcccttgtgccacccatgctccatcttttacccatggcatagacagtattctctgttgctggcctagcatgccatccagtctttttcaacccaaggctccaggcaaccattcccagtagactggagttggcaggcaaacaaaatcgtttgttatcacaggtctagaagatcaccatgcctcttagaaaggcttagatttagttttcaaactttggattgagatgttcaaaagtgacatttttattagcaacatctatgcctgtttaccttctatcatttctccatattttctgtcagacatactcctagctgtgatgtatagtataaggataagcaagcctttgtgggtttataagtataaggtacctatcatataggtaaaccagagtaggcattttcacaagggccattcatccttgcccaaacacaaacaacatagaaaaatgtcttgagaacacacagagaaactcatgtttttaaaagcagcagaatcaatatatcaaaatacatcacataagtaaacacaggcttgctttttcagactttttaaaaatggaagtataatgtatacattgagtactagacaaattatttgtgtatagctgaatgaattttctattgtattaccacaaatgtcaagaaatagaacattccttagtcccctaaaaccttcttgtgcttacacccctccatgcccttcagagataaccagtgtcctgactttgttaacatcattgattaattttcctttttttaatctaatagaatcagtaatcaaatagaattattttatgttgggcttctttcattatgtttgtgggattcatccatgcagctgcaggtcatttgttttcgttactgtatagtattccatatttaaacataccacaatttatttattctttctactggttgtagtgtttccagtttttgattttgtttttattttttgctaggatgaacaatgcttcccagaacattcttatatgttcttttggtgcatgtatgtgaaggaattgggttactggctcataggatatgtttatgttcagcttttgtggataacagctaaacagtgtcctaaagtggttgtaccagatatgagtacagccagtgtatcagagtttgtgctgctcaaagtccttgtcaacatttgatgtttacagctttttattcattttagtcataggtttctcatgatttactttgcaattctctgattagaatcagagtttttagagtgtagctgagctaaagaaatcaatgagataataggaaacatttctaatcaagcaagctgtatgtgattgcatgtacatttcctgaaatcagatccaaatagcagtgtgaccttgagtaagctctcgaaccttccaagacatggttttctcatgtgtattttctgtgggctaggttatggtctcttcaaactttaacaggcaataattctaaccaaagttttttaagagtcccgaaactcttctaacaggtacaagattattctatgttttgttaagaggctgattgccatatctgaatccataatgcatgctcataaaatcccataattgaagaagccatcacactcaagactagctagagttccaccaaggcttatgtattatttttaagtgttaggagatgggaaagctggggcacagaggtttgtatcctgtcagaattaacaaaattttgtattgaaggaaattggtgaatagaaatgagaatagctatgaaacacagtccttgagataaaaatttccctaactcctaaataacatagtaagcctttccactagtgctaatgtgaattctcgcatttgagtatttttttttaaaataataacctgaaagaggaagatgtagtgtggctaaagttggaaagtgaataaaacagatatattggaaacataaaatctactcatcagaatttatgagtatagaagtttctgctaaaatatgcatcatgtatcacatgggcttgtggatgtgtgttttttccagaaaatttggaaagacagaaccttctaggggcacataaagtatgaacgtaagcttttaagtgctaagagaaggtgactgaaaaatatttttgttgaatcttcacttgtttcatttttaatcatctctcctacagattaaaggtattagttcagcatagactttagtttaaaatcgaaacagatgtttttggtttctctgtgttataattagcttcctatgctgcaagtatacttttcaaaattgtttattaagaattggtgcatggctcctgtccccataaggttctttgagatgaaattaaaagtctatgtaaaagtgtgagcccttttgttacttttagaatgatcacagttcttttaattagttagggtctggtgaaggggacacttgtttttgcattttaacacatgactgcacaaaagggaagctaatattatcacttttttttttggtgccagggcaaatatttttttaaaaaaggagctccagtcctgagaaattaatgaatttactggaaccatatatttactcaggaattaagaatgtttcctttttttctggggtaatctgttggtgggatgggaaggcagtttattaaaggaaaaagagttgaaaaattgttgcttccctcctcctaaaatgctgtttgaaatatttatgtctaagattgcacatctgaaaatgtggttggatggttttttcccccacttagaggagaaaaacttcagtagtttttatttcattgtgattttcttcatgcctaaggtgctaacataaaacagagatagatgtgaaagttgctatcttgtccaaggaaattttaacagagtgtgacaacttttcttctcttcagtgacttttcctttatgactgaacatggtgtttatggccggatatgagtgaattctttgttttatgaactaaatctttaagatgtggctccaagatgcttcaaggagctttatccctcactctcctatctgtgaaccatacatatgcttctgccctgaacatgaactttcttacccttggttccaaccccaaaccatagtaatgggtgtcttcactccctctgtttaatctaagtgtaaatcttagtggttctaccggtcagatctgtctgtgtctctccatctctgccattaccacatatgctcaagctgctgctatttctttggatgactgcagtctccaaattgttctcctcacttccattcctgcctctttccgtcttctccaaatagttgccaaggtaaacctgtaaaactgtaaatcagatcatgtcatcctatagcttgaaaggcaacagttaaattctgtggcttttataatcagatataaatccccaccatgccccacaatatcctcaagatctgatccctgcccccacttgtcaactaccactctctcccatggtgctgctctgctgctccacattccaccaggtagatcttctttctgcttagtgaacagtcagctcatcctcacctcagggcctttgcacttgctcctcttctgcttcagacatcttcccagatctacatgtaactggtttctttctggcattcaggtcttagggcccaaagctcacttgtttagcaatgtcttccctgccttatcattttgcttcctccagtcattctttttctcattaacctgttttgtttttatattgccttttatcagtaaattaaagtactattattgtttacttatttttttactttcctactaaaaccttggcccccagagataaagggctcatgtcttggctacagaagtatttacacataattttattcgttcattttttaatgaaattgagatcacactatacaggttttttggtgcttactttttttttctcttgttattggttgcttacttttttatgtggttatgccattaaatgattttaattaatccttcattaacagacattttatcctaagtgtatatgtttaaaaacctgagaacctaaccatttgtggtgcctccacaaatgaatcctctgagttctctgtagataaagtgtcatggtgaccatgtgataaaaatcctcatgtgtatgttttgatactacatttatttaagaatttctataataatgactagttattttccaacatgatctatgctcagtaattgtatgacagggtagtttctctttgattacacatattcatggttagttgtgtagtggctactcaactgccctgtgaggctgtccctctgtacattttggttgatttggtgctgaagtaggaatcgaacagtataagttaagcttggcatttagttttggtttcctgtagtgattttggcaattatggtcctcatctctttgatccctttttgttgttttcaccaattactgaacaatgtttttattaaacagtgtattagtccattctcacattgctaataaagacatacctgagactgggtagcttataaagaaaaagaggtgtaatggatcacatttccacatggctggggaggcctcacaatcatggcggaagacgaaggaaaagcatggggacttcttacatggccatgggcaagagaggacttgtgcaggggagctcccctttataaatccatcagatctcatgagacttattcactatcatgagaacagcacaggaatgaccaccctcatgatccaattatctcccactgggtccctctcacaacatgtgggagttgtgggagctacaattcaagatgtggtttgggtggggacacagccaaaccatatcaaacagtgattgccctttatacttaatccaaactttttttcttaaagcaattgttaattggtgtgcctattagttgcttaggaaaaaactaaaagtcatacaagatattattctgcaagtcttggtacatttattttcctactcttctttctcattatagtatcattatcatgatcattatttgaagttacgtattaatgatattgagtatggccacctacttctttaagatagtttgccttttattccatataaagtcaaagaaaatgcccacagacatcaccaagatactgtcctagtctgtggactgttctcctgcttgggagcatggaaaccttcaacagatatccagccaaggcctgcttatttgtgaatacccagtacactgccttgctgctgggcatgggaggagagtggggcagggtggcccaagtacatccagtgattttagttgtatggtatttcctatataccctgctttgttcaataatctctttctggaagatatgtaagctagtattttaaaactatttttaattaactgtttactttgtgccttgtattaggtatcttttattcctttttttgtgcattgtttttgatcttccagtcaccctggtcaggtgagaaaatttaggtttggagtggttgtcacttgctcaagtttgtacaactgttaagtggcaaagctggtatttgagcccaggagagtctggttcatataacatggtgtatttggatcatgctgtatattgtaccagggtgttacttgtgcatttatgttcattccctgtgtgagtatttattaaacacctgtgatgtgctagggactgtctggatgctgaagctatgtcagcgaataaaataaaaatacctgcctttatggagtgaacctttaatgagagaagacagacataaaataaataagtaaattatgtcatatgttagaaggagatgttaagtgttacaaaaagaaacaatgacaaaaacataccggcatgtgctggagaggggtttgcatttgataaatagggtgcacggggagttgggatggaccatactgaggagttcctcgttgagcacatatttgaaggaaggaagggaatgtgtcccacagtatctagggaaagagtattttagatggggaaatagcatgtccatgggccctcagagttaagcacccctggccattagaggaatggagaggagggaagagagagagttggtaccaggtcaggtagggccttgcaggctggtgtaaggacttttactctgggtggagcaagggttatgaggagaggagtgcagtgctggtgcagaggcagtgcaatgttggactcaaccagaattttagattttgtcaagtggttaagaagggagagaggggcttaagatatatgcaagagtctggatatggactgactccagagtttaagttggttagggagtgggtgacgacattggaggtgaggaaatgtggcaaagtggcaggatcaatggatggcaggttggagttggggccaggggagtgagctggacatgcaggaggtgatttctaagtagattgcctgaaaccaagattatggaagagtgacagttcctggtaatgagaaggtgtttgatgggatcttggagtgtgtggctgagggagggtggaggacagaatcatttcagtaggagacgtgtgcaaagaatggaggccagcaggatggtggaaggatcgtcagcctgtgtattgaaatcacaaaaaaattaagataggagtcatgttggacagaatggcagcgagccagaaactacaaccaatgaagagtgaggggcggcccaaggaacctaaaatgactaaacctgcagtgggtggtgatcatgaggcctgatgtgttctgcgtctgtctgttattgtgcttcttgtcatggggtctttatttttgaatttgtccttcttttctgagttccttcagtctctagttagtcagtgcatgcatgttatctggccatctcttaagagttcttttgtgatcttcctttaaactgtgattacttcattgagttttttttttttcttttaatcctgtgggtattttggggtataatttttaccatattcactttgtggcaacatgttctcctgctgtgagttcttttagggagttttactgttcttttccacattttaaaatagtcttttgtgtggttactctacccatttttttttgtttttcaatggaatgagtttgattttcctggcaggagattcctgtggagggagagggaagtgcccatttctctgctcaagggctctattctctctgctgtgctgtgctgtgctgtgctgtgctgtgctgtgctgtgctgtgctgtgctgtgctgtgctgcactgagggactgtttctttcctcctctgcctctcagcccctagcctggtgtaggagggcttcccgctccatccctgatgtcatcccaatcacttcatcggccccaagatgcacagacacctctttccaaggtgttccccacctggtttttgagtagggtcggcagcccatggcctcctgaatctgttccgtgtctccttttcccaccttctccagcagagtccccggtgcttctcagccctgcttctgcccattctcactctgggtgggatcagctcttctgatgatttgctggtgacagtgtggagctctgcaaccccggttattctccgccccacccatacggcttcctgctcaggacctgctattttctgttgcttttggccgtatgtacacgtttttgagaatttggtcatatttacacattttgtgttaatttctctgaaaatgtaatttttatgggttttctacctgctcccccattctataatatgccttgaggagggaagaaggaggaatattcagaaacatgcttctaccgtgtttctataagaagcagaaatcgattttcagtgttttagaaacagctgccagcatgtgttggcagttagaactgatcagaaatgactgaagtaaaaggtttgggaatcactgcctgtaaactagaggggaactcgtgacaacaattcagctgcttttggagcagtaggagaattattgggccctcgagtggatgacaggaaggaagctcatcatgatgggcaaaagatgtgtcagcggggttggggaattgcaaggcgcaaggcctcaccactgcccagtcctttcctgtttgcttcttacacaaatcacattgttatggaaccgttgttgcttctgattccagactacctcagagcaggtaaactgagcagatccatgtgaaaaatgttaggatgaataaatttgctaaaagacccagcttgtaatgttccagccatctagaagtccaaattattgtttacatacaattttagatgacttgtttttgtactttatttttaagaactgtgccctcagatttaaccctttattaatctacaatagctttaaaatgcccccaaatttccactgatttgacctttatgcctttctacctttaaagtatccgggaagagaaccaatgacaaagtgaaaattaagtgtgttgtaaatttgagattgctttgtggaagcgggctatgccttcagatattctgtgctgggaaggggagcacaggaagccagtgtagttgggccttgcgggtggatgctctccattgagcttccagcctcgagactcatcctttagaagatccttctccatctcccttcccacactttctcgtctctgcagtttggatcagtgcttttgctcacaaagaagacaagtgttctcttcaggtcataagacagagcatgagatatactagtgctagaggggaaaagccagaattattttagtagccatccttcacattctccaggaagtttttctacttgtgatacactttttagaattttaatacacttttcttggtttttcttgaaaaatagatagacatgggtatttctaatgatacatttttctctacacattgtaccctataacgaacctggatcctaactctaattgtacaagacttattagtaataacatcttgtacttttattcttacaaagatctatgccatttctaaaatgtttacatatatatcatctttttttttttttttttttttttttaagacagagtcccactctgttgcccaggctggagtgcagtggcacaatcttggctcactgcaacctcttcctctgggttcaagctattcttgtgcttcagcctctcgagtagcttggactacaggggtgtgccaccatacttggctaatttttgtatctttagaagagatgggttttcgccatgttggccaggttggtctcgaactcctggcctcaagtgatctgcttaccttggcctcccaaagtgctgggattacaggcacgagccactgcgcctggcctatatcactttgtttaacactccaaaccaccctctaacaaagctagagggtttgatagacgaggaaagattggagtctaaaacagagtttgtttctttcaatatttagattttttttctagtcctgttttaaatatgtcacttatatgcaactgctagatacatgtcactggcacatagtagctgactcctccctcccaattacgggctataactatcttttgtcaattgatatttatcatctctacaattcttataattatatcatagattattaagtattagcactcaagtatggttcacattagatagtcaagaaatgtaaataagaagctgaacacttaaaaaaaactgagaactccctcataagacagttttaaaatacatggagcaaacactgacaaaactgcaaggaaaatagacaaagccacaattatggctttcggtacccttctctgaataattgataaaacaagtagatacaaaatcaggatacagaagattcaaagtactaatcaccttgatggtgacagccacttatagaacagtctattcaacaacagcagaacacacgtttttctcaagtgcacccagaacatttattaagatagactctattcctggcattaatcaagagtttcaacaaactttaaaagattcaagtcatacaagataatattccttgactacagtgaaattaaattagaactcagtaacagaaagatccctggaaaatcccctaatgtttgaaaaccaaacacatttcaaataagctatggatcaaagagaaagccaaaaagaggaattggaaaatattctgaactgaacgtaaatgaaagcatcacatatcagaatttgttggatggtattaactcagtacttaagggagcactaaacacctgtattagaaaagaagacaggtctcaaatcatgacgtcagttttcaccctaagaaatttagaaaaaacaaccgaaattgcaaagtcagcagaacaaaggaaatacaaatcatagtggaaatcgaagggagaaaaaaaatcaatgaaaccaaaagctatttctttgagatcaatagaactgataaacgtctaaccagactgaacatgaaaaaaatagaagaaacaaattactaatatcaggaatgagagagatgatatattataaattctacatattttatatgtaaaaatctatacatatttacacatattctgtacattacagaatctatcatatatttaaaggttttttcctttgaaatggtttttattttatttatttcactttaagctctgggatacatgtgcagaacgtgcagggttgttacataggtatacatgtgccatggtggtttgctgcacctactaacccatcatctaggttttaagtcccacatgcattaggtatttgtcctaatgctctccctcccctgcccctcatcccctgacaggccctggtgtgtgatgttcccctccctgtgtccatgtgttctcattgttcaactcccacttatgagtgagaacatgcagtatttgcttttctgttcctgtgttagtttgctgaaagtgatggtttccagcttcatccatatccctgcaaaggacatgaactcattttttttatggctgcaattaagagagtattataaacaactttatgacaataaagttgacatcttagatgaaatggataaattccttgatagacacaaattatcaaagttcactcaaaaagaagtcagtaacctgcctagctctatatcaagaaattgaaattacaacttaaaaccttctcacaaagaaccagactcaaatatcttcactaatgtaatctatcaaatatttaactaattgtacacaaactgttccaaaaaattgaagaattcgttttagcaggtcagcataatccttatattgaaaccagataaagacagtaaaagaagagaacactactaggctgggtccagtggttcatgcctgtaatcccagcactttgggaggctgaggctgacgaatcacctgatgtcgggagttcaagacaagcctggccaatatggtgaaactctgtctctactaaaagtacaaaaaattagctgggcatggtggtgggcacctgtaatcccagctacttgggagactgaggcaggagaatcgcttgaactggcagcaggaggttccagtaagctgaggtcacgccactgcactccaggctgggcatgacagagcaagactctgtctcaaaaaaaaaaaaaaaaaaaacccagaaaaaaacactacacatccatttcatctcatgacataaatgcagaaaatttaaacaaaatttaactaatcaaatcaccaatattttaaaaggatgtaacaagtggagtatatcccaggaattcagggttggtttaatactgaaagagcaataaatattgttcattatgttaacaaacttaaaaagaaaacctatataatcatctcaatagatgcagaaaaagcatttgacaaattctacttccattcctaacaaaaattctcagtaaactaggagtagaagtgagctctttaacctgacaaaagatcatctatgaaaacttacagagtgtcacacttaatggtgaaagacagaatgctttcctttataagatcaggaacaagacagggatgtcttgccctcaccacttctattcagaattgtactagaggatccatctagtgcagatggataatataaacaaataaaaggacttcacattaggaaaaaaagaattaaaaccatttgtattcacagacataaatgtctatgtagaaaatctgatggaatctacaatttaaaaaagcctgctagaataaaaaagtcaatttagtaagtatctgatcaatgtacaaaaataaattgtatttctctatactggcaatgagcaatcaaaataaaaatttgaaatttaaaaagctggcatttacaataacatcaaacattatgaaatacttagaaggcaatataagtgaaacacttgaacactgaacagtacaaaatattgctgaaattaaagaaagcttatataattgggaagatataccttgatcatggatcagaagacaatattgttatttgaacagacacttcaacaaagaagatatacagatgacaaatagcacataaaaagatgttcaacatcattagttattaggaaaatacaaattaaaagcacggataccactattaacctatttggcaaaatttaaaagacggagcataccaagtgctggagaggatgtagaggaacagaagttttcatacactgcaggtggaagtgtaaagtggcatcactttgtaaaatagtttgactgatttaagaaagctaaatgtaacacctgtcatactatccagccgttctacttctatttatccacacacaaaaattaaatatatgcccatacaaagacttgtagggcatatacttataggagctttatttgtaatggacaaaaacgggaaacaacacaaatgtccatcaatagtgttgtatcatacagtggaatactcagcaataaaaggaatgcactattgatatacacagcatggatgaatcataaaataattaggctaacttaagccagacaccatcctttttcaaaaacgaataaatactctgtgattacatttatataaaactttagaaaatgcaaaatacagaaagcaacagaaagcatattagtgattgcttggtgatggagggaggaaggaacagatatgcaggagggaggaaattgcaaactacaacaaggaaacttttgagggtgaagaatctaataactgtcttaagtgtgatgatggttttacagatgtacacatatgtccaaacttgtaaaactatagtttatgcgctttgtcagttgtacctcaataaagtggcatttaaataaaaaacgttaataagaatattcctattattcatttctgaccttcaagagaacaacagactctgttgagcgcttactatatccagtacacggtgcctacctatattgttctcggttaaagtttatgacagctgagaaataggtgctttctcactgttgaagcaattatagcttggagacattaggtaaattgcccagggtcagcagccaggaagaagtgagatatcaggctgtctggctccaactctacttgctggtcagccttcaattgtacttcttcctcagtgtgatgtggctgagtctgtgttggaatctcaaaatcacctgtccagggattttactaaccattatttttttttctatgtttggctgttacaagttggttattttacgttgaaaacagatgttttctgctaaaagagaagatagctattcttagttatttggagacagttctttaaaggtactctgtgtgtgtgttaggttgatctgccatgccgccacagcctggccagtctcatttgtcagacagcatccatttgctggtgaagtctgacgggtggtaacattatgtattaatagcccctgataccaaattcagcctacaattttatgacaaactattctttactgtaaagcttttttcttaaataatccactagatggcagcagacccacgtggaacagaatggatcttcattgctgtagaagagccagaaacgggacactgttttgtttttgatgacccagtagtgcatctttttcggatgtgtaggaaatggtattatttttctgttatgaaaaatgtaacatactctttgaagtcacgtctgtggaagtgagtagtggtacagatagttcaaaattgtagataatgcaaaaataattttttctttgtattctcgtagagacacatgttgatttaatcctacctgtatgcattagatgaacttttcttcaagaaactgtttattcttaattctttttatggttggaaagactgcggcttgtttcatgagtttttttctttaattggacctatgccaatcaaaatagaagatgactgtcctataaattcatagcacctaaggctagataatgaagtgaaatcctacagactggacttgggagaaagtaggaggattatttatttttccagatcaccatactgcttgtcatctgactagaaacctcttatctccctttctctaagcttatttttctcaagcatttttgaacatggtcaattggggtgtcgcagaagatcctgtgaaccacatatcctactatccataccttctagaaggggaagaacttaggagatggccaaaaaccagagagtaataacatgatagagtgctaacaatatttttgcagcaaatatgctataaaaatgctcatccaaaacaatgaaaaagtgttttgtttctaaattagtataagagcagcagatgaaaatgaggtactcaagccagcacctatgatgggtgaatagcatattctgagaatcaaagaacttcaactcagtgtacatgcatgttcaatggaaattttgtaacattgttaaatattttactagatagacttaatgcagtgactgcagtaggccctccttttccatggattctgcatggattcaactaaccatggaacaaaaatattcagaaaaattttaaaaataaaacacagtacactataacaatttacatagcatttattatatattaggtattgtaagttgtgtagaggtgatttccaggaggatgtgcataggttatatgcaaatactatgccattttatattagaaacttgagcatctgcagattttgttgtctttgggaggtggatggagggaggcatggaaccaatcctctagggatagtgaaggatgacagtacattcaaataacatgccaagttgagtttttaaatacaaggttttagtaatttttaataactgaggacaaagactggccaactttccctgtaaagggcagattcttttagactttctttcattttctttttttttttcttttttgttaaccctttaaaactgtagcaacagttcttagcttggaagtctgtacaaaaccaggtttcaggctctacgggccataatttgttgaccctggtgtaggaggctaatgctagtagtatataaaatcaagtctgtggaatcttggcagttcataaaacccagagaaagagcaggcgtttcttccttgatcactttcagctgggaagaaggatccttgtgatccactgccagacctaaacttactttgagcactgctggaaacatctaacatctcaattcaactccttcaaattacttcttcaatctagacacacttattttttctttgtttgctttgtcaactgtcacacacctggattatgaaataatgtgttttaacatcttttactttcagtccttttagcacattgaaaaaagttttttgaaaaccaagaaatctacattctaaccctagctcttgtactaaatagctatagtttttggaacaagttattctgtctggttctcaacttctttgtttataaaataggattgaactaataccgtataatattttttccaaatttgatttagtagtttcagatttatgttcctataagccctttatcacctgatcagatgatgcctttaattgatcctcaagtgtagacctgctcaatttaaaggaatgcaaccaaattaatgttcacgttcagaagccctctcgctgtgcctggtacgtagcagatgcccagtaaatgtttgtcgagtgaatcaatgaatgaataataaatgggcataactacctttcttaactctccatttatttatgctgtatgttttagaaatatatattatttcttacgtacgttttgatcttcccagtattctttttatggttcactcataaaactattcattgagggtcaacaatatgataaattctggaaaaaccaaaatgaataaaacttaggccttgccttcaagaaatttgccttctagttagggtgactaataggtattctgatcatttcagtgtaggtctgagtatgatattagaggtttgaatctccaaactgaaatgtcctatttcttacccttcaaaccattacaaatgccaccttcattacagctttttggattgtcctccaatagaacacacatattataggtcattgtttgaaacattgttatagcatttgttgctgctgcaccctctttgagtttatatggtgtttgtacttttgggttttttttgtccttttctagtttgtatgctgcataagtgtagggggccttgtcttccatttctgttcatgagaagctctcattagttaaatgcattctattaggcaataacataatggttgttttctgagaggcttcattttatgagacattgtattatcttaaaaaattgtttcagagtgacaaggaggttgttagccagagcctttgatttttaagaaatttcagtatctataaaacctaaatctacaaaaccaaaagcacagagtaaatgtagcttttgattataactagattgttagtgatagtgactaatactttcattattaatcacctgtatgataatgaaggtaagcaatgttcaaagaatcttaaaacagttttgttgctttagcaaccagtttttttccccctccaaagattggctctgtggtgctacttctcagtggtcatattataaccaaaaagatcccaatctaatagtagttttgggtattaggtggcccaaaataaatttcactataatttatcccttttgttttctacagtgaacacgcctccttttttcatacctaagcttaaaaacaaaagctcctgcgtgacacactgctgctatccctcatgcaacgagaactcctttcccatttccacagaagggataaaactgaggtctattcagttcctgtagccaatgccaaatttagggggtgatttcctgtgtgctcctcctctttcagcaaaactgaacagcagtattccttagcctgtggaacagtgtctcagagtaaccacaaatggtacattctatatataacagtggaggaaatagggaaggagacgaacagttaatatatctaaatatatacattgcagagcaagaaaaagaatactggcaggtgctaagttaccactctacaactgatcacaggctgcagtttgtattactattttcctgttataataaccattccactttcctcttgccttctttcagcacctctgctgtttgggataacccagattttcagccctgggtccttgttgctcctgctcacaggctatgtggtactcacttttatgagtgaagatggcagtattatcaggccccctccagttcatctcccttttacttgtgtatgagcgtaccccaaattccgcttaataattacctcaatcaacatactaccttggccctaaatgaccagttgtagtcttgaaaacgtgattgttttcctcccttggatgttgtctctaagtcaccttgagagatggaaaaaattgtacaaatggataattaggtgtaatcgtgaaatattggactttacttcgacctgttacttcccaaatccaagtttctttctggctgtaggtgaaacagcaccatggagtggtggttctttgagaccataaggatccttcagtttcccaagatgcttgtctcccaggtggtgccaggattgagtctcagtaggccgtaaacattctagaagtccagcagcttctagataacagaatacatggcagagcagtgaatcccattgtccttggaacaccgttaattttttttctctgtaatttcttgagcagaagcatcggtgtgtggaacaccttgattgtgactaataggtggattaggagtctggtagaagcatggggtcgggggagtggggacgggccacagggggcacagtgggtgcttagaggatgcataacagaacccagagtaataccattgaagtgaatataaaattctgcctcctccaagatggaaggagcagctagttgggtcaaccctcaacaacggcacatcactagtttactttttatttttaaattagcacgttattgaaagtgtttgtaaagataattagccatagaaaataaaatgggtaaaatcatctctgtagagcatatggatgtgcatctgggaagtccaaaggatgaatgaaaaaattaatacaaaaaatcaaacaaaaatgatttaatagagtataacatgagattgctattgctgcaaattggtgtacggcaatacccatggtcatgtcagtctgagtaagaggaaatccatattgttgagtctatatgtggcttttgttctgacagccattgctagtttattatttcactgaacaagtgcttcaggagttggggtgagggataggctgactgacatacgtagagcaaaatgtagaaaggctgtaccaacaagatacaattcatggtgaacagctagagtcacttggttaccttgtaccattgtttattctatccagggctcagtagcaaggccagaacaagtctcaaaaggaaggttttgctccaacattctgagggacccctgtgtttttcctattgggatttgctactagttttcttcggtgccctgaaattgcacaggcttgatgtaccattgcatcagctgggtcattaaagccaagttgtagatctgcttataccaccacttgaactcgctggatggtcttttctttttgggagttgaagctaaagctggtaacctttgggtcattcagtaaagggtggaagcagcataaaaagtctgtttctcatttgtacttgaggctacaaagaaaagcactttgcagaagtatgccagttatctacagattaattcaccaagatttttcactgaggaaacactgccctgtattttcatggatttattttctacctgctggcttacttatgctttgcaggcatctaagagtacatgttgcctcctgcttttctggtcctaaaagcagacgtaaccagtgtattggactaatgtagtgtcctgtaggaggagatgatccgtatccttgacaacgaaattgtagtacaaagatagacagtgtgcataaccgtgagataagcctgtgaaggctcgctgatgtcccatcccattgatagcaaatcctttctcatgttctctgtcctttagggtagagcaaaaagtatttgccatagaagcaggtatatacaggttgctagagattgtgatgctctgttgtagtaaatccatcacattttgaggaacagtgcagttggagtcaccacctgaataagcttttgctagttatcatgagcattagccttctgcattctccagataggccggttaaatgggaatgagaggcatgtccactccctgctctttctgtccttgatggtggcatttctgagtaattcccagggaatagataatgcccttggttttatttttttattagagtgggtccccaggggcttccaatgatttcttccttccataagagcccttactcagggagtatgagtgagaactgggggttgctcagtatatctgttcagaaaccagaaattaccacatggtggaactaggctcccattgggcctgtcagaatccatttctactcaattctttaattggctgagtaattttatatagcattcatgtggtgtacttgtttgtactttgcaaaattgatatgcatttcggtcctttttttgctattcagtttattcatgaatattaaagttcctattcttggcccatttttctttttttttattatactttaagttctgggatacatgtacagaacgtgcatgtttgttatatagatatacacgtgtcttggcccatttttctactggattgtctgacattttctaaattatttatagttattgactattgctccctctttcttatatattatgtagtctttaccttttgtttttaaggcctttgattgtaattatattctcaactgcttttcataatttttaccaatcagaaacataaaagtttaattatcagtgaagttgaagttttgttatgtacacatttgccttttgtaaattgcaagattataacctttgtccattttttactgggctgttgttctgttaccaaaaataattaccattgtagtttaacctctttcctcatcataacctgcagttactgtctcctgtgtgtatatgaacacacacttacatatatacttgtgatatatgtacacattttttgtataacatttaaccaagttattttatgtagtcaaatttgtcaatattttcctctgtggattttagttttgtgtcatgcttagctaatattttatatctcttactccaagatcatgtataagatcatataataaaaacatttatatttcttagagcagtttaatattttcaattttactatttaaattaatggtttattaaaaatgtattttgctatatgctgggaggtagggttctttctcccctgcccaaatggttagtcagttttcctggtgtcatttattaaataatttattttttctcacttgctatgattttttcctaaagaacaataacactttagagttgagataaatacctgccaatagtctatcgatgcccatactacagtttgtattatcaatacgcttaagaaaataaagcccctataaggcagttcaagaaaatctgttgaggttgagagggaatatatagctaattataagcagccataagttaaacacggcaaacaaaatttgtttgtcttatgaaaggaaaaatcaacccccaaaaagcaaaaataaattcctattaaattagccaaatgctaagagttgctatatgctttgattcttctctagtgtttctgtttttcagctttcacttaaaagcagtatttattacatcattcgcggtgaccaaaattatcctgcattttgtaatactttatcattcccttgagcatgtaaataatgaatagttttaaagcatttaagctatataagtaaaccactcatttaaataaaaagaatgagggggttagattgttaagagttctttggattttcagcttatttctacttgacgttttatttatgtaccatgacattttatttatgtccccacatacataaaactgtaggtcctccccttttgtgtagagccttttttaaaaaaattgcaatagtcatagacttccggattgtgagtttaacatgacttttaagccctggactttttattttaaaatcttttctaaacctcacaaaatatgtatataagtatatagtacaatgaacctttcacctggatttgccagttgtgggcatttttcaacttttgtttaatgtgttttttactttctgtattcaaatttctccagttgtccctatgattttctttatagtgcttgcttttttcctgattcagaatccagtcaaaaatcatacagtgtcttttgggtattttaattccttaatttagaaagcacctctgtctttgtcaactttttttttcccttttgtgacattgacgtctttaaatgcccaggcaagttatctcgtagattgtcccacagtctagactggtctaatttctttttgtgattagattcatgttaaatattttggcaagaaaaatcctcagatcatattgtggctttctcgctgcagcatgccacaaggttcataatgtcagttttttccattctcactgctaaatttggtcatttgttttcagacaacagatttatatatgataaagttatatcttttgtaattaatgtcatctgtgtggtggtaatttaagttgtatgaatgtcctgtgattttagcattttttgatgaccttgctgaaatcagttattacatggataattgaaaaatgattttttgtaattctattcctctcatttattaacaataacttatttatattatattctaatgaaatatgtaattgttacttatttcctcacaatttttatgctagtagtgttaaagtctgtgtgcccttgtatttacttaataatatcctgatgggataaggaagaagatagtatttttgggtcataagtgcattttcacaagttaacattctcacacaatttcctcttgaaaatttttgttactaattagatttaagtaaaccatttagttattcttttttccagttaatattttctattttcatctttgtttttctgtctcttttcaactgcccaattgcttgtacatattaatttttaactctttctgttaccttaacttttgtgacaattaatacatgaattttctattataatagctgtggaaatacaaagaactctgaatcaacttggaacacctcaagattcacctgaattgaggcaacagttgtaagtatctagttaaataaataaaagagaaagaaaaaactctattgctattattctgttgcttttacagtatgtagtatattatgtttactggaagaaaaaatggaaaaacaatggagtttttctgctaccttatccatacatttgtaccaagcttttgtgtagatttttccctgtctggagtaggcaggtgtttttatattaaagatctggaagactgaggtgggcagatcacaagttcaggagttcgagaccaacctggccaatatggtgaaaccccgtctctactgaaaataaaaaaattagccaggcgtggtggcgagcttctgtagtcctagctactcaggagcctgaggcaggtgaatctcttgaacccgggtggcggaggttgcagtgagccgagatcacaccactgcacttcagcctgggcgactgagcaagactctgtcttaaaaaaaaaaaaaaaattccttgataggcttaccctatcaaagcagaatttctttagttgcatttcttacagtttttaggtaggttgtttttgacagctgttgaaaaattatactctagtatctcaatttatgtgatttactttccatagctaaaaatccccgcagtcaccagagttttatttggtttagatccaatacataaccagctacgtgagctgtctccccacaagtttatacctacatccttgaatttcagagagcattagcttccgtttaaaaaaaagttataatgaattatatagtacatattccagtaaattaatatgctgttagaagaccagcagtcatagtgataatattttgtctgtggtatgttgtggattttacagagtatttttacatattttatcatttaaaccttacagaattagagtaagagaaatagaccaaaagaactgtttccattttgttcatgtctcttacgggtttaacgagttacccaatgtcatttagaacttaactcttaaattttatttcagtactgttacagctgtaaatttcaagtcacatatatctagtaagcaatacttctaaacaacattaactatagagggaaaactgcaaagaggacgatattaaaagataggtaataggaattcatatttttaggaagtacaatttgaaggacttacaattatctctaatttatattttatttttccacagtgggtaagtgtcagaatggtaaaaatgctccaaatctaaataataaaccacaattcattaaactaaagtaaaatggaatagaagtacataattcataaaagttctaatattttgatagagttaataatgaagattctgaatatatatccgtagtcactaaggatttttttttttttttttttttttttgagacaggatctcatgctgtcacccaggctggagtgcagtgacattatcacggttcactgcagcctggacctcctaggctcaatcgattctcccacctcagcctactgtgtagctgggaatacaggcacatccaccatgcctggctaatttttgtattttttgtagagatggtgttttgccatgttgccggcactggtcttcaattctgggctcagacagtccacccacctcaccctcccagagtgctgtgattacaggcatgagccaccatgtccagcctaaggtcttctttttaaaactttgactatattatgatttccagagatttacaaaaatgcattaaagatagggtatttggtaaatagagatagaaatagattttaattaccctttgtcagtcaaatacagatccctattcttaagcatattcttatacaatatctcattattttaaaggaccctaagtgtgaccagaccatatttaaaatgagatgaaatatataagaggtactgatgttgtgatttgtaaaacatcacaattaatatgagcttttttttagtgtcatgtttttaagttggaaatcttttcagtttataagatagctagataaaatatggatatgtagtcagcactctgtatccatagattatatatccccagattcaaccaactgcaggtcaaaaatattcaagaaaaaaaaaaaaaaaaaacacaataataaaaaaaaaaactgaactataaaatatagcaactatttacatagcatttacattattgtattgggtattataaataatctagagatgatttaaagatatgggaggatatgcataggttatatgcaaatgctatacctttttatatcagggacttgagcatcagcggattttggtatccacaggggtcctggaaccaatctgcagatactgagggatgactataatttacttcttttatttattgtgttctttccctttacaaggaaatgccattattttttccagcgtaaacttaaataatagtaaatttgtaccaatattgcctctttcctttttatttttattttttgagacaagagttttcctctgttgctcaggctggagtgcagtggtgcaatctcagctcattgcatcctccacctcccatgttcaagtgattcttctgcctcagccacccaagtagctgggatcacaggcatgctccaccacacctacctaatttttgttatttttggtagagatggggtttcgccatgttggccaggcacgtctcaaattcctggcctcaagtgatccgcctgcctcggcctctcaaagtgttgggatgacaggtgtgagccagcatgcctggcccctacccccgccttttttttaagtatctatagcatatacatgttcacatagagaaataagagaggccagatataactagatctgggaactgggcaaagtctaaggtaacaaatcttttcttgcttacctgaccttccaggtgtgagatgcagataaagggcttccacatccccagtatctcaaacataaaggatcagacatctaacagtctctccttcaggttccctctgattcaagtcatctgtgtttctaaatggccgttgaattgatttctctaagcttgcctaccctgtgtgagtgaagaacctgacatataatatttgctcattatttatcaaagaataggatatgaaattttttttgatagagaaagttgagagccagtttatgaaaaggcaatttttgtacaactgtttatcagtgttgattcaaaaggcagagttgaagcttaaagaagtatattagtcctttggctgtaatgcgtgttttctcactttaggcaacagaagcagcagtatactaaccagcttgccaaagaaacagataagtacattaaagagtttggatctctgcccaccacccccagtgaacaggtatcaagctttaagacacattgttgatgtattgaatgtgaaaaaaacccagtgcactgtaggatctttgaactgttacgctagaaaggaaattatgctagaaaggaaatcaaaaataattctgtttgagattagttcacagaacacaaaactatatttaattgctcaggtagtatcctgtggttcaataaagcaaaaattatttccatgcatttgccctgacccataattaagttagttctcagaaaatgcttcctgagtaattatttcctggccttccggggctgactgcgtggaacatgcaggctcattcaagatgtgaggtgtcctgggggcacatatttatttccctgcttatttagtggaagttattacttagctaaaagtataaggctttatttgcctgaaaaagaattactttaaaatagcctcaaaataataagctagtttttagcagcgtgaaaacctgaggtgagaaatccagcataatgggtcttttgcctcaagttaaatatgcacagtatttgacatactatcagaatgttactgagagttaatctgtaaggccctgtaattggggagtaagtgaaaacttcagggttaaataaagagccaactaccgcaaattcagttgaacttcacagctagattctagttggctttttcttctctttcctctagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctgtaagtattttaaaagacattctagaaatgaacatggttacttgctaagggtcccataaaagtctatagtagcataattttttaagtcataaagatctgtgaatatcttggaaatcagctcttgaatatttatttttatgctttcctgctccatttttagaaaaggatgataattttgtattacggtggtgattttttgtgtcatagtacagaagattacagagtatataaaaatatagagacatattttgtcaaaaaagattagggatcaaatcctgagtagtattctcacatcgtcttggtactgaggctttctgcttgtgtacacgctagtgtagaaagcactttcctcctggattacaccaagatgacggagatgaatggcgcaagtatgttgtatcaatattgaaaatgaacatgagcctggagaaaataaatgaaaggaagctttacaatagaattttgaattaatctaattttaaattcccttagaaactatcatgagttattttcttattcattaacatatggattccaagactacattaagctttaactaaataatacttatttgatccttgagaatatttagtgaattcctttcttgtctacttagaatataaaattacttatattattacttgaagcaattgacctgaaaaattagaacaagaacttctttctctctgtctctacacacacacacacatacacacagacacgtacataaatcagtttagtttattataagggaaaatatgagtgtttattttttctcatttttgctttttttgccccttctcattccatcctgttactaaattattcagggcagttttcctgaggacagctcaaaagaaaggaatcttgtatcctgggaaaggtaagaaatacaaaacattttacagatcaaaaggtaatttttcaaagtttatacattaaggtccctggaacagaattaaagctttcaatatattatatcataaatatcctaagttgtttatatgttgaaaacagagtaaatttgaaaaaaattttaagtaattataaagtatttattacaaaatatataaagttttccaaataaatgtttatggacttaattattaatatagacattcccttatatgaggtttaaatcagctgagaagaaatacccagttgacagatacagcttccaataattaagtaataactctaaactcacattagctaaaatgatataagtgaaatgaaaaatgaataaattttattaatatatctgttatattcttagaatttttttgagtagttctgtgactttggagaataaaatatcctatttaatgaatatatcttaaataggaaatgagtcccattgttttgaataccaatctttgtttttttccacattcatttttttctgttagccaaactcaacctcaagtgcaggtgcaggatgaagaaattacagaggatgacctccgtcttattcatgagagagaatcttctatcaggcaacttgaagtaaggcttacattgtagacttgggctgctgctctggtcttagtgagtttgttctcaagatgcttaggtaatgctgggagaatgcatgagacagaaaaattttgttttctttttgagacagtctccctctgtcacccaggctggagtgcggtggtggaatctcggctcactgcaacctccgcctcccagcttcaagcgattcttgtgcctcagcttgctgagtagctgggattacaggcacgtgtcaccccacctggctaattttttgtacttttagcagagaaagggtttcaccatgttggccaggctgttctcaaactcctggtctcaagtgatctgcctgccttggcctcctaaagtactaggattatagatgtgagccaccatgtctggcccagagaaagaaaattaatgtatcagtttggtagcatttgtaatgtatgagttggaataattccttttttaaaaaaataatattgtccttactgtttgtgctaggacgagggatcatactccctcctactgcagctttttaaaaattattattgttatatcaagccatctatggaccaccttagtattgagaaaataccagtgtagagataaatgtctgtccaagagtctggatgtcttcccagagcacatgatacacatcatacctgcatgagtaagaccttttataaggccttcaaagaattttatttctctttactatgtttatgacatcaaagagatctaaaggatgtattaagtcatagttcttatggaacctacttagttcctagaaagaaggctaataatagctaacaatggctacaatttattgaagaccttccatgtgccaggcacttgtgggatgaattctttatgttaattatctcatttagtccttataaaaactttatgaagcagttaattgtgtcattgaagaaaagtaaatttatatttaatcaccaagtttataacttctttattcagtagtgacatttcactaatccactgcatgttcaaattattaatgtgagactttaaatttacacctaatgttttattactttaaattgtcaaattgatgtgtaaattttactagaaatacatgctaagaatattttatacccttgtaagtagatactgcttgtgataacaaaactatcaggttgtataaaatgaactcagcaatccatggctcttctctattatagatccttcatttccattcatttccatcctgcctcgctcacttggtatttttaatgccacaaactgattttagagaactggtggctattgttcaaattcttcttaattattgtcaaatattttcctgatatttccaaagtttatgtattatatttgtgtattatagatgcatgctcacccatgtgtgagtagtggtttgggtttttaaaatttttcctcttttatggaatggggactgaatttctgattataataatatatgcgttttctcttaggctgatattatggatattaatgaaatatttaaagatttgggaatgatgattcatgaacaaggagatgtaataggtaagacctgctgacttagattttggaggtgagagcaagctacatgcactttacctgctgtaactttctcacagaagagtaaccactttctgtcccttttttggtttccctggaaccaaaagcatggtctataaaacacagtaagcatcacccttggcattatctaaaacagatctcatttttaactcgtgctggttgaaataaccagcttcatttatttcagaagcccaaatttaatcagggcctattgctgccaagaccatggaaggcaccatgaaacattattccagcttatttccagggcctctggttttagtcttactccaatttatttgtcatcatgctaagcacttttggggaaacttgtggtatatgtaactgtgcatgacatcttgtcttttaggtattagggaataggtagacatttgcctaatcattcattttaatagctttttggtagatgaatttagtagtattacatagaagttaggaattctttttagaagtgattttcttttctaaagttgctaagaatcccttaagtattgaatgtaatagcatttcaattagggtgtagttgttaacattcatcaggatcctgaccatcttgaagtctggagctatgtattggtatgtctaaagatgcttttagtatattttctgaatttggtccaactgaaatatttgcacctttacttcagtgtaactattttttatccattcttaccctcctctgtatccccagtagatcacagggtaaaatttcaaaaaccaatttattcatcatccgaaatatgttgagtggctactatgtccagacacaaatctaggcattggagattcagctgaaattaaataacagataaaataccctatctcaattgatcttataatgggaggaaagacaattttttaaaaaggcgagaaaagcaagtaaatggtgataagtgctatggagaaaataaggccagggtagagggatgggactgctaggggtggaaattgttgctgcttgacacagggtagttaggtatgataggtacttactgataggtaacattttagtgaacccttggtagatttaagggagcaagtaagagaaagtgttccaggcagagagaacagcgagtacaaaggccttgaggcagaagcatacctgacatttttaatgagcaagaaggagatggagatcatgtccaagtgcaggggatgatgtcatgtaggaagatttcagtttttacaaacgaatgagaagccaaggaggagttgagcagaagagtgctataaccctgcttcagtttcgaaagactcacttggctgctggaaaaagaccaaaagcaaggaggtcacctaaaaggctattgcagtcatccagatgctcaatcttgttggcttggattaggatggaactagagggatggtgagaagttcatggatttcagatattttttaagtggacagccgaaaagatttactgactggctgggtatgagtgtgaaagaaagagttaatttaagggtgatgctaaggttttagcttggcccactatgatggtgaagttactgttttctgagatggggaaatctgtaagtggagcaggcttagatgggtataaatcaatcatttttgaatatgttaagtttgaggtgcccctttacaccaagtgaaggttttcttgacattattaaagtgaacatggagttcaggggagaagtctgggcaggggatctaaatttaggagtgatctgtgtacacatagtatttaacaccacaagattgggtgagataatccagggattaagtctgggtagagaatagaaggggtctgaggacttagccctggatcctctaaatgtttagaacagtgtcttcaaactacatgtattcatttatgtatggtttatggttgcttttgcacagtgaaggggtagctgaatacttgtaacagagatcatacaacccacaaagcttattcattttctggctctttgcagaaaaagcttcttaacctctgatttagagcccagacagttgaagaagaacaaataaaaagactaaggaatagccagtgatatggaggaaatccaaatgaatgcatcgtcctagaagggaagtgaaaaaaagtgcttccagaacaatagatggtcagctgtttcaagtgctgctgttaggccaagaaaaatgaggattaagatttgactactggatttaacagtgtgtagggcataggtgacctcaatacgagctgtgttggtgaaatagtgtaggtgaaagcatgataaaagtaggctcaagagagaatgggaggagaacagtggtggataccaagtatagataactctttcaaggagtaaagaggggaagtgaaacagagaatgcagtcatagctgcaaaaatggatgtggaataaatgagaggtttttggtttgcttgtttttaagatggcagctatgggattgatgaaggtgatctaccagggaaagaaatactgatgataagtaagagagagaggaagtttgctggactgaggtttttgagttaaatgataggaaatgtgataaagtgcacaaatggaaaatttggctcttgctcggggtatatagttcttcctggcaacaagaaagttgtcagaacacacaaatattgcatgtagatagggtcatgaaaacgtgtggaaatgtcttctgatggttcctgttgcttcaaagagctggaaatcaaggtcatgggctgagaatgataatgccagaggaggcctgagaagcttgaggagagaagagaaagtatgacgtagtctttcagaagtcagagaaatgaagtagacctgcttggcagtcatgactttaaagtgaaacacagttaatcctttttacatccataatcagctgcatgggtactggttggggttttgtcatatgactaaagtggaggggcaagggggctaaggatgagagtaagctgaggctaagtgattgtccaaggactctaaggctagggtaaggagggaagtgaggacatgccatatgtgagggacagtgaagaagtggtaggatcaatgaaagttgaaaattgttggagccagggaattagaaggagtgagctctagagatagaaggtggtgatcaaagagtgagacccttgaaattgagattatggaacaactgcaattattggaatgtcagggtttgggatgtgaccatggaaatgggtgggtgaggaaaggtgttcgtctttggaaaaagtatggtcagtgaactgtgaggccagggtgttagaagggtcagcagttggatcttgaagtcaccagtatgtataagagaagtgttggagagagcatcagtgagtcagaggctaaaatattcaaggaatgagaagaaaaggccatgcgattgatagatgtctgcaacaaagagagttggctgagtttgatagcatgagccttaaagctgagagctggtagggaggaagagacaagggcaaagggtctcatgcttcaaaatgacacccgttccacctccaggcccctggagggtgggaagaaaaactgccaccaattgagaaggcttcatgggccctcggtgagggctagattttagcacagaagtatgttgatgaccacagagtaaatggccttcagcactctgtatttaccttaaataaacattgtcacatgcttgctactgagtcggccattacagaacacaaactaagtagagcataggtattatgctccagtaacttaaagtacattccatttacaaagacatagagggaaaagaaattgagaaacattaatgactaacataatgattaagggatcaagttttagcatttgggtttttctgtttgtttccctctgaggacataatattctttgaaaagtcaaggtaccagtttttatcatgatgaacaaaatcttcagcagtagaaagaagagagttgatctcttgtgcattggtcttgacatagtccaagctgtggagtttgacactgagacatctcttgtgctgacactgatttgataatgtcagggtgacagtacttttcaggggttgccaggtagagctggagttgctctgtaatgaagatgattaaggttctgttatacaaatgctcttatattgtttggatcacctgaaaaatagtataggtgtatactataattcttaaagccagcttaaaaaaattcaactttatgatatactactattaacctttgaataatgaccatatttaatcttaccttgaatgaaatttagtgatttgttactggagcatcaatccatgtttaacacatttgtgtgtgtgtgttttattttacagatagcatagaagccaatgtggaaaatgcagaggtgcacgttcagcaagcaaatcagcagctgtcaagggcagcagattatcaggtaatttaactgtgatcaattttcttataacttatccttttcgtatgtgtgtgtgtgtgtttgtgttgaggaagcagggagagattaggtttaaaatggctgaagatgttaaaatttaaaatcccatggaagagaagtctgtttaaataataccagtcagtttagaactgtttttagcctgtgttcttctcagggttgaaccagaattgttggcccacagggagagaaagtttagtgtttgggcggcagagacaattctaggctttctgatggccggggatctctgatgtcattgtgacatttctacccagaaacctttttgtgataggcccctccttcccatttcttgctgctcccttttactttttctttctttttgtcagtgacacactggactaaagaggcaaatttccttgtcctagagagattgcttcaggtcttgtggaaatcatattagcttggagtgtcactgttcattatatattctgtccacattcagcagacccttcaccaggaatgaatttatttcttgagtcgggttaatatagggagtccacatgcatgtgtcaaatataaattatatgtcaagtactatacaaatattagaactatcaactattaatacatcatacaatatgcagacctttgatgttcaaattggataaggccaggctctttggaaacccctaaataccatgtagcatttgatttcctttttaaaactccattcctttgttgctatcattcataattatcattttcttgaccttattaactttttttttgacacagagtctggctccgatgcccaggctggagtgcagtggtgtcatcttgcctcactgcaacctctgcctcctggctgaagacattctcttgcctcagcctcccgaatagtgtgtacccctacgcctggctaatttttgtattttttgtagagatagagttttgctgtgttgcccaggctggtctggaactcctgggctcaagcgatccacccatctcagtctcccaaagtgctgagattacagatgggagccaccatgcccagccgctgttaacttcttataaaatatctaagatattgtcaccttctcagacattttcaattgctttttgtttttctcactaaccttagaagttgcctttatttcacagtccatcttttactggacaaattactgcatattcagtgataagtaaataataatgaagctatggagattgctgagttataaccagttgtattcactgacagtcactcctgtttattatctttgtccatgtcattcagatatgcagctcagtgaaattaatatcactatatcactgtgtcatggactttaggtatccctcacgaataattgaaaacacacacacacacacacacacacacacacacacacccctgcaaatgccagaagtcttctggagctgttagcatataactgctgaaacttaacaggatccatcagtgactaggttcacatggtattttattttgcttttggatttgggggaaatgtggatattctgccaagttttactcttcctcttccttgtggaaggccaagcctacaggaaaaagcacatgtcccaagctacaccccaggactggaagctgcccctaggcttaattcccccagctcccgaagcgggacgagatggccatgcagcacaagtgctgagaaaagaggcagctttccaatagttctgtttggaagccttgatatgtttgggtgaaccctaagaataaggaaggtgagaaattcaagttcacttatcaccacattgccccagggtctcattaccccacgctagggggagtaccccaggcaacaaacacaccattgtgggatacccgtgatgactcacaggtacattacatgtgtgtttgtggtaaccaactggagtctgggaaaaatatttatgcatggtattgaaattttagagaaattgtgtttgatacgtaaggagtattcactggaaaaattagatgaatatgtggaatattcaaactatttatggttttcagtgtaatttcagactcagaaatgtatctttttataaatattttggtacttctacttgacacaaagtaaatttacaaatttttctactttgtaagaaaaaggattcctgcatgttgatgtgaggtacaaacgccattaaagaaatctacaactgaaccaggaatgaagaacggaacaaaattcttaaccattcggttttcaatgacagcattatgattttgtttgctctgtggttttgtttgttgagattttgaatgtagtttcccattaatattaaagaatgagaatgattttggaaactcattccaaaatcattgtattttggaaacaagaaatatgtgtgaggggctgggcgtggtggctcacgcctgtaatcccagcactgtgggaggccgaagtgggcagatcatgaggtgaggagaatgggaccatcctggccaacatggtgaaactccgtctctactaaaaatacaaaaaaaaaattagctgggtgtggtggcacgcgcctgtaatcccagctacttgggaggctgaggcaggagaatctcttgaacctggtaggtagagattgcagtgagccaagattgtgccactgcactccagcctgggtgacagagcaagactccatctcaaaaaaaaaagaaaagaaatatatgtgaagaaaagttgccaatttgtacttactgatatcttcagagaactcatttttaagaaaaactttaataaaaggtaaagaatgtttaagctcgtaagctgttctttatttttattcataggtaacctcagtctcttgtttaagtcagtaacttatttagtggtgtcttctttcttaaggtcagccacacccttagaaaaattaccaatgaaagttgaaaaattgctcccttaattgtagcattagttcaagaatttttttgaaagaatagtgccatatgtattaaagagatttttgaggaacaaaaaaacacagtcaaaaatttgagggcaatatactactactgattttactctagaaatgaaccaaattatttttagttgctgtagaggtactccactaaatctgtaaacatgtttttttgttttgttttgttttttgcgtctgcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcggtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagttcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaattcgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaagaaaataaagtcattgtccaccttaatagctaaggtccacaagggtaacttatgcagcatttattttttttgaaagtcaaaattgaatttatttctttcacatggctggtttgctgcaatatgaagtttcagaatgggctgaagtaagttgattgagggatttgagttgaatgacattttcaagttcatttaaatatgataaaaattcattggtggtaaataacatctgtctttcctggaaaaaaaaaagttgtgtattttcatgattcagttaaaacaaaaaatgagcctgtgaatcccaggcctttttagtcctccataacatttgaacagtttgacttgtcagcaaagaaatacacttatcaaattttaaaccaatgggagcctgaaagtgttacagtgtactgcttctt

SEQ ID NO: 13430 - DNA, 87205 bp, Human
ctctcataatattgaagtagctttgttgtctatggtgacatccgaggttcttggtctcacggccacaaagatcaaatatgtggacacacacaaagggtgaggtttggagcagaatttttaataggcaaaaggaggagaatagctctgctacagagaggggtcccaaaaaatgggttgcaatacgtggtgaaatgcaggggtttttatagatgagctagtggggaggcggtgtctgatctacataaggagggaaaacccggtttcgtgcatatggcatgaaaacccggttaggaccaggtgtgtcatctgcatagggcttaagtgtctggcagccccggccccaatcttctactatataggcaggtagctactccgtgttgcttatttccttcttactgtgcatgtggtaaaaaagaggggaggtggaacccccatggtggacatgcctggccccagtagccccttctgtctgtgccgctgccggcatctcccgtgcaagcttccagtttccttacctatgtttgcagcccaatcttccaggttgctctttgttagaaaggaagtgatttcttgggctgctttttgttagaaggtaagttctgccgagggctcttttgctcatactatctgcctaaataatttctatctcctgtatcaatatcctatgtgtgactctattctgcatatatgacttaggttttaattattttgtttacgagttggtcctacccccccacccccgcttccaccacacttaaggaaagatacattttaattcattttttatatggtatgcatagttggaggccaaaagattgagttgaaggattcattacttgatgaataaatggatgggtggatggatgagtcagtataaatgaagagcatcccaagttgactattttaaagggataacatgcattttatatttgttaaacattcattctcatttgtaaacacttgtatatattcatgtattcaaaatgtattgaaaattaattgttttccttggtacctgaagtcagtcctgggtattgcaaagtagttcgaagtcactggtttccctctgtctcacttcactacacactggtgattttgctaagtgatgagccagaaaatgtacaagttccagaatcaaaggtaaaacaaaacccaccaagaatcagctcactgttagcgtcctagttgaaaaataaggcttatcaaagtatttcagattgcattaacacttttgatatagctaggtatcagtgtcaacctcaggagagggcaacgccaactcctgaaaccttcaatacagaaagtctagaaaaataagcaaatatacatacaaacaatagcgagaagactccagaaaccacataaaaccgtgggaatcgaaatatcccttacgtgtgttcagtacatgtgaacccacgtattttaagtggacgatttctctctcagagtaccgtaggtagtgggggacggggcgcagagggggagaaacagaaagtcgccttcctccatggttcatttgcatttccatccagaaactcacaggtcgaccccaagactccactctctcccgcctttgagaagccggaccggcatcggcggctgcatccttctcctcctccccgctctattttggggccccatgatctcatgccctctgcagaccacacgctgcaattccagcccagcccgcgccgcgaggccacgcagggcgattcctgcaagtgtcgggagggtggccggggcgcggggaggggacggcttggggggaagtttaagacacgcccacgtaagggacccaaaataaccgacacacagagtgcccgaaatcagacaggaagccaaataatccggggcgttgagtcgctttgccctgactgcgagagccgggtgtagggcggggagccaaggatctgaccgcgaggggcgggcgcggcggggaggggcggggcggggcgggcggcgcggggcctattaaaggcgcggccgggcagcggggccggagcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtaggtccgcggccaggccccggcgcccgggagggctgggagtacggggagggcggcgccgagctcctgcgctctcagcgcagtcagcaccgggcaccggagagaggcatggtccgggagtgcttcttcgcccgcgcgctctcctccgcagcctttgcaagtgccctacacagccgcccctgccaggtaccttgccagggcaggatggttcactctcacttgaattatggatgcctgtgaaagcaggctgttcaaaacggtcatccttagaaatactcgaccccctgccccaggagagtacgggtttttagaggagaaaaatgtcaaacgcgaaagttgttggtcttaagaaggtgcatcaatgtgttgcttcttttagggggctctgggcgcagtatacatgacttcacttgggttaactgattgcagttgaagagttagcggagctctttaagttttattaggaactctacggaacactttttccctttcgctccgttttggaatttccttgcaggtgctcagaaattccatggatgttcacattatgtgactgaagaaacctttatgattctttgcccactcttctaaccagaggctacacggtttgtgttgctaacaaaagctacctattactcctctgctattttgctatgacatttgcaggacccacagtcaacttcatgaaatgtgggggttggtttttattctgaattcatggtgggaagtgctgattgagagaaggcctggattcctggctgttattatttgctgaggccttgcgtaactgtccctaaacctcaatttctaatgtgtgaaaatgggacaacatcaactcccttgtgcattgcatgggattattgtgaaaatcaagctgaagaatgtaggtagggaagtaaattgaaaacagcaaggaaatagaatcatttttattgtattatatggaaatcacagatttctatgtatagtgtaccctaaaatatatccccttacatatgattgaataatgctttgtagaaaaatttctaatttttcaagtctcctttcattttgtatgcatttccattttcactatatttgggacatcatggagatgctataatactttgaggaatcaatcttcctagacttaagagatggtgccgtatgcttagtacttaaaaagaagccttagtttcacagaataagtaccccaagccacatgatgtttgcatctcaagataaaattttgcatcttgtaacactgttttgagtctataataacacaatattgatgagaacttagtctcttgagtcaccttttaaaaattttgttaatggaagaccttagcttttacaacctgatcacttaaattgtttagtattaataccttgaggtgtttcacacacgatgaggtagtcgataattgtatatggaatcagtgtgtaactcttgtgtaaaaccatttctacatgcctataaacctttacaggttttccaattgcaaaattcaggttttaaatttttcttgctcatttacttatacatccacaacagatatcagcaaaggtctagttttggaataagctgtccagtctttgagacctgcagtcaactggtcaaacagcattctgtgtgatgatgctactctgggcatttgacatggaagtgtcctaggacttacttccacaagtaggactattatggaccttttttatccattaattggggtcttttgcatctattgaattggaaagaattcttacttcatatcttttgatggaacactgtgagacattaacatacaaatgttaccaaatagacctggtgcggtgactcatacctattatctcagcactttgggaagttgaggcggttccattgcttgagcccaggagtttgagaccagcctgggcaacatgatgaaacccatctctacaaaagatacaaaaattagctgggtatggtagcatgcgtctatgtcccagctacttgggaggctgacatgggaggttcagctgagccagggaaagttaaggctgcagtgaactgtgattgtgccactgcacttcagcttgggtgacacggtgagaccctttattgttgaaattgctatttagctactgaactgaaagtgcaaactcgtattcttctttcccttccctacttcaatacctttttcccccaaccccgccccccccccaaaaacttccccaaataatgggcttccaaatggaaaaggccccaaaagcatcctgacaattgtcgtcaaagagctctgggatatgtcttctagaaaggagctgcaattatagaattccttttgttttcagattaaacctcagcacacttttcataaagctgcagaaacagattgaactaattgcaacctggggttgggattaggagaggcccagcactatgatcctcagctacactgttttaatttagcaggataaatagaagagttgcgttgccttgcctttcagaggcaatcatgttgcagtggcaatgtaatttttacattactctgcagttttctcagataaactaaaatgatgtagatgtgtgagagtggatgaaggagtgaggattctgtcctaccctggcttctccccattgtggtggttgatcttaggagagggccaccaagctgtgctttagaggcttttggccctgggccctggaatgcttgtgcctaggtactgagccaaactgaggaaaacagcaagagggaaaaacaagtattattctctacatgtgtcagtaggtatgttaaatattagatgcctttccttggttgtaaatgaagttttgaactgaagtgtagacttccaccgagatgtgttgacttggagatgtatttaaatatccttcttgtttcttggtgtgattttacagtcatgtaattctcaactacattgcaatacatttctccagttagctcctcaaaagcattttttttgtgttgtttgtgaccttctgctatacttatgaatacatatatctgtgtatctgtgtatgtgtaaagggcttgcgtatgggtggtggtcactgaagactactttcatgtttcagtgaaagagttctttaaaaaaacatatatctatatctatatctatatatctatatctatatctatatctatatctatatctatatctatatctatatctatatctatatatatgtagagagtccgtttggctcaagtttgaggactgcaacccaggagcatagattcaagttgccctgagtagatgctcctattagcagcagttacaaatgggtttttaaaggaaaaaggaagaggcagttcctaagttgtttatcaagcattcatgttacaataacgagctattggttggctatacattgttctttgtatcacacattccaggaacatgaagatagtgggtgaggcagctgtcaggaacaaaatgcttttaaagaattgcccctgggaatgggtgcagtgatgtgactgaagtcccatgctcatgtccctctgggcctgataaattttgcatagttcgcatatctcagactgctctgagcaatttttctttctcatttcctccttttaataaaaatctttctcttcttaaaatactgatgatcaacgttttggatgtaagtttgtcccacattgctgggaaggctcatttccggatagtcttgtcccatgtcagagggaatgagatgggcagaagtactatcacttaaaaacttagtgaggttccaaggctgaattggtaggcaacaattcagggattggattgaaaaataaggggacagagcagcgggatttcaggtcattcacttacactggagttgaggtatgttgggtcatttctaagcatctagctattatgatgagttttttgttatagaattttgtggtagactttagacatctagaaatacaaagcataatcaatttaagaatcaaaaggatgacacaaataaggacaattatcaacaaaacaacttgaaatacaaatatgaaaagtgttcctattcctgaaggtaaccaaatgaatattttaatccacttcttgtcctggtctaaagaacaaagtgttgaagatctccactgaggaagatgtccacttaggcagggtagcctgatattggcccttctaacgtggctaggagtcctttatttgatggtattttctattaaacaaaatcttccaggttggagaccatgatctttgatgtttttgtctcctaagagcttgctgttaaaagaatccttaattaatttagaattttcagtgagaaacttataaggccttgacaatagtgaagagtatcaccttgttaatggaaaaaccaaactctgtaaaatattttaaagagctttatcctgagccaagatgagtgactgtggctcggggaaacactttctcaaggagtcctgagaatgtgcacctgaggcagttggattactgtgtgtttttatatatttcagggaggcaggagttactggcaaagacataaatcagtacatgaaaggtatacattgattccatatgaaaaggtgggatatcttaaagcaagggcttacaggttatttattcagcatattcagagattttttttttgagacagtcttgctctgttgcccaggctagagtgcaatagcacaatctcggcccactgcaacctcccgctcctgggttcaagcgattcttctgtctcagcctcccaagtagctgggattacaggcacacaccaccactcctggctaatttttttgtattttagtagagacagggtttcactttgttgcccaggctggtcttgaactcctgagctcaggaatttcacccacctcagcctcccaaagtgctatgattataggcgtgagccactttgcccggtgattcggagattctttaatttgcaattgattaaaggagtaaggctctgtctaaaacttggaatcaacagaaagggctgttgtggctgtgtgtgatggctcatgcctgtaatcccagcactttgggaggctgaggcaggtgggatcatttgaggtcaggagttcaagaccagaatgaccaacatggtgaaaccccttcaaaaaaagggtgaaacctctttttttgtaaaaatacaaaaaaaattagcagggcatggtagtacatgcctgtagtgccaaccacttgggaggctgaggcaggagaatcgcttgaacctgggaggcggaggttgcagtgagccgagattgcaccattacactccagcctaggtgacagagcaagactctgtctcaaaaaaaaaaaagggatgttgtaagttaagcatgatgctatgtagcaaaattgatgggtgtgcagacatgacttaaccctccccttgcatacccttaaggtcttgtttataacttggtgtcttattgccacagagacgttttcgcggtcttatttctattgtaacattaatgctggtcaattgttacgcctcaactccaaaagggagggagtagaattaagtgcgtttgacctctcttcctattttgactgagagctcagtttttgaggtttctctggggtctccttggcagagagtgggtccactcagttggtcgagggctttggattttatttttagtttacaacttttcaggagagctggttcgtagtctccttcatccaggtgcatggatctttccattcttatttcaaaaggagaaagctgatgttttccaagcagggtagaatgtaagttaagcaaatggaagagccttaggccagggaaggttaaagctttctgtaagctttgccaattaacttttcatgattccatttatttattcttccactctggaagactgagtgtggtttgcacaatggaaatgccgatccatccaatctcaatgagcttcaaccacacaagataagatttctggcggagcatagaggctaatgcctgaaatcccagaactttgggaggctgatgtgggaggattgcttgagctcaagagttcacgacctacctgggcaacagagtgagacctcatctccacaacatgtggtaggacttccaaaaatggagaatgcaatgagttcatgctggtaccaagcactgattttagagaaaaacaccaggtggtggtgggaagtcactgtgaatcctgctgacctaaagaaaaaaaaaaccaaggcaaaattaatgtaattatagagctttatttgggccaagtttgaggaatacaacccaggagcatagattcaagttgccctgagtatatgctgtgaaagacttctttataagaggcagaagctggcattatttgagatttgggtgtaaaaattataattcaattagcttccttttccttcccttatgatccattatcttaactctagaatatggaaggaagaatgttcaagctaagtctctgctcttaatcagacttggagttgacattgctcctttggtttataaaatttgttatctgtccagccatagttgaacattttaatttcagaataaccagagcatcttaagaggccagagaagtgttctctgtgtcccttatggtatttgtttcacatgttctaataaaatacataaaggattcctaggaacccaagactgttgtttttactattaggcagaggatagtacctgacactcaatgtcagcttttaattgcttgaatgaatgtactgcattttttgttagactgagccacactttgatttggaaaaggggaagatgggaagactaaatacacaagcagggacccatagggtctgtgatggtcaggaatccacatagagatgacacttgggtataaattcaggggtaagattaaaactgggatataattttatttgggtatagggagatggaggagatagtgaaggaacagaagtacccaactaaggtgaaggtgcctaagaagaaggcagacggggcctctgtgataacgtggattcagaatcagaaatctagtcagtgaacattctctcaggtacagacactccaagtgtggcagtcggcatgtatgaaggagagcctccttcacttacaccaaggcctctttggttttgataactttgctgccacaccctgaattcagtctttgtgattcttcgctcttcttcagcattgctttctgtcccttcttttcttctgccttgaatcttgttctggtatttctttttcaccatttgtagctcagctgtttccactccatgttgtctctttctcagggatacgtagctactgtttcaaaagcactttgctaatttctatttcacttgtttagttaactttggacactcagttttgtcatctcctgcccccatcatatcctaatcatgactctgaagaaaatccttggtggtcacattgagagaccttatgtgttctgtataataaagaactgggggccattaacctttctagagcatttacagaaatttttatctatcagccttttttttttttttgaaacggagtttcactttgtagtgcaggctgaagtgcagtggagtgaacttggctcactgcaacctctgtctgcctcccgggttcaagtgattatcctgccttagcctcctgagtagctgggattacaggcgcacaccaccacacctggctaatttttttttttttttttttttgtatttttagtagagacagggttttgccatgttggccaggctggtctcgaactcctgacctcaagtgatctgcccgcctcggcctcccaaagtgctgggattacaggcgtgagccaccacgcccggctgtatcagcttttcatcttcatccagctgactctttttatcttaagtagcaatgttaaaggtaaatgaaaatagtttcatattcaattttgctctcaagtttgatgactaccattgtaaaatatttgtgtgacatttaagatacagcaaatgtatttcatctatattgtggcctttttgtacaagccagagaactttatcatgatttataacttctttttttttcttactatggggagaggcatttaagttccagacaacttaggaacaaataagcatttggaatacaacttgtaattagagatctgcttttggttaaaataagcatgcctccatcaaccataaaataccccccaaacaagaaaaaataaacaagaaaccttttagcaaatgagctcagggccgaacatagattactcttctaagcataaatcttgtgcaacaaaacctgatactcagaattctgacccagctcgaaaatcccttgtcatcggataaaaactaagttatgcatttaccaaggaaagacaatgtaggaacacatttaaggtttttcaaaagagtgaccagaatgttcagttaaatattaacgggaagactattttctgagtattctagttatctgagatttagttgcaagaattaagatatctgtagtgtctttgaaaaattatttttacctttttttacttttagtttttagaagaggtgttggtagaagtgtaggtggtagaagtttagatggttataatcatttttgtagcacttggcagctttaaaaagcatttcccatatatttttgattgatcctcaatactcaacaactgtgaaataggaaagtatgatgacagtcaattctgctttacagataaggaatctgaggctcagtcagggattcagtcaggtttccatgcagacattattgtgcataaaaaccacctgggaagtgttaaagacagagattcctaggctccaatctcagtgattatgatttaatagatttggaatggacccaaagaatcctcactttttaacaagcacctcaagttattcagatgtaggtggttgatttactctacttctagcaacaatgggctaaatttataggcaaaagccacaccattagtacataatagactatgatggtaactggaaggacttttatctacagatttttatcacggactaatagctaatgccatcccattcatttgctaaatgttatatcctattcatcaagcttggcctgctgttgggtttccaactctcctttgcctgcttcagtataacaatgtgtaattagaacctaagaaatttctggtgtggtgatgctaaagcttgcctctatattgagatatatatgtgtctttggtagttcagtgatgagattttcctgggtggaagccaaaattagtgcactttattagtgtgaagtcaacaatcagctgtttctgggagcttccaaagtaggtatacttttgggaaattgtgcttttcttcttagtttgagtttccttcttggcttattttgaaatgtagtagaatagaaaaatagagagttttgatagaaagtgattttgggatgtgtggtggctcatgcctctaaaggagaccgaggcaggagaatcacttgaggccataatttaagatcagcctgggcaatataatgaaaccccatgtctatctctctctctctctcaatctctctctgtctctctttctttctctctctccatacacacacacacacacacacacacacacacacgtgtgtatgtacatatctccatattttatatatatgtataatatgcataagaaaatcattttggaggaagtaaattgtcacagcgaattgtcacaagtgtttctcatttatggattgaccattttctcaccgtatttcaggactttgcacagacttagctggcaaacatcctataacaggtgtgatttgagagtcttaaaaaaaaatcactatcttggttttcaggtgaatatttttgagaaactagcttgttcctaaagatgtgtttcccgatccccctcctgcttagaaagctttttttgacgttagcaagcatctgggggatcttgatgctctcttatggttagagagagagaattgaaaagaaactcagtagattaagacattatttgccctttcactgtgttgacttttacaccgtggtattaaaggagtgatggcaccttagcagacgtcattgcaatgacaccaattgtacaagtagtcatgcacttgcaataaaaaaaaagccatttcactaaaaagaacaccttagatgttttattgcttagatgaagcaataaaaatgtccttgatgaggctggtcgcggtggctcacatttgtaatccttgcactttgggaggccgaggcgggtggatcacgaggtcaggagatcgagaccatcctggctaacacggtgaaatgccgtctctactaaaaatacagaaaaaattagccgggcatggtggtgggcgcctgtagtcccagctccttgggaggctgaggcaggagaatggcatggacccaggaggcggaggttgcagtgagccgagatcgtgccactgcactccagcctgggtgacacagcgagactctgtctcaaaaaaaaaaaaatgtccttgatgaagcagatttaataatctgaaacctagattacctgtctttttgatattctatgtgacacaattggaagtatgcatgtagcatatctgctgcatactgaagtactgttttctagaggaaaagcagctgtgcggttgtttaagttgcaagctgaactaattttttttcaaagaacaccatttttatttgaaagaactgacaagctttttatttagacttatttatttgacatattttctcaaaaatgagtgatgttagcttgtcccttcaaggaaaacctatgaagctatcagctgtctatgataaaatctgagcttccaagcaaaaattagaattttgaaaaacttgtatttgccatttgagtgtaacagcttcctgatccttacacaaaattgatgaagatagcgaggaatgtggttttttttcatgttgtttaatgacatgcgttaacatttggaagaatgatagaacttagtgaaccaatattttccaaaggatgagtggatgatgttacaaaattatgcattggtataatttccattcaaagtgcaagatagactaatggattttaatgtaacagtatgtaaagttcagtaataccttttccatttttatgccataatttacttctttcaaaagacaaatataagataaaaattaattcaagagcacagatatatgcattctatcgaaatgaatacaatgtgatttataaatgagaacaaattaccaatgaacagtatttcagaagttgaaaaggtgacactaaatgttaaatacacagccttttagttatattcttcagattcagtttttttgtgaatttaatataaagatgagttcattttgcaacctaaaaatacttacttattgaaactatattaatactttaataaactatacaaaaaagataatgagacaaacgtgcatttgtggaactgcatgtcagtcagccagttccctgcagagggaattcccagcattacctcattcatctgtgagaacacagagcagtccctatttagacacacacatttgtctactgctccagcatggccagccccccacttcttgatggtttctttctgctatgaatatgcatgtccagttgtctgcttcatagagcagacatttaccttcctcatccaccagccattggaggaggactggggccacgcaaatgattgattcgaccaattctctggggagagtttcccagtggccctcttccatcatcatatctggaatcagatgagtttccatagcttcttttttttttttttcgcatcttgctgaagcagagttttgaaaagcaaaaccacaaactcagctgttccccataagaaatctgttatcaaagataatctccatggagactgactccagctgtccagcacttgtccatttgcgatgtaaaccatcttgccccccttccctgcttcggagcgactggtcatagtttaagagattactacttttagaattttggtgtggttttaaagaagaatgtccataatcatctgaaaaggcatcttagggttgttagtaacttttagaagtataatgggatcctgataagaaaaatttcgtgaatatatttacaaatatttaggaaataggtgtacatccagtaatattttcagtaatatttttcagaactaggggatgtgagggcgatctggctgtgacttctatcaccccattgatcgccagggctgatttggctatctggctggctaggcgggtgtccccttcctccctcactactccacgtgtgtccctcccgaagatgtgcgctcggttgaagaagatgaccatctcccatagatgagaaccagtctttggtcaagggtatatgaataggtgcactcccctgctagaacctccaaacaaactctcaagaactagggagaggagagtgaaaattaacctagttacaatgattgtatccttacattcttttataaatttcaaaatacttctacatctcctacctcattagtccaaaccacagctctgctgttatccatccccatgttagagatgaaaaaatcatggctcagagaaagtttggagactttccaagatcacaaaatcaataattctgttaatctcatctctgtagtttattggtgaatagttttggagtcagacaaaatcaggtttaaatcctgctacggttactagctgtttgaatacagacaaaaaagtttcctaaatagtaccacaactgtagcatagagacaaaatcatattagagtgtgttaggagaagtaaattatataatgtgtacaaaatggtgcataatatgccctgaataagtggttttttcttgttattgttgataagcttcaatgtgactgagaattttttattttaccttactcagaaggcactttacatccttaactacccaaagtgtggtctgcagactgacatatcagcattatcctcttagaatttgtaagaaatgcagaatcttgggccccaccccagacctactaaaccaagatctgcattttcatagatcctcagaggtttgtctgaacaattaagtttgaatatcagcactccataaggctatgagacagcacagaaggcaccacatctggaatttctgtagctgagaattctaattaaccctcgctgtgccactgacttcatacatgatgttgtgattagaaacctaaaacaaaatgaaaaaactcaatgggcctccatgacctcaactgtggttgcattaggttgaattggtgctaccgctggttgcatttggcccctttccttccatgaacctcagtggcacatggatacaagtagccccattgctcttgcacatacagaacatggcatagtctcctccctttgcatataccatctctgtctttcaggaacctgcctgtgctctcgtgtgttgcttataatttaattgccttcttttactctgcactggcttgtcctttaattgctctttattgcccttagcgttgccaatcttctgtctttgctgttacctgataacattcagatgtttttccaattcagccatccatctatcaaaatatcatgtagatggtgctttccatcgcacgatcaatggaactatccaattccaagtttccactgcagtcccctctcaacaatcaacagtatacttgacacaaaaccaaaacaaaggaatcttataccaacgctttttcaggtgatgtaaaatcaggttaaatgtccttggcccagagtttattccataatacttcatcatccaaacacactagcttcctataaactgccacccagcaccatttcgattataatctctgggatactaggaaacaggtgaatgaaatattcatgtgggaacagtgtggtttaggagcattatgagtagactctgttggtcttatctacttttggattagtcggggaaataagcaggaaacaactctacttggacacgatttatttgaataccttactaatcagcacaaaggaggtaaatgtgaagaatattgacatatataagtatttatacatttgttatctcttagaaactttcaaagaaaaagaatattgagtattatggaatgattcaagcaaaggtcttcagagacagggttcatgtaaagggtctaaacgggaatcacatgaatcatttgctatgtgacctttgaacaattactttctttctttgactttcagtttccttaaccgtaatatgaggagttggattagatgggttccttctagttccaaaatatttgttttgagagcttacaatattttccccattgctataaaaatactatctattgcaaaaaattcagaaaatataaaaaagtataaagaagaaaatgaaaattgcttttgggttttttcccctccaggacttttctatgtgtacatatcactttttaaaaaaaaaaaacaaagatgagatcactttgtgcatattattctgttgccttttttcatttatattccattatgaaagtttaccattgatagacagctttctaatgtacttttcataagtaggattttgagacttttattttagtatcctcaattcaataggtaatctttgaaactatttctatgcatactttagacattctcagtccccaagaatttccagctttttggtacatgtttgttttctgttttattcattcctcagctccatctctattgcttatgtctctttttcatggttaaattactagtttttctaaaataatagcttctctgcattatgtttctgctcagaatttttctgggactgccacagcacacaatgagaaaatatatactcctaagccgagactagtttttatttcccacacgcgggataacagtagacgttaatcaatgtagggctcaccatgaatagtttcatccattcgtagcagtgctgagtctgtgacatatgtgttcagtcatttatgagttaatatttgtcaaccacttagagtagacccttgctggtagtaagtgctatgtgtgtttgttaaatacatacatatctatttgtgtttactatttgtccggccctatgctaaagacttatctcctttaatgggtacagttctgtgaggtaggagggagcaaatctgttggcttgggagtgtctggcctagctcccatacctcagtgggactcagtatcctatatgatgtatagtacatgcaatattatgtgcatactttgtattaaggagattgtagggctcagatatgtttcagtcaactgctgctgtgatggcactttgcccatttagagagtcaaaaaaggactgaagatgcatatctctcttcagcattccacacctctgaagcacgccttctatgacattcagctcagccttgtacagttctccaaatacactttgtacagattatatctgttttctaccccaccgtgattttttaacctctccttttctcacccaacatcaggcacccaccaagacccaactcaatgtgtcctctcaaatgaaacattctttagatgctctttggccccatctccctgtcccagaaccactcaattgctactggatcctgttgaggccatagagcttagtgagtaaggccagaccctggagccagagtgctggagtgtaaatcgcatctctgccaataattgcttttgggtctttgggcaggtcccttaacttctctgtgtcatagcttccttgcctattaaatggggataatagtagtagtacctcacaggtttgttttgagggttaggtggattcatatttataaactaatgagaagagtgcctgatactagatggtagatcggggttcaatattgttattgctatggtttgtaacttatttaacaaatatgtagagtttttactgtgtgggcagtctggtgcaagaggctgggggctaaatggtcaaagggaaagtttacttactgtctgttttttaggttttatctgaagggaccagatatttatcgaagaattatacaagattatctcaagttgcagctgaaataagtgcagcccagaagctgtgtacatagcgagggggaattagccttgtccaggaggtctgagaaggcatttcttaggaagtgacaggcgagcagaagaggattatgagaaaaggcagcagcaggggaaaggccctgggagaggagacaacacggcccatcccagagcttggaggaggccaggatggctggtgtgcagcgctgagtggagtgtaatggggatgaggtgggaaatgttgccagagccatctccaggcaggatttgttgttgttgttgttgttgttgttgtttgagacggagtctctctctgtcatccaggctgtagtgcagtggcgccatctcggctcactgcaacctctgcctcccaggttcaagcgattctcctgcctcagcctcccgagtagctgggattataggtgctcgtcaccatgcccagctaactttttgtatttttagtagagacggggtttcactgtgttggccaggctggtctcaaactccagacctcatgattcacccacctcggcctcccaaagtgctgggattacaagtatgagccaccgtgcccagccggtttttgttttaagagcaattggaggccgggtgcagtggctcacgcctgtaatcccagcactttgggaggctgaggccggcagatcacttgagccaagagttcaagaccagcctgggcaacatggtgaaaccccatgtctaccaaaaatacaaaaattagcctgttgtcgtggcacacacctgtaatcccagctactcgggaggctgaggcaccagaattgcttgaacccgggaggtggaggttgcagtgagctgagatggcgccactgcactccagcctgggtgacagagcgagactgtgtctcaaaaaaaaaacaaacaaacaaaagcaattgaaagcaattggaaatcactgaaatatttttctgtttggtttcttttttatttttgttcttagtgacaagttctgatttacttttggaaaaatcattttataatagctttagtggcacaaacaaatcaacgggaccctgaaaactataatagctttagtgacactaacaaatcaaagggagcctgaaaatagaagagcacactgtctttttgttgttgttgttgttaattgaccacttcgtaactttttttattcctgctagattttgagtccgtagatgtgttcactccaggatgataaccactagctacatgtggctatttaaattaaaatttcatctaattaaactttaatgaagcaaaaagtttatttcctcaatcactcttgccacatccgtagtgctatgcaatggcgcacggctagtcactttcatattgacagtacagatctgtggaacatttttagcatcttaaaaacttcacttggatagcatgtaaaaattgtgatattatagtttttaaaaaataccttgatagttctccaattaacaatgatgaaaatgtacatagtacttgttcaagaaacatttactagaagacaaattaaaagagttaagatatcaacgttcttataaatattattttaagattccttatccaaatgattattgaatatgattaagttgatttaagcctaaatatatacatgaagaggtgacacatttctaaaattgtgttccctttctaattataagctcatatattaattactaatttttttcataatagtcacccatttttcatctttattaacttagaaaattttacttcttatttaaagccctggagcatactttcaaaaatgattttgaaacatgagtctcttcattaggtcaacatttgtctaagcacgtctgtaaatattctgttacaggaagaggaagagtattgagcaaattctcttcaacaatcagacagctctgctttagggactgatatccttccagttcaggaggaagtgtttccaggtaatttccaatgaactccagatgagtaaggtttgacagctgacccacatgaggggacaaattcatcaagctacttttccccaaaggtaaacattgcagctttttgcactgaaacagcccatctggtagcatctcactgttgttgttggttacagcacagtactgcaaattactcagatactggatttcttctggaatgaaggtcaagtggttatagcttagattcaaataatgtagtttgctgcataggaaaagctgctagggcagattctcaatattaataggaccccaaaagagctgctctaggttagataatgccccagtttatccaggaatgtaagtaatgttattgtgccataagtttaagcaggaaagattctgaagatgctgacagccaatgatctcttccacagttttaaggttattttcctttaggtctaactcatgcaaattattcaggctgaaaatggagtatggaatgcattccaggtcacagctgatcagttctaggcttttcttattgaccatcattttcaagttgttcagcacagccagtttgcttccctcattatcaagggacaattcttcagtgaaggcaagaggtctgcaatgacttgtgggatctgggagaggctactctgcaagtagagggtccttggatattttaagtcctgaaagccgtctaactgcacagtactgaactgttgagggagaacacagcctccctgtgtggggcagaaaagtttctcacataggggaaagataaggttccttcagattcttcaggtgaaatacccagcatgggatttttcccatttcaggatgcttcaggcagaggattttaaaattctgctccaaaaagccagtgcaggatggtctactaccagagatgaatggtccacatctttgaggttgaccagctgtgagacggcagacggcagcttcacctccagggtctgctccaggcttagcacctccatttcggtgaactcaaagacatttgtctggaagactgttgagcataaaaagatgcagttctatcttgtcttggacattttccacaagctaatgtttttcagtttctcaactgtccattcattactgaggttgatctgtttcagtttgttctcactgacctctgataggaatatggagaagcgtctggaataaaaaggatcatactgattagccagatgaaggatgaaggcaaagtcattcttgacatcagggatgtcactatagttgcttttttctcttaacacctcaaaggaatattgcttcatggatctcctcagcatccaccacagcctgtaggaggaggtcagactgtagagtacatccaaaatggtataaaatgaagccagaaacttcaagatttctgcgaaggaatagacacactggtaggcttatatcctgtaaaagcctacatgtcaactgaacagtcaatttaaagagtgatgtaggttaaaaaatatggaacataagttatgatgagcacaaaatgactttgactattatctgcttcagatacacactataaatgatgtccttctgctctacgtgcatgcggaatcttctcactttttcaaagatggctgtggcctcttgcccctccttcttgtccaggccactggaagttgggctttctataccagctgactccaaagcccgctgcaggtggggcaatgactgctttctggaatctatgtcagttgaacaccctgaggacgaaagcaaaatcttggactcggagagtttcagaggcctcactgactgctcggccactgtttctgacagggtgcaggtggtccgtggagaatcgaagcacttataaaggatggccacaaaatgctcaagcttggagctggtacctggggtagtgaagccataagttgctgcaggctgcaaagaacagtgtgtgcaagagcaccaggtaggggaagaacgttgcaaaccaatggagctgtttctcgtaacagacagcgttgatgtaggagtcctgctgtcagtggaggtcgttctggattccgagtgggatcggaaactgatgtcccgggattagaggatgtgtttatgctggctttcaggatgttccaaggcatggtgcaatgattgtcaaattccactttgtaagaagacagcacagaaccctgctctgtgtcagctggagagctccagccagcatgtccacatgatcagcatgatgtaataccagaagacatcctaccatgattttaagatgtgataagatgactgggtgtctgctagtaaacattttagctcggttagtgtaatcatgactttcccttgtaggaggacagaaatataatgaaaaaatattaaataaatcagaaatgcttcaatcaggtgatctataccttttgaagtttcttagacataccatctctgtgtttgtcttcattcctatgaatgctggccaactggaaccctgcaattagtctcaaattgaaaaatttcctgtctttggccacagggtcaatgatggatgaggctaatgagtgtggtattgaaaacacgggggtttcagtacctgtgggccatccaggtagagaggtccagcaggcagctggaaaacaaaccggagccctgtgtgactccagtcccgggccccaggcccacacattcccctccattaccaattttaaaattctgtctttaagttgtcactgtgattgtgattgaataaaatactaggcctttacagaaattaagtggtggtttatatctcccatttcctgtccacaggaagaattactagaaatcctctgtttagttgtctttttgtttgtttctactgagcccatctttcaaggataaacacaaggtgcccgaatgagtatgttccaaaaattatttcagaaaaaaacagcaaataaattacagaaacttaactgcacattatgttctttccaccctttgtttttcatctctgacccactatctgcataggcaagattcttgcctaggcaggaaaaactatgttttttggataagattcatgaggcttttccttgcagtccatctgttgggtcctctgcctgagggcagaaagagctgttctgcaccattaataaaactgctttcctccctttcctatcttatgagctgaactaaactttacaattcttttctaaagtaatttaatactacttttatttaacgacatatctttcttgatagttgctgcaaaagagaccaactattttcaggattgggggacaatttttcttttctttttttaaaccaactgaagaaagatctaattaaaatatgtttttgcatcaaagggatttgagaattagaaaacaagataaccctcaaaatggagagttctttgcctatattaaatttagtttagattgtgccttgggatgtctgtctgtctatctatccatccatccatgtatttatctgtcttggtctgattatttactgtttgagtccaattagaaaaacaaagctcatactcagtaacttaatcaaaataatttaatataggaaacaaataccaaaagtgttagaagagctaacggtcaaacagggaatggtaggacccttaggcaaccctgagaagagtaacagaaggaagccgctaccacctggagagcaggaagggcaaaagaaaaaggtgatgaaaccagagcttgggagctagggcttcgctgtagcagctgggaccctgggcagatgcagccactgcaggggtcccacccggagcagggaggacaaggtagatacattctgatttctcctttcctcccaccctccaatgttctctttcctgttggcctctcctggtctgatgcttggagtctgggagtctgggaagtgtagtagtcaaagttacttctctgagttggcggatcaaaagaaaaggcagtaacacaacttgggtttcttgggaaacagactattagatggaaatgagcatgcctgggatttcattagagtatgttcttgagatcagcacctgtggaaggcaagacaaggaattggggtcatacagaggatgactgtgagctgcagtgctcattgggtgtgatgctctttggaggctgtgcacctgtggaaggcaacgcaagaaagtagggctgtgcagagggtgaaggtgagctgcaatgctcagtggatgtgatgctcattggaggctatgcccactctacggaccttcttaaactagtgggagaccctctagagtggtccaggagggggcaagctgccccaggaaggaggagagactttgggcaaagcggctgtctttagctgagacactccctataggtgaccactcccagcagctggaggagcagtggtgcctttatctctgaaggggagtccaggcacctgaccacagtgcccatcacaggcagggaaaggatgtgaaagcactgtctgcacattgttgatttaaaaaaatcatacattgatgaaatgtaaaaagtgaaagttcagtttgcctttttaacttaattctgtttatgatttacatatttccatgtcccagcctgttgatctacctaaattaaaatatgtatattttaaaagatttattgataagataagaaaatgtttacaaaatagtattacatgcaaaaagatgaaacaaaaattgtatatagaatcatttctcagttatatatgtatatgggtttgagtgtgtaaatgcatttaaaacaataataaaaaaaatagggccaggctgggtggctcacgcctgtaatcccagcattctggaaggccgaggtgggtggattgcttgagctcaggagttcaagaccagccgtggcaacatgatgaaaccactgtctctaccaaaaatacggaaaattagctgggcatagtggcatgtacctgtagtcccagctactcgagaggctgagatgggaggatcacttgagcctgggaggtggaggttgcagtgagccaagatcatgccactgcactccagcctgggcaacagtgtgacagcccatctctcaaaaaaaaaaaaaaaaaaaaaaagaaaagaaaatagatcaaaaaattttaaaaatgaaatggaatttttttggtagaataatatggattcatgcctgtttctgttttctcttttttctttttcctttcaataaacatactgtttgagaatagttctagatttacagaaaagctgtgaagcttgtgcagagttccatatactccatgcccaattcctctgtcattaacatcttacattagtaaggtccatttgttacagctcatgaatcaacagtgatacatgattattaactaaagtccatactttattcagaattacttgttttttccctaatgtctttttttgtttttttgttccagtaccccatccaggaataccacattacactgagttgtcaggcctccttaggcttttcttggcgaagcgtctcagactttccttgtttttgatgaccttgacagttttaaagagtatgagtcatgtattttgtggaatgtccttcaactgggatttgtctaatgtttttctcatgattatacttgactgacgtatttttgggaagcacatgacagatggtaaagtgccattcttaactcatcatttcaagagtatctgctattaatgctattaataggtcttgtcattgatgatgttaaccttgactacccggctgaggtagtctttttcaggtttctttgctgtaaagatactcttttttgtccctttccatactgtacctttggtagagagttacattccacctccttgatggtggagtatctgcataaattatttggaattcttctgaattggaaatttgttctcccccttatatttatttattcagtctttttcagtatggagtcattaatgtctattttatactttgaattataacccagtactctgtttttcatgtttttgcttaacttgttccagccatggccacttggcagttaatttctgtgaccctttgacgtgtgtgtgtttgtaagtgtttagcacttccttactttctggccctacaggatgttccaggcttttaggttctcttgacttgtttttttttttccttacagatttcttaatattatataaccataaaactagtgtgtataatcaaaagtcagtttctccaccctgcaaattaggagtggacttacataaacctttgtgcctgaactctgtgcatttcccagaggtgggcatcacaccacccatgcctccattgcactatatgtgtggattagttttcagacatctccctttctccaatgaagtgataaataaccaggttattccctcagaatgaagctggccagatgtgcactttaccttgggaatgatttaggcataagatctgggagaaggagaaaggcaagcatgcttcctcaggtgggcagggagccatcttggtttgtgtgaccaacttgataaattcatctctgttcagcacctggtcatcagctctgtaaactcaaaaatctctcatagtttttggtgtgtcaggagtccacgaaaggcttgactggacctgtgtgaatcagggtctttcatgcagctgcagttagatggtgacttagagttggaacagcaagggctggggcatttaggggctggccaggcatctttctgtctcttcttgcagtcttagggcctccccatgtggtctctgtgcacggaatggttgggattcctcatagcatggtggcctccgtgtaagggtaactgcttacatggaggctgaaggctttaagagcaagtattccagtgatgggtctacataagtttaaaataattggatagtattttatgttgtttggatttaccaaattatatttgctccatgatttataaacagaaatttaggttatttgcaagtttttgcaattccaaacactgctacaataaatatctctgtgtgcatatctttgtgtgcttatgtgattatttctagcagataatagaaatggaattgcaagagtggtaaatatgcacactttgaatttaggtagattcattgaaatgaccttttagaaaggaacttacacttctgtgaaggcagtgtgaaagaatctatttctccttatgtgcttgtcagagcttgtgattatcagtctttttaatgtttgttcattttgttgggtaggaaagggactcattgatttgtagttctttgattttttttaatgaaaatgaatgttttatatttttattagctattttctttaaatagttggtttattacttttggtatttttaaaaattggattttttttctacttgatttttataccctattatctattgtcatgtaccaaaaatgtcttatccttgttcccccatcccaatgtggtggatttttgtttttttggctttacaggaatttccaatttttatgaactcaaatgtatcaacttttccattatcatttttggattttgtgtcatacttgtaaagcaaaattgtaaaaatatttgctcatcttttcttctggtgattttattttatacctttaaacatttgctccatttgccattgtattttgttatcaggaaagagagagaaattttgtttactaagcacttcaagatcttttttctcaatagattgcttttcttaagatgctgaagtaaatcagtacaatagataaagaccacaaaaacagcattttgcgacagtgacagtcctactgaagacaggagacagttaaaaccatcagaccaagaacagaggagtggatatttaataattctatgattacttctgggggttaactatctgtgaatctaaatagaagttccagtggctggaggctgtatctgaggagggaccctttagccttttaaagagtgattctgctgtgcagttgaggtgttttctgtcactctccttattgatgaaatgcttgtgtctcaagatacaatgacggtctacaagtcatggagtgaaggtgaacatgaaagctcaatgaaaccattactttatactatgagatggatgttttattctttgacctttaacttcagagagaaatgacctgtgaaagcacttggtgagatcttagtaaagaagtgatttgcccactgaggcagaagttataggtgctggttaaattttatctttttctttgaaaatgtttggtacttattgaaacaaaaatgaatgagcatgacagaagaggagaataattgccctagaaatatcagctgtctggagggcttgcagaaacccaggaaagatttcaaatataaagggcctgctgcaggtgagtttctggccccttttctgctttgcctggggaagtaaggctcctgggctggtgttacaggagcatctcaagacaagcttctcattctaatagcctgtgttcaaccaagaatcttatgcatgtacatatttgaggtaatagtcttttttttttttttttttctgagatggagtctcactctgtcgcccacgctggagtgcagtggcgtgatctcagcccattgcaacctccgcctcctgggttcaagcagttctcctgccttaggcccctgagttgctaggattacaggcgtgtgccactacgcccagctaattttttttttgtatttttagtagagacggggtttcaccattttagtagagacggggtttcaccatgttggccaggctggtctcgaactcctgacttcgtgatctgccctccttggcctcccaaagagctgggattacaggcgtgagccaccgcgcccagctgaggtaatagtctttaagagaagagggtacaggatgtagggtcaggggttattcaaataaaggtatgattagtttccagagagaagtaaatttgtagacattttacatttattagggaccatagaaaatatttagtccaactctttttgtttattgataaagggacataaataatgtaactttctcaagatcacaaagctccaaaagtaatacatgtcttaattcagatatgaaaccattgagagttactggtctctttgtgattatggtcacgatttcaccaaacttatatttttaattgaatatggctggaattttaatgtgtaatttacttacagtttaagtggtaaaatatgaatcattcctgctttcttaagccagtcttttaatttgatgtttcattttaacctttccttctaaaaaaattattttgtcaattgtcattaccagctcccatgagttactgataggagttttctttgagtctgttcttcaaatgcttatttatcaggataattaattaaaaagaggaatgatgtaatgattatttgcttaaatatcaggcgtactaaaatatctttttctggattactaattttagtttggagaagaatctgatagttttattttcccaagatactagtccaaccaaatctatactatgtttatctaaaataattgtttatttttatttttattatttttttcttcaacttctattttaaattcagtggtacatgtgcagaatgtgcaggtttgtttcataggtgaacatgtgccatggtggtttcccgtacagatcatcccatcacccaggtattaagcccagcatccattagctattcttcctgatgctttccctccctgcacccctgacaggcccagtgtgtgttgttcccccctcatgtgtccatgtgttctcatcatttaaagtaattgttttgagctgcaattttctattaccagtgactcctaacattatattagatttaggggattgtgttctctttcatgtacatcatatcatacttgaaaattaaaaaaatatacttgtgattatcttaatttttcatttaaagaaaggttaaaggcccagatcccctaagtgacatatgggcaccacttaaggatttccatttcgtgtcgtaatcgtaaaacttctcaaccttctctgactttatttctcttgtcttctgttcttttaaaagaaagatgtgacagaaagcacaaaagatccccaaaaagagtgtgtggttttcttttttttttttgagatggagttttgttcttgctgcccaggctggagtgcaatggagtgatctcagtttactgcaacctctgcctcctgggttcaagcgattctcctgcctcagcctccctagtagctgggattacaggcacccactgccatgcctggctaattttttgtatttttagtagagacagggtttcaccatgttggtcaggctggtcttgaactcctgacctcaggtgatctgcccgcctcagcctcccaaagtgctgggattacatgtgtgagtcaccacacccagccgagtgtgtgtgtgtgtgtgtgtgttttaatgaatactgttctctttattcacagttagcatccacttagacaaaatcttattgttctctttattcacaattagaatccacttagataaaatctattaaactcagcctgctactgattttccccacttaccaaataatagaagaacttggcgtttttttaaatgcacgagattcatgacactgacacaaattagaagcaagtactgtttgacatgatggcatacgtccagcaatttcattaatcattattgtaaaaaaatgggttgatggtggattcttggaaagtcaaacaaaattgctgtgataagtctttgaagcatgtttttgtggactcctgtcttaacattactcattttaaagccaatattcttccttttatgtttatggaaagtgcggtactggcatccatagggcagagattgtttttatccatagaagcaggaatccctttttagggaaagtgcttgtgaccttagcttgcttagagctcatgcagagaggtcctagacgtgctttagcagctgggcttgagcaggtagtgacaagtactaccttatgtgtggatctgtgcagaggcaaaggaaaccagtagggttcccctctgttatgttgccattagcctactgattgcttcttgtcaatctttacaagcagtggtttggtaataaatgaccttgtccaccaagaacaagagtgagttttctagcttatttggggttcctgttgtcattgtgtgtgtgtgtgtgtgtgtgtgtgtgtgtgtgtgtgtgtgtgtagtttgataaattacttaaaagtttataaaggccagacacgatggctcatgcctgtaatcccagcactttgggaggccaaggcgggcagatcacctgaggtcaggagtttgagaccatcctggccaacatggtgaaaccccgtctctactaaaaatacaaaacttagccgggtgtggtggcgcatgcctgtagtcccagccactcgggaggctgaagcaggagaatcgtttgaacctgggaggcggaggttgcagtgagctctcatcactgtactccagcctgggtgacagtgtgagactctgtctcaaaaaaaaaaaaaaaaaaaaaaacccaaccagccaaccaaacaaacaaaccaaagtttataaaataactcttccattacttctttactacttccccttccttctatcattgtcattttcaacctatgccagctgtaagttgataggtattcctataatgatttctgtgaatcttgaaacctgttaatgagataataaatattactattcccataattgccaagctgacataattatgaggatgtagggcattctgctctaagacaattatcatagtagatgttcccaggcatcacataggcaggcattaatatttaatctttagtgtcttctaccatgtctcttttgctcttaaatcattgagttaattttattcattttatttttcatttctagaaattttatttttttactttctagatcttttttaaaataatatactgttttctgttactattatctatcttgccttatttcttattttgaacagtatttgaataaatgacaattcaagaactcatgaaagacaccaatttttagattcaggtagcttattgaatcttaagtagaatagataaaataaatatatgttgacaacagaataacattgtagaacacaaagttgaaaataaaaaagtttaaagctattagagaaaataagacagattcacttcaaaaggatgatagtctgatgactggattctcagtggtgatgattaaagcataaggtagtgtaatgatatcatcactgtgccaaaagaaaataattgccaaactggaatttgcatatccagtagaaatatctttcaaaaacaagaataaaccaaagacatgtgcagactaacgaatactgagagagtctgctatcaggaagaatctaaaagatgtactttaggctgatgattccagatgaaagctgagaagaaaaaatgcataaagaaagtggtaaatatttggtaagtttaaatgaacttataaaacaatgatgtctaaaggggtttacaagttagatagtaatattaaaagaaaagtctgaaaagctataatctaagcatccatattaacagtaagaaaaaaaaaaacccgaaacccagaacattaagcctagatatggaaggaaagaaaaataagagtaagaccagaaattaataaaataacaataagcatacaaaagaaaagataagattactcctggttagcctgattaagtaaaaaacagacaaaaaagggtggcagtacaaatcatatcaagaatgaaaaagaacacaaatagagatgctgcaggcattgaaagtataacaaagggttattataaacaactttataaccatatgtttgaaaaggtaggtgaaatgaaaaattacaagaaaaaatacaacttatcaaaattactcaagaacaattagaaaatctaagtaattctctagcccatgaagagattgaaccacaaattaataaacttcttacacagatttttctaggcccagatatgttctccactgagttcttctaaacctccaaggagaaacgaactctaatcttaccatccttacagcctagtttatgaagttagcatggcctttcacttgaagatctttttactgtcgttgtcctggaattttgcagtgatgtgaatcggtatgagccttcttctatgatttattattttggatacttgatattaggactctttgatgtgaagttttgtatatgtctttttgaatcccattgaatatacttaataagatgtctttttatttctattttttttttctattcccctctcccctttaccgttctgtgttgatcttagacttttgtcttaggcttacctccaatgactggtgaatcatggtggttcatttatatttaaggatgagagattaggtagatttcatggagctttgagtattcaggcagaatttgtttattgaagtttgcttaaggtaaataggcagagaaggagcttactgttatgctgagaacccctaaaatgccagaatgaggaagagtttactctgggtcactaatacccacattagtcctgtggttgtcctgtgtactgattccaaaagtacatgggtccattggagaaactttggaaaataaatataaacactaagaagatgacaaaataacttgtaagcccatccatcaagtgtagatttatgtataaccaaaaattgggaccatattacccattctgttttatcatctgttctttatacccaataatgtgtcatttttccatgtcaattaaatattcttctaaatcatggctgtataacagttatatacagccatatatacagttatatacagttatatacagttatatacagaaggctgtataacagttatataaatggtctatatttctttagctattttcctactcttggacattatgtgtatgtctattttttcttatacatagtactgtaatgtatatatttacatctaaatatttgtacatactttcttaaccttagtataaactcccagaagtgcaaataatatagatgttttatggcatttgttttaggatttttcacagctacttgtacccaaaatgcttgaatcagtctagggctgcaatatattaaaagtgcagatagatatgaatctgtagaaatctctaatatattaatacaaattggtgtttacatggattcccttttcagtagcatgggctggaaggccactgtatacctataactaaaatgtctagtgccatcatttcctgcaaaataatttgttgtatttcttctcagattccttgctcctgcatggtcttcagctactgttgaaaacagattactgtagaactaaaacaaaaaaaggaaaaatgttaatgcactggtttatggcatttaagaaaataggaactaggctgtcgtacagttgacaaacattggtaaagttgtactatccctttggaagaatccgtagtgggcccagtcctttcagtgattggatacttctagtaggaactaccatttattcagtaaccctatgccctcgtcaccaatctaggcatgttttgtacattccgccgaaggctcctgccaactttgtgaggtgggtattatcaccacgtcatagatttaaaaatgaggcttagtgaggatttgaaacattccctactttcacagctgctggttgtctagaagtcagaagaatgcaagccgcctgagaccactgcagttgttttgtgcacaggtgtctctcccgcactaggtcagtgcttgagatgtagtaggatctcaagaaatatttgttcaatgctgaataatgaattgaaaggtggaatttgaaccaaagtcattttgaacttgaagctctttctaccaggcaggtgtcaatttctttagttttagtgtttcactgagagattgtgagatttgtccctatgtgatgtgcttgttcagtgctggatgtcccttttcctgattttcatgtgactagttatgtaaagggcttcacatcaagtttcactgcagtttcagaggatcttcttcagataaatctagcgtaactaaaatgatactgagtgcataagagaccaagcatgcatgaacaactgcttgagtggacttaggaactttttttagaagagattctaacttctgctttgagcttttgtaatgctccaaagttcttcaggaatgtgttgtctttgaatctccctttgaatatcttgtagaagtttcttggcactggatttactcaataggatcgaatccccatcctccagcaaacgaaatcccgtgaagactcccagcaccaggctggtctgaatcctcacagttctttttcagaaagcatgcaactttggtcaaagatcagaggactgataggcaatgtagtcagctgattcatttcaaatggcactttcataccgtctgacacattggaataccacatccagcaatctaccatttcctaaacaaaattttgtgtgtatatttgttgtaggtatcttttatgtaatgcagacacaatgtcacttaacaaactgactctgtcagcttagatgaggaaaattaggggatttatggtttctccccatttatgtttaattaaatcacagcttgctgatgttcagcttaacgattatttgttgaatgtttactttgtgcaaggcaccatgctagatgtggaaaacacagggttgaataaataaatccatgcctctcgggaactcacagtctagtcagagacagacaaatcttatggagcatggtaagagctgcagtaactaggggtgagggaagacctagagaaacatggtgctagcatctcctcggtgaggagggtctagcaagtccaaggcctcatttcccaccggactcataacatagccttccacaatgatcccaagggatcgttctgggattattaaatccagtcctgtcactttcatatttcagcgcctgaacacactccactgaccgcccgcaggctgcctcaggacccatttgttccctcccttttccctccagccccttcccttcccactcctacctgcctcctttacactctgcctgcctaggttcaaatcttgctgtggatgcttatcaacccccggtccttggcaagttactaacctctgtagctcaccttccttaaactgtgttaatcgtaatctgtcttgtgatgttatagtttggattaaatgatttaatataaaactcttagaaaagtgcccggcacgtaggaattactagagaagtgacagccatgattgttgttgttattttctccttcccaggctggtgttgtctttcctacctctgtggctttgcatgaagcaccatggcgtatatatggtcaccactatgtcatttcttaggttgcttctaactatgtcatatctttatcatcagcctatggcatcattccagagttgttgttgcctttattagatttataaactctgacattaggacttcaccgcaaattattttttttttttgtatttccccacagaatctaaatacattgcatcttgcagatactcaaacctttgtttactgacagagggagaggtccctttttctccaaatctctctttgtaaagccttttgaaacccttttcttcttttctgctctccactgtgttgttagtatgttagcattttttacatgtttctactgaagtccattgcaatcattcgttctaatgcttcccccggccaacttcctttgtttctctgtaagggtaggagttgttttatttgtatctctggtctttagtacagggactgcacattgtggacactcgtatttcaatgaatgcctgatacagaaagaataatacacatgatattaatgccattgtatttgagggaattggtgagggaaaaaaattttttttttagtatttcttttgactcactaaatgtctaagaactaatgatttagttaactaaagaagcaggaaactccaaatattccaaaaactttgcttttactttctgtctcccagtttcttgttttctaagataagatgtatttctatggtttcttagaaaatattaaaatttgaaaaatacctaaattgttatggagattaaaatggatggtagattatgatattgatgagttaaactgctttgacaggaaaattcaaactaaattaggtttcacagctctgaaaattattgaaggggaatttcctactaaaaatcattctgattaggtgttttgtaacaaagtagtagatattctaaatttcatcttttatggatgtgactgtcaatgagaaatgatcatttctattgtcatacttttgtttcagttctatgctatgcctcatcttataaaaggtaaatcaagaacttctttttaataatgaagaggtgatttttaaaagtcagcatgtgtcttcagctacttaacaagaggataaagagctatatataaaccatgtgtattttaaaccaatggttaccatttaaatgcttgcttaccacctagtctttccatagtagttttcctgtccatctagttcttctactcatatactcatatccaatttgtcctgcccctttcagccattccacccatgccttaattctcttatccccttttgtattctgttttccccacctttccctctcccagggcatgtcgtcttttttttttttttcccccattttcccacttccactcttagaatttcaggccattcaagtttgttatattccatgatttcagattaagctgggctcccagagctggagggtctttttactcttccctcgttgacagtctttgttgtcgccactggtttgttgccatctttcacatgggatgccctaagccctctctattccttccacactcccacccagatgcttcttacttggccaagaagattgaagaggttcctcatcagctgtttctagcttcctgttgctataccttagtttgttttgtgtgtgtatgtggtgtttttgtgtgtgtgtgtatatcttcctctcagccttctgacatgcctatctctgagcctaaccctctgagagtattttattgtataagtaaaatatgacttgttcaaccagcttccttaaaatgagcttaggttgttcctagtttttttgttcatttgttttatgaatacagttttgaaataaacaccttggacaactattttggccacttgtgagagtacagttagtactagctttgcatgattctctgacatgcacaaatttcagttaccacagtttaattaaataaaaccagctcccaacaacatagttcaaatttcatttaccaagatatattaactgtgagtaattgcgtaaagtacaaactttgctgctagctcatcagtccacaaatcactgtgcaaatagcaagtgcaagttatggtcagtgaccaattgcatcatttctttcaaaatctgccagtgattagcccataggcatcttttagtcagttcatgcacagacagcaaaagcatgtagttgtgttgttgctgctttgcctctcagaggtaaacctatatgacgttttcaaaaagtggataattgaaaaagtgaatgaactgatgaagaatgaaagtaaagtaaagaaaagaaaggaggtaataatgctggaagtgaaattgaagtcaaagtaaatggagttatggaagaaacagctaaccgtgggaatgctaacactgccatggtgcaatagactccagatatgaagccagaggagtctagtgaagctgaattttttgacataaatgaggagagtggttgtgagaaaaagaatgaagatatcccagagggagtgacactgccacaaaacttcctcttggagacatttcataatgttgaaggtgcaaagcttatgtgaaaacattggaaactgatctaaacttagaaaggaatatggaatatgacaattctccaaggcacagaaaatattctcactctgtattgtgagttatgtgatagatgagaagaaggtaagtactgtttggactattctagataagtttacagataaatacaatttcaattcttcatggtttttttttttttttttttttttttttttccttgagacagagtttcactgtgtcgcccaggctggagtgcagtggtgcgatcttggctcactgcaacctctgcctcagcctcccaagtagctgggattacaggagcctaccactgcacctggctaatttttgtatttttggtagagacggggtttcaccatcttggccaggctggtctttaactcctgacctcgtgatccacctgccttggcctcccagcgtgctgggattataggcatgagccaccgtgcctggccaattcttcatgtttttaatgttttaaattataatacactaaatatagatgttttactatgttttattttcttatacatttataattgacagtaaaacagtttttgttgttgttttggcttgtttttttttttttttttaattttttttgagcatcttgctctgtcgcccaggctggagtgcagtggtgcgatctgtgctcactgcaacctccgcctcccgggttcaagcgattctcctgtctaagcgcccccgagcagcagggattataggcgtgcatcaccatgctgggctaattttttgtatttttagtagagatggggtttcaccatgttgaccaggctggtctcaaactcctggcctgaagtgatccccccacctcagcctctcaaagtgcctggccgtttgtgatgtttttgatagatatttttagagattatctttccatatagttgtgtcagtttacaccaccatcagaagtttaggagaatccattactattctcttctgataccttgttctgcttatttgcccttgttgacttgctcaagctcttcctctgatacctccttattttaaggaatatacacacacacacaaagaaaaacacatgtttttgcatccttaaagaaggctaaccttttgctttctttgcaaaaactcttcctttcttttatccattttattttgaagtaagtaagacctgctgcctcactttccttaccattcacttcctcttaagtctttgcagtcacttgacagtaggcacctcgagagcagaggtcatgtctgttttattactgaatgtccagtacatagtccgtactcaatactcttcatctgaaggaatgaattcttataaaagcctccaccaaccatctacttggtcctattcacccattcctcctgtctctattatctcttcaccttagctttccggaaatactacaccatctttccatacctccacccattgtccattcccgtttgcattttcttggtttcagctaagataggctgttcattatttatctgccaccttccatgtgcctgccttcgtggaacccttctttatgctgccctttctcctagaagtttgctgtgttctgtcctctctttccttcctccagttccacctggcaacatcacgccatcatttcccccccattcagagccatgccaaaagcttgctctaggaaactctttctgatctccctctccctaaccaccccaacctttctccttctttaaacaactgtagaactttgcaggcggtttgtagggcctaccaaatatgggccactgatgtgctgtttttaacttctcctacccaagtagaaaccccttgagctatctcttattttttccttcagtgtataacagtctttgcgcatcattggtactcaattaatattttattgaggtgccctgtaatctgacattccagggagctttcaaggaaactttgtcacactaaaaaaaattgaggattgttttgtgggttattccgctcctttgtcttctaactcacagaagttctgtcatggttcttaggggttgtagggtgtgtccacttattttaaaatgtcaaagaccagaagagtggagaatgggaaagtggcaaagtgttagcactggaaagatgtttagagatcacgtagtccaacccttaaattttatagatgaataaactggtatctagaaagcttaagtgacctgcctgaaatcacacaactagtttgtggtaacacttggtccaggaggttgtcagctgaccctcttcagggctcgttcccacaaggtaccacagtacatgtgaggatgttaggtttgggtttgtgtagaactgttaaaagaggcatataatattccacatattgcctttaatggattgatacataggaaatccagactctgtaaatagttttctctctctttcccttaataattataatttttatgactaattcatttatactaactaggagagtttctaattacattaacattggatggtatagaatggttggttgacatttgagtaaactttttattaaagtataaaatacagaaatgtatacaaatcacaagtgtatagttggaattttcaaaaagtgaacacatctacgtgactagccccagactggaaaaaagaacagcaccaaaaagtttagaaacatttaaagcaataaaacatttggagaaataaaaggattttaaaactatataaggccaggcctagtggctcttgcctataatccccccactttgggaggctgaggcaggaggatcccttgatgccaggatttcgaggttacagtgaactatgatcatgccactgtaccctagcctgggtaacagagtaagacactatctctaaaaataaaaaataagataaaatattttttaaaaaagaaaccatgtaattttctcttttctccctacaggtattgtcagtatgtgtgttaacaacaatacttggttgtatatttgggttgaaaccaagctgtgccaaagaaggtaattaggtgtgtgtgtgtgtgtgtgtgtgtgtgtgtgtgtgtatgtgtgtgcacagccttattaagaatgtgattgaggtaaacattatctcctattcctatgggtactccatagatattgtcaattcaacgctggcttgagcctttttcctgaagttcttgtattatattagtcatataaagttctacttacaaaacatggccgggggttctgatgctgttgtcctggagcccatgctccctgacttcctccagggactcagaggacattctttactgctcttttaccctaaggagttagttgctgaagcaaccctgtaggttactaggtgacagttaccatccctgggcaaccagaaacctgtcagtatgtgctcttaaggttctaaaattgcagacattggttgtttcaaagccacaatgatatttttttaaacttctagatatatttttctttccatcaattgcagaaatctatccagcattgacaagattataataaataattaaactggatcacagtaaatcgtagtggttattatcttgtctttgaggtagttccccccccatcccctcgcaataaaatcattgatggtcattctagagaattcagctttgaaaattgaacaggttcttctgtttggctattctgtgattgtaatattaattatttaaaaaatttttagtgattattaagctatcatgtactgttgaaaagtagtaattttatgtatcagtaaactattcagaacacatgtatctaagtttaactgaagtaaacagttacagactttagtgtttacctatgtcatcttttagcatgaagtgattcactcctgagttgacacatacaaattaaaaatgaaaaataacaattttaatccaagcccaacatagtatgcatcatatttttaaaaattattaggtgcatattaatgagctccaagtaatagctattattccaatagacttccctgacccccactccaggtcaggaaagttcgtatttctgacactagaaattattattgttacttcatcttcttaaaattgcctgatttcccagtgtcaaatgagaggtaaattccatggcagtgtctttttgggtcagaacaccattaaagtcaagaactaagattatttcttttttgttgttgttggatgtcccttattttccatgtgttcctttttttctttttttctcattgtcctaattttctagctctccagtgaaacctggcttattcaaggtatctagtaatgaacttcaacagtaaaaaactgtcatgaaaagtactttcctcccatgtctaccatttattcatttagcaaaaatgtgctaatctcaactatatggcatgcacctggctgggttttagggagacagtatgctgggcaaagccagatgtggtcttggtttgccgtctaactgggatattaaccaaataacctagttacgtgtggaattaagtaattgaggggaaggacaaggttttatatgagcttaaaaaaatggaaatcaggcctagctggggagttaggaaagctttttagagggagccagtctggatctaaaggtgaaatgggtgtttcaggtcagggagggaagagctatgccagggagcatgttctgaacaaacccactacttctttacaccaggattgagagtgaggcaggctaggtaatcttttcctttctaaaatattcttaaccacttctaaaaaaaatttttcccacattttgaaattttagggaaccccatgcctgcttaagccaactttttcatagcacaaagtattcagaacaagcctttattctgacttttattttatcacaccatggttatttaagtcttatcagacccagtaacgtttgtaataataatcattaaaaagttatctttctttcctacatcaggagataaaaatcacaaaccaggcacataaggttactttctgtttgtatcactttttgtgtgtatttgtgaaaagatttttgccttactttattaccccatctgtattttctaaagtagtatttgaacctagtgtacacctaacttagttgtattcgttgatgtttactttgaattatataatgattagaaacatctgacttatcgttcaattttttcagttaaaagttgcaaaggtcgctgtttcgagagaacatttgggaactgtcgctgtgatgctgcctgtgttgagcttggaaactgctgtttagattaccaggagacgtgcatagaaccaggtaaggatgagcagggaaaaaagtggagttatggtcattaggaaaagatcaaggaaagttctgtgtctttcaggtatgtgatttacctaattcatttgaattttttttagtttagcatacatacacgttttgacattagcttttatattttctttcaacagttccttaagagaaaaaaatttacagaatttctctgttaaacattttatggatagcagaactttgtctatttttaatgtatgctgaaagcctttgtaatctaatttgcattcaaattctaaaagcctgcttgaaatatagaaatattttcattatggttctttgacggcaagagatcttatatgtccacctatatttttcaaaataaaactatcagaatatgaaaattttcttagttagatttggaattctctgcatatgacatggaataatttttaaatgagagagatttatttatttttcattagtatttattttttaaagacagggacttgttctgtcacccaggctggagagccgttgctcgaccatggctcgttgcaaccttgaactcctgggctcaagagatcctcctgcctcagcctcccaagtagctggaactacaggctcacaccattatgcccagctaatttttaaaatgtttgtagagatgaggtctcactacattgcccaggttgatcccaaactcctggcctcaagcaatcctctcaccttgacctgagagtcagacttagattaaattttagcaggtagaagaagccaggtctacatatgaattgcatatggtaaggtgcatctaaatttgaaaatgacaaaattctggacttttagtgaaataataataattggttcctacatattttaccccattagttcagagtggccatggtagtggcagattctgtgagtgactaagagctgtgaaattgttcattgttgctcatggatcatactcaggaagacagcaattctgtgttcactttggacatgttgaatttgagacataaaacacattttgctgatgtttgtttctagaacatatatggacttgcaacaaattcaggtgtggtgagaaaaggttgaccagaagcctctgtgcctgttcagatgactgcaaggacaagggcgactgctgcatcaactacagttctgtgtgtcaaggtcaggtgctcgttgggctctgcagcagcctggtatcttccagcgtcttagcggggctttacataggtgttatcttttatattaggagtcatggctattggccaactatattagctgaaaaaaataattttaaaactttttattaaagaaacttttaaacatacacatggggagagagagtatgtaatgaacattatacccatcacccagcttcataattatgattatgtgcacacggccaataatattttatctataaccactcattcccctgccaccaccctctcatgttattttgataatagcagcacacttgatgttgtatttgtggaaagatccctcttacagtcctggctgacttttatgtcccggcttccctcctagtaaatggggacactgtctgctgtgcattgagagagtcgatgtgaaattgtttagaaagattcgagggcattttgtaaggtgatactattatgatgtcttgtccaggtattattattatttttttttcaaatttcttgacagaacctgactctatatgagagagaactaagacaccaaaataccaaggattttgatgagtggatagaaggggagggttgtaaattttggctgaaaatattaagaatttgaaaatggaaaagataccttcaagttctcacaaatacagtagtatgttttagtcttacaattgtgcatccatttttaattcctgatatcaactaactcttattttgaagcacaataattctctttattgattatacacctccagagtcatgtcctgtgttatctatcaatctgttcacatactttgtttttggaatctgtcttaatgtgtctcacaagcatcacaattattattactgttaagtgtgttcattttattttcttgaaaatattttaggtgagaaaagttgggtagaagaaccatgtgagagcattaatgagccacagtgcccagcagggtaagattatattctgaggtattaattttttcttttttagaagtacagcatcatttttttctttccaaattaagatgataaaaataataaaatcactggtttattaaacattacaggttgagtatcctttatccaaaatgtttggtatgagaactgttttggattttggacttttttggattttgcaatatttgagttataccagtttgggcatctcaaatctgaaaatcccaaatgctccagtgagcatttcctttgagcatcatgtcagtgctcaaaagttttggattttgaagcatttgagatgtcagattttcagatttgggatgcccaacctgtatttttagccagatcttgtgtttggcaatggtggaacagagatgattatggagttatccctattctggaagtttatagaaaaaagagaggccatgaatatttagtctttggtattgaagaatgctagataaaaatatttgcattttccttttcaggaaggaaggatctttacttttatttggagtttttagagctgctaaacttgtagaaaatttagcttctttttttttttgtattttggtccatttatacatttttgggataacaacctatttgtgagagatgatacatttttttaaaataattcatatttggtttttttgtccttcagatattttgtacagggtcttccatatatgacaccatcaaaaagagtatgtgtggaatttaaagggtgaagattttataaaggtgttaagtgtatttatctttgttccatttgaggtctaccatctcatacatttgaattactcatcttcagaaatgtatttttacctctttaaaatgatagttttcccagactattaaaatttttaagctgtattttagttcattttgttcatgtatgtaatttttgttatatgtcttcttttttttcttttggaaggaaaagtacttttgatttaaataagcagtagcaacagcagccaaaactaaacctcaaccaaataatttcaacagaagagcctttttttaaggaaaattttcatgtaccctaaactgtcttttaaatccaaggaatactgggaatgttagacttagtgaatttcaaatctttctttttcttctaaatattgcttataatttttcagttgtaatattgaatcttttagtggaaaacataaccctttctttacaagaagattgtaacttaggacacttattattacactggataatttaccagtatgtttacgtgatggcccactaacctgcttttatgatttctgttgattgaataaaactagttttgtatggaccgttaagactatatacactggttctacagagtctctcagtggagctatgttacagatagtagctagtgaaaattgtataaaaatgttctccttgtggggttgcttttgtgtttgtgtgtgagggtaaggtgggaggaggcagagttgaaaaggcaaggtaaggtatttcctgtcaagttttaaatttactgagtaaactttcagtgggaagtctaacagttatccagtgttatagaagttccctaccacctaccatgtatcactagatgctgaaaaatttctgagccatggccgttttggggtagccacatggccattgtccatagctattctcgtttgtcaagtatattagcatcctctgtggtttttggcctcctttttgaaatttccacactacacgttaactgtttgtatatgtatgtatgtgttgttgaaacctcattgatcattcccagctttgaattatttctttgttgtttatatatttaaatatagtatctctcaaacttttgtattaagtatttatatcttttaaatatattaagcctaaaaactaaatacagtatataggcttggtgggtggctcacacctgtaatcctaacactttgggaggccgaggtgggaagattgcttgagcctaggagttcgagaccagcctgggcaacatagtgagacctcatgtctacaaaaaataaataaataaataaattagccaggcatggtggtgcgtgtttgtagtcccagctacttgggagggtgaggcagaaggatcatttgagcccaggaggttgaagctgcagtgagctgtgatagcgccactgcacggcagcctgaggaacagagtgagactctgtctcaaaaataaaataataaaataaattaaataataaaatagtgtgtaatgtatatactatatgaagtactatttactgtattagagtccatatcagaaagtggtggttcaggaagaatatttatggaaatattatatgctgttgttttttattgtttattttcctgcaaattgggaaaacaatattatattttagtagcaattggtgtagcttttggaacagcaggaaccatgaatgatgtttctgtatggtggctcaaaatgatatgaatgcttaatatatactatgtgatgatatatatgtattacgaaatgatagagcttgtatataaatataaatgcatgtaaaacgtactttataagtatgcttgccgactttgttagttagttttcttaagatcacacagaccttagtggaaaatcttcactggacctgtgccaagaagggggtacatcttcattggatatgtcttgtctttgcttctttaaacatttttttttctttttcattacccaggtttgaaacgcctcctaccctcttattttctttggatggattcagggcagaatatttacacacttggggtggacttcttcctgttattagcaaactaagtgagtaacttcagagtttactgctggaatatcaccatttcagtgagattgactaggcaggcagtctttcttggaaaagtactggcagaacctaactgtttcactaaacttttctatggcaaagtagttgaaccttgtgtaaggcgcttatctttaatagtgtgattactctgaagctgcccttcaaaaaaataagttaatatagttatcttcgaattttaacctttggccatttttatatgtatttattctttctcagaattttgaattccttgtgaaaaagtcccttgtttatttattttacaaatattattatttttgagactgagtctcactctgtcgcccaggctggagtgcagtggtgtgatcttggctcactgcaacctctgcctcccaggttcaagtgattctcgtgccacagcctcccaagtagctgggatttcaagcacatgacaccatgcctggctaatttttgtgtttttagtagagacagggttttgccatgttgctcaggctggtctctaactcctgggctcaagcaatccacccaccttggccttccaaagtgctaggattacaggcgtgagccaccatgcctggccttattttacagatattttatttcagaaatagaatttcaaaaactaaaggtatttctgagatattacgagtacagacatagaatatttgtcagttattctgtattatcctttggattgaattggactcttcctttttttttttttttaaatcccaatcaggccttaattaagtgatttttctataaattccccataaaatagtataatggtgttttcttaatattgatgccaaagttttaaatcacgttaacaacctttaagcagctacaatgtaatactggactaaaatagatgtaagtaaatacaattactttagctttttttctggaattctaaaatattgcttaccagatttgagtatgtgaggtgctttaaacattaacatcactctttgtaaattcatatgtacgtcattatgcttgtcttatgaagtgccaaaataattttgggagagttttaaaaatttttagtttttaatttctacatggaagaagatagttttgttttgttttaatgttttgcataaaaagtctttagctttgcatggacaaagctgtgttcttcccagcaggcctgtggcctttgaagtttaaatacagccctttgttggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttacctgttcactctgatggtagtttcttttgctgtgcagaagctctttagtttaattagatcccatttgtcaattttgtcttttgttgccattgcttttggtgttttggacatgaagtccttgcccatgcctgtgtcctgaatggcaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcattatttctgagggctctgttctgttccattgatctatatctctgttttggtaccagtaccatgctgttttggttactgtagccttgtagtatagttcgaagtcaggtagtgtgatgcttccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatcctatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtggggtggggtgaggggggagcgatagcattgggagatatacctaatgctagatgacgagttagtgggtgcagcgcaccagcatgacacatgtatacatatgtaactaacctgcacaatgtgcacatgtaccctaaaacttaaagtataattaaaataaataaataaatacagccctttgttaccattatcaggagagcttgtctccatggtgccaaatgtggcatcgtgagtttagagttaagaggtggaggtacctgtatatgaagtttaaaataaatcattaaaccatgagcccaagccctagctttgaataattagggaatgtagcctgtaattctgaactgatggaaggcagtgagatatatagacacatgccaatttgagggacttttttaggcaaatggagtattgaacgctggaatcattagttatgtgttccctcctcaatagtagaggcaggagaaaaagaatgaggcaccagaactagatcagcagggcatcaggaatagtcggacttctgcactttcttggacttgaagccacaagatgccttttgtctttaaagcagctgagtttgtccagggttagctgcttctagatttatggcctgggaccctgtcttcccagctactccttcatccttgttttaatttatagacttagttcagttttcttattctacctcttatgatttaggtatttgaccactaagtagtatcaaagaacttacaagcatcattttattataacttgttcatcttgaatgaagtgatgttatgggtaattggcttaattattttaatgtttttctgactaagagaaaaatgaagtcatctttaagattggatttgtatccacagtgttgctttataattcatcctgaatttttatctgattaaaatccctcctgggctaattttttttacgtgatttagactgctgtggtaccactgctaaatgaggtaagccaattgtcagatgtatttaataacaatgtttatttttttcccttctagaaaaatgtggaacatatactaaaaacatgagaccggtatatccaacaaaaactttccccaatcactacagcattgtcaccgtaagctctgcatttcaacttctatctgtttgaagaagtgagatgggattgtaacattttttgagggaatagatttaagataaaagaaaaacaacttattttccaataggtagttaagtaaggaaacccaggttctgatctttgctctgccacaaactagctgtggctttggaaaggtcactttactggctgagtctccattttctcatctgtgaaaagagatgactcaagacctcaagaaacgatttcctggtttcctttcagtgttaatattctctgattcttgtatcctagttttgaggcttactttatttgagccaaaaaaccttcccaaactcctgtgttcacaacttgtctttctaatcatcttgatgatgaatttaagcaagccactttgcctgactccaaataggattacaatcctgtttttgtttcagtgtttccagatttaatttgagtcaaataaaacagtagaactcactaagctttagaattgaagccagaaaattagtatgttagcttatattgatccaagctactctgggacctcgccaaaaaaggaatttgttctgcagaaatgctttactcagcaatttaaaaagacaacagcattgttttcaaaatttcagaggctaccttttttttttttgtttttttgagatggactcttgtgctgttgccagactggagtgtggtggtgcgatctcggctcactgcaacctccacctcccgggttcaagtaattctcctgcctcagcctcccaagtagctgggactacaggtgcacaccaccacgcccggctaatttttgtgtttttagtagagtcggggttttgtagcctgcccggacctaggggcggatggggggaatgtgggaataaaagacaaagacaaaagagtatatttggaagaaggggtcagggggtaccttgcctctagtggacaagggccctgagctttacacagccctccatatttattaggcaaaagagatagcgagtagagggcggtggttgtcggctaattgtcagttggccttttggttcacagcaggcttgcgagactacattcttttaacaataggctagatttctcagtagataacttcaaggagcctggccagggagtgaggccctcagcaaaccttttggtggcagggcagtgtgagtttgcccacatcctgcattcatgaaaaacagtttgctgtttgaccatatagcctccatggaatgctgagttggtcatgtcccacgggccttcagctccctgcagggtttcaccatgttggcaaatggtctccatctcttgacctcgtgatccgcctgcctcagcctcccaaagtgctgagattataagtgtgagccactgggtctggctgaggctgccttttttatatagatctttatccttagtattactgacttattttctcctattacataatttaaatcacaaatactacataaaatcttaagaggttgcgttttgccattacctgatttttttgtttttctttccttaaacttattataattccatgtagcttcagttatcggtttctttttgatgatttttttctgtgaatgtatttaacattaagtaaacacaacttgcatataatctgttttatcttttttagggattgtatccagaatctcatggcataatcgacaataaaatgtatgatcccaaaatgaatgcttccttttcacttaaaagtaaagagaaatttaatcctgagtggtacaaaggagaaccagtgagttctttgtttttctactaaaatagttaattattctcatctatttcaatcagagtaaaataaccagattctctagagcttttaataactgatttcatttagtgtgtctgtggccattcttttgtaaatggagatgaatgctgataatcctaaacataacttgtataattgcgtaaaaggagagtagtttatttcagaggtggatttgggttgtgctgggcaatttttcttttctgatcaattcttcttctaccagtagcatatagcagtagtatgggggtaatagctttgatctacacaaaactacgttgtttttgaacgtcttggttttatttgcctgtgctaatttaggagcttctttccaattgtgatctccaatttactttccaagctgtgttctcctttttaatttttaaaattctccaattctccaatttacttttttaaattgccacaatttaaaaaaattttttaaaaattgccacaataattatataaggtctatttaaataatcatgatattcctcttagaaggacaaagagcataatagttagtttgcaggttatgaattcaaattttagctctgacatttaaagctgtgtgactttggacaaatcattctgtttctgcctctgttttatcatatctataatgtagataatattgtttactactttgtaggattattgtgaggattatgtgaattaataatgtagcatgcttgtaggaatactatttagaaccatgattggcaataataagtgcttaataaatgttagttacatacacagatatctcagcaagttaaagacatgtatattcgtgaattttttttcttttaagagacaactgttaattaggggaatagctccaaaagctacaggagttaatctctgactatttaatatgttgttgctgcttaagagtcatattacatgattattgtcatctaagtgctgaagcttgttgaccttaaaagcattctagcactagagaggaatgcattggtgtggtatgaatacatactttcctaagagatgaatgtttgcatgatttcttaattttccttcattttctgctccagatttgggtcacagctaagtatcaaggcctcaagtctggcacatttttctggccaggatcagatgtggaaattaacggaattttcccagacatctataaaatgtataatgggtatgtgaaatgaattttttctaggatctgtaatatagaacagcttattcttatgtaatctcctttttattgaatcctgagctttagcatttgagtgatatgttggctgaaaaatgagaactgaagaactctttctcaaagagtttagatagatggtaaatggacagtaaaactagacaagtgggccagctgtggtggctcactcctgtaatcccagcactttgggaggctgaggcgaggggtcacctgaggtcaggagtttgagaccagcctgaccaaagtggtaaaaccccgtctctactaaaaatacaaaaattagccaggcgtgatggcgggcgcctgtaatcccagctactcacaaggctgaggcaggagaatcacttgaacctgtgaggcggaggttgcagtgagccgagatcacgtcattgcactccagcctgggcgacaagagcgaaactccctatcaaaaaacaacaaaaacaaaaaaaaacaacaaacaaaaaaagactagacaagtgttttctagagccttttgagaaacaccgataacgtgtttagttcagatcttcgggcagacatgaaaaatgaggtcatggtggaggtagagatctgggagtgggagtactgcacatcttaactctagaaagaaaaagaactgtaactgcccaacaggttcatcttgcacacttcctagacagattgggtttatcaagacaggagaattgcaatggagaaattgtaattcatgcagagccagctgtgtgggagactggagttttattattactcaaatcagtctccccgagcattttgggatccaagtttttaaggataatttggcagacaggagttcgggaagtggggaatgctgatgcgttggattggggatggaattataggggatcaagtgagtttttcttgctatctcctgttcctgggattgcaaaactggttgagccagatgaccaggctgggtggtgtcagctgatacatggattgcagggcatggtctggtaaatatctcaagcgctcatctgagattttacactagtgatgttattcccaggagcaatttggggaggttcagactcttacagctggaggccgcatggcccctaaactataatttctgatcttgtagctaatttgttagtcctacaaaggtagaccagtcctcaggcaagaagttgtttttttttctgtgtgtgtgttttttttttctgggcggtggggaagggctattaccaactttgtttcagagttaaactatcaactaaattccttcccaaggttatttcagcctatgctcagaaatgaacaaggacagcttaaaggttagaagcaagatggaattggttaggtgtgatctctttcactgtcataatttgctgttacaatttttgcaaagatggtttcagaaccaagagaaggaaaagatgagtgtattaaagaggatacagataggaatgatctctgctatttagcatctattgcgtttgcaaatattattaaaaagaagatattaatggtacctctggatttccatttctaaattagtaaatatgctttctaatgtaagaaactgattagaataacctctctgtgatatttgaaatccatgatgcattgagaaaatacaaaaactttttaatggaagaacctctttggccgatttgagcaagattaccgaaataattttatttatttttaaattataaaatttcggtcacaaaatcaatacaacaatgcatttagaagggtgaacagaaaatatcttaaatcccagacacgaaatgcttagcaattttccttgtgatcttatgctagttagtgttctttatggttcccaggagcacagtgcaatgcctcttctccaccttcttatttgccactgtttttattccatggacagtaattaagagtttatgggctgggcgtggtggctcacacctgtaatcccagcactttggaaggctgaggcaggcggatcacgaggtcaggagatcacctggctaacacggtgaaaccctgtctctactaaaatacaaaaaaaaaaaaaaaaattgccaggcgtggtggtgcacgcctgtagtcccagctactcgggaggctgaggcaggggaattgtttgaacccgggaggtggagattgcagtgaactgagaccgcgccactgcactccagcctggtgacagagtgagactctgtctcaaaaaaaacaaagaagagtttgtgtactaagcatgggggattcaaagattaatagtatatgatctcttggctttttaagatttagtagagtatacaactaattgtacttggggtggggcaagaactctgattagaggtgtgtaaacaaagcctgtgtccagaggaaggcatattcaattctgctcaggaaatactgcgtagagaactgctgtctgctcctcaggggcctgcttcacagctgtgctgagtcatcagtgagtgagtgcttcatgatgtatgctttgcaaagtatattaacatatgagttattcatgtggtatgcagttactgttttcaggtccatgaatattatcctcaagtagaggatagcaagcaaagttttaaatccaattgcaatttttatctgtgtaaaacctaactttcattctttcattgggaaaataaagttttcaaataaaacccttgatttcaaacacaatagatgcgaaatagcatttagtagctcttaatgacattttcaatgaaaaaaactatattttacacccaaacaattgtcagccatcttttatttttgtttgttcttcattttagttcagtaccatttgaagaaaggattttagctgttcttcagtggctacagcttcctaaagatgaaaggtctgtaggcaattaatttctattgtaaatacttcgttttgtagaaatgatatactattttaaaatagactacaacaaaactttgctatttgctatgatgttttatatcgaaataaattctttagtaaatgatcataccacattttgaagaatttcaaagctgtaaattatttctcagtagaactgttacaccagtgttataaaatttaatccctatcaattgatgaattattttttccattctgtttttcaatgtgttcgtaaaatattacattttgatactgtttgatttagaccacacttttacactctgtatttagaagaaccagattcttcaggtcattcatatggaccagtcagcagtgaagtaagtacatttttatcagtaattatttcattaaacccagtcatcaaactgaacctcgctttgaaggaggctgctagaccattttataagattctatcatttctggaaaaagcaagtattatacacaatattactaaatataaggatgcactttaaacaaaataagagttgggagaattgtttagcctgtgttttccacagtgctaaattaaactgatgatcaattagcttctatattttcaatttgaaagcctttatccactccatcgccccttaccttggcctaaatactaagtgctttttgagaatgttataaacagctaaacctccagtgtgaaaatacagggtaataagtcaaatagcagaggaagcctcctatgaactctcttccttaggagataggtctttggccacctgagaccatgcttacaacagaggtcccatagaaggatgggagattttatcaaaagtgtagcgatatttgaatacgtgattttgttgaatatttcctaggaaactagaggtacgaaacagctcatggactaacactttcagtgtaacatctcgtttgacctgacaccctttcaggaacttagccagcgcctagctatgtttttaatctgtgtagcactttaaaacagcaaacactgctttcagttttcacgtggccatatcatttttgttaccattttaatggcaaaaaaacacaattacttttgcaccaacctagtattttggaacacaggaagcattagaacagaaaaggatctgaaggctcggcaccatggctaacgcctgtaatcccagcactttgggaggctgaggcaggtggatcacctgaggtcaggaatttgaggccagcctggccaacatggcaaaaccctgtctctactaaaaatacaaaaaaattagccgggcctggtggtgtgtgcctataatcccagctactcaggaggctgaggcaagagaatcgcttgaacccaggatggggaggtttcagtgagccgagatcgcaccactgtactccagcctgggcacagagcgggactctgtctcaaaaaaaaaaaaaagagaaaaagaaaatgatttgagcatatttccttgtacctctaagttgactttccttctgatatatattttgttggtgacctaagatatgaaaggaagtaaaaagtaaggatcttgactattttgggtcatgaaaaaagtgaaaagaggtattgccaggatccctcctgtcagaatccttgtgtagtgatcttgtgccccctgtgattccaaggggtcatagactattaaaaaaaacactctttcttaattttctagggcttcactcccaaattcctatcagttctcccgcccaggtagcccaggttggatagtcggtgagccttaaggactcttcagcacagcgttcagactaaagcctggcctgacatgtctgtcatggtccctgtttttgagggtgctgcttgcctaattcagcaacagcagaggaaggaagggaggcaaaaaagcatccttatttttctcacttgaatttacaacagctgcctaaaccatcttcccttcatttccctttccctgggtctgcgctagatttgcccctcttaaaaagtaggtactgcttggatcactatcaccttggataaaagagagtgaagagagaaggaagttgaccctcacctaggtctgtttttaccctttgtattctttccatcaaaatccatctccagcagctccactgtagttagtaactccattgtgccttcctttcattctgtccttcaacttggcagaaatactcctgcttagagggaggataaggaagatgcatgccagcaatgtggacatgtcataattggtcaaagggaaaagtttcttgtagctgttgtcttgatttgaacaattggctacatgctagtgtgatttttactctttcactaaagtcactgatacccaagacttgtgtctgggtcaatttggctacagaaaaatcccaggatcattttatacttgtttataaggttacatacatttgaaaatcattgctgccttttctaattcactaacagtgtgccaaagcacttgcttttctgagtcatcttcatttaaggttgagcccattacttttcaaatcatatccatcaatttgcaaactctgtgaactccaacattactggcacaccaaaacccactttatcttaatacttaaaaattccagttcatgttgcttggataactttgaatgaaagacgttgtcttgtttcatgttacagtgaaagagcttatctcatattatagtgaaataatactgacaatgaatgaagattaagctgattccacacattacagaaaatacacaaaactgcacaaaaatttttctcaaatggttttgcaaggagagaggataaaataagtgccagaaagcagtttgccaatatcatttgtcattctgtgttcttgtgatattcatatgtaaaatacatgcagtttgtaaggaaataatgggttatattcctatgagttctaatttagaaaattaaatacattgaattataagaagcatttcatgaataatttgaacatttttgaaaattaggaaacatatttatacagtgaccatttgaatgatcagaaagtataagaagaaatgaattgtggaaaatgaagtggtaattaagaacatattggtttctggccaaacactgtagatttgagctattattattttggcttaagttgggtctaatctaagtagtagcattctgacctcaggaatagatcagctaatctcattcccaaaacttaaaattgaacgtgtatagaattaggactcttgcattgttaatgatctgcagttatttactgttctttgtatctctgaccctgacctgtcttagtctaatgtgaatcagctcattgtagttgcatccactggcccttatctatctatctgtctgtctttctttctttctttgtttctttctttttttttttttttaacagagatagctttatgtataaatagccattagtgtggaaggtatcacatgaggttgttgcttcccattcttaggtcatcaaagccttgcagagggttgatggtatggttggtatgctgatggatggtctgaaagagctgaacttgcacagatgcctgaacctcatccttatttcagatcatggtaatctgaatttgcattatttactcttcaggataaagggctgaagaaagtttacttgatggtttcccaattttttctgaatgttgtagttaattcttttttaaaaatgtagtttcttatggacagtctttaggaaaaaaatacattaaatataaaatataagtgaaacacagaattcacagaaacctaagtgcctatcaagcacaatacaccaagaatttgaatagctaaaaaatatatattttcaacattaaatttgtgtaactctacaattttagatttagttggaactgattattatagcttcaatttcctttttttgttgttgtttttgagacagtctcattctgttagccaggctggagtgcagtagcatgatcacagctcactgcagcctcaacttcctgggctcaagtgattctcctacctcagcctcctgagtagctggaactactggcatgtgccaccacacctggctaattaaaaaaaattttttttggtagacatgggatcttgctatgttgagcaggctggtctcaaactcttgctctcaagctcccactgctgccttccaaagtagtgggattacaggcattagccatcgtgcccagccttcaattttctttagcttgataaatctgactttagaagcatgatatattaattttgataatattttcacttttacttactgtgatctttgtaacacgcttgtgtacagtttggggactataggagcagcgtgcctatggaaaatagaaaataggttctttttgtttttgttcttgttttttgcttcagaaataattatagaaatctgtgtttagaagcagtcctaagaagttacatgcaaagaagtaccagtcttggaatgagagtgaatcatacacatacactcccagttaatatcctaggtggtttggggcaaataactgggctttcacattcggtctaaaaatgtgataagacattcttctttgctcacataatgatattgtaatatataaataagaagaaacattaaccaaaatttgggtgacggaaaagattttgaaaaaagtgaagtgataggtacagctgaaattctgtcttacctatcagatcttcaactaatatgagtgctacacccatgtttaacgaatttaaccttggaagtgaaagaagttctgctctgcatattaaattttttgttaaagttacagcatgttttgggattttttttttctcctaggcatggaacaaggcagttgtaagaaatacatatatctgaataaatatttgggggatgttaaaaatattaaagttatctatggacctgcagctcgattgagaccctctgatgtcccagataaatactattcatgtaagtatatctctgtgataactttgaatatggtcatattaagaataccttcctttaggccgggcacagtggctcatgcctgtaatcgcagcactttgggaggccaaagtgggtggatcacctgaggtcaggagttcgagaccagcctggccaacatggtgaaaccctaaaaatacatatacgatactatactatatctatactaaaaatacaaaaattagcctggcttggtggcagctgcctgtaatcccagctgctctggaggctgaggtacaagaatcgcttgaacccaggaggcggaggttacagtgagctaagatcatgccactgtactccagcctgggcaactgagtgagacttggtctaaaaaaaaaaaaaaaaaaaaaagaataccttcctttaaatcattatatcgctaaactaaagggaatcacagttaatttttttatgattaaatctccaatgcagagcttttgtacacaaatggattttatgggactggatgcgagaacacaacttacctattggttattcatggactaagcataatatttgatgagcttagtgcaattttatgttgaagtgtgtgttttacttgtgtgtcaggataaagattatactagaaaaaatgtttaagagagaaatccaactacatttattcaagtttaattaattaatgacactccattaaaattacttagtttgggattaatattctgttgtgaggaggagtgctggcagaaatgattaattctataggcaattgattcctgtcctcccttaaaccatttcagaaacaataaagaatgtatcttttacatagggaagaatgaatttcacatctcttgaccacatgtggaacataaactgccaaaagatgttttaaaatatttattcttttgccagtcaagtgtatttcataactgtttccacctctgttacctccctctctttttgattaccatccatgataactttcagatgtgtagagcaaattttgtttgtctttttgatatgatatagttagttaactttgaaacagaaagagaataagcttttctgacaattaccggaattgggttaggttggtctatttggtaagatatgtttcaatagatagatactattgactattaatgaagaaaatagatttcactgcaggaaaatggttatgcagatagatttacacagtgtcacaaagcacaggctgcatatgcctaataccaagttttaattcgtatttttttaatttagaaaagtagtacatgactgttataaaacctgttataaaaactatacagatagactggacacgatggtggctcacgcctgttattccagcactttgggaggccgaggcgggcggatcataaggttaagagatcaagaccatcctggccaacgtggtgaaacccgtctctatgaaaaatacaaaaattatctgagcgtggtggcatgtgcctgcaatctcagctactgggaaggctgaggcaggagaattgcttgaacctgggaggcagaggttgcagtgagctgagattgcgccactgcactccagcctggtgacagagagagactccatctaaaaaaaaaaagctctacaggcaatagcagtctccagagatgtttgggatgggatagctaagctgtaccatacccttatcttaggccctcaagtttcccaaattaaagcaaaaactatatatgtatgtcactttacataaatatataaaatatatgtatataaaatgtatactcttatctggataattttctcaaatttatgtaatgtttggctaaaataaaatctaggaagctagacagttattgatttgtagtagaaagtaccctatgtaaatccatgggcatactatgcaaatgcagtttttaaactagtctacttgccttctctttgaagtttcctcatacccctcttatttgaaaattctagaactatcattgaatattgaagtatacaaagtaaaaagaaacagcttcccacctgaagtcctcctacttgacaactcatttcccctctctagaaacaaccgttgttaagcttggattatgtcttcctggataattgagatatttgaataattatttttgttgttgagtatttcctagggaacaagatgtacaaaacagccttacaaaacacatacagtttttatttttacccagtgaaaccataccagatctagatggatagatattttgagggatggatggatgatggatattggttactaactggatggaaagatggttggacaggtggatggatagttaggtggatgaatggatatgtgggttaagagatggatggataggtagatgttctgtaacttgtctttccctttaacaatatgacactatatcatgggtgtcattacagggtgatccctaaaggtctgtctaattcctttcagtggctacaatgtaatgacttaaatgaactctttaaaacctgccttggtatttaaatgcagagtttggatctgacattctatatttttgtattatgttttaattatagtatacaatcaactattaattcttatgtttgttcccctccagttaactatgaaggcattgcccgaaatctttctgtgagtatctttattttccattatctagttatttttacttttgtataatatatattgagagaaaagtttcagcatctattattgggattgaaggattagaatattttagtaatctgggccaacatggaaatgctgtgtagtttaaagatctttaaggtcgtatcccaataatccaggtttgaaaaatttttaagaatttgtctattggcattataaaatttatatgagaagaagaaataattttaaaactatttacaagaaataatttttaaagtagaaggaaaaaccctgtagctgtaccaccataaacaccattagcgttatgatatatttccttccagtctttttttatgccttaaaaaattaagtttctgtactagtgctgagttatctatactacattttatactcatacattttaagtctgcaagaaaactcttacaattgcacttacaaggatgtttgaaaatagaaccattagtggtaacttgaatataatctagtgacactgagttctggggcttttatgcagtaataattatgatttcctctaaatatttcaagtagtttggaagatttaccttgtacattatataagtggtttatttagctgttttttcatctgacttattgggccagctgatgaaatgtttgtgaaaaaaaatttcatatgaagttagaaagcaatttcaagaaaagttgacactttttatagatattagggaaatatctttccctaataaatatctttccctaaaaaagttgacacttttttagatattagggaaataatagtttttctttgctgtttgcaatttcagtgccgggaaccaaaccagcacttcaaaccttacctgaaacatttcttacctaagcgtttgcactttgctaagagtgatagaattgagcccttgacattctatttggaccctcagtggcaacttgcattgtaagttctgacagtctcccaggtaaacttagtctgatcggttagtgattcagggtaaccattgggccctttctaacaatattgttatgtgaaaactgtataagtatgattctcttcactctaacccaggatttctaatgtcggcctatggatgtttgagttagataattctttgttgtggagagctgtcctgcacattgtgggatatttgacaaggatcctttacttctccccactagatgaaagtagcacttcttctgtaatgtgacaaccaaaaatgtccgtcagcgttgccaaaagtcccatggggaggaaggatcacccagaccatccttggctaagaaccattgttctggcttttcatatacatattgattacttcttacaatctacatttgttactgcttgccattgcatgtctcctgcacattacagtatgtctaattgtgcctccaaagcctagccaacagttggtaaaagcactttataataatgagtaactatcttcattatacacgttgttttttcattcttcttatactaatccatcaataaactttagtttattggtgtgtttggcaaattatttggatggttaatagtgttaatatctcacaacttgttcattaactgttttggtggttgccaagaagctagtcatgatacatacccctgtcaagcaaaacctaagcagtgaaccaaaattcagtaaacagaattatactgtctccactcttattggagagctgggcttttagttttcaaaaaatatatatatatatgaaaggagaaatggtcctatcttcatgagagaactaatatttagtaaatatctaaacaccatgttgcaagcatttctttaggctatatcattgaatttttacaaataaccgacatgagaaattgaaatcaaagaagacagttaaatctatctaaactcacaagtagttaatcacacagccaatgttcaaaaccacttctgtcttgatgctagtggtttttcttctgtctactatattgcttatagttaatttgtccatgaaataaaagatagaggtgacttcttaatgcttttcaaagccaggtggttttatttaccgttgtgttggtttaacaaaatagttacatactttttaatcaatgaaaataatgttatgattatcaattatgttttatgaaaggactttacatttttaattcatatatgtcaacattaggaatccctcagaaaggaaatattgtggaagtggatttcatggctctgacaatgtattttcaaatatgcaagtgagtaaacctattatacttaattggattaaatctaaagaaaaaatgatatgcaaagttttagacttgaaaacatactgtgattatatgtcttgaatgagaattaatggaacatactttcataaagctatttttctttgaacattaaagaattttgttaaagttttatattcattggctattactaaaaagtcaaaaaacaacagatgtagtaaggatgtggagaaaagggaacacttatacactgtcaaagggaatgtaaattagtacaacctctatggatcactgtatagagatttctcaaagaaataaaaatgaaactacccctaatctagcaatcccactactgggtatctacccaaaggaaaaaaaataatcagtttatcaaagacacctgcactcgtatgtttatcgcagcactattcacagaagtagtcatggaatcaacctaaatatttataaatggatgattggattaaaaatgtgtgagatatatatatatatacacacacacacacacataccatgaaatactactcagccataaaaaggaatgaaatcatgtcctttgcagcaacatggatggaattgggggccattatccttagtgaaataactcaaacaaaaagctaaaaatcacatgttcacttgtaagtggtagctaaacagtaggcaaacacggacatacagagtggaataataaacattggagactccccaaaggtgggagggcaggaggagtgtgagggatgaaataccacttattgggtacaatgtacactattctggtgatgggtaacactaaaagctcagacttcaccactgtgcaatatatccatgtaacataactgtactcatacccctaaattcataaagttaaaaaattaataaaattttatattcatgtttcataaacatatgacatatctcctattatatttctaataattatttttcaaatttttgtgctctgttgagagtattgctttacagttgaagaaaaccagtgctataatagataagaaagtatcagacttatgttctgagaaggataatatcttacatttacccagcactttaacattttcaaaataaacttacaataattatttaatttgatccctgcatcactgtgtaaggtgggcaggatgaggtttatattgcatgtcatagatgaaaaaaaaatgttatcattcattctgttctgattgtcaaaccaagaattgtagtaaaactaagagacctatcctagatgtccttagattatgtgtgtgatagggttaaaactatatttcccacaaagtccactgagcgtggtagttttcctcttatcttatcataaccagtttgtatatgtacaatgtggataacagaatttttgggaccaacttgtagacagctgaaatgcactgataaacttccttttctggccatctaggccctctttgttggctatggacctggattcaagcatggcattgaggctgacacctttgaaaacattgaagtctataacttaatgtgtggtaagtgtgaacaggtgccttttttcccttctgaaaatagacctgaaataggattatcaaaagcaggtcacattgtaggcaactttgtggagatgatggtgaggcaagacagatttttaccttcttcctgactctcagactcactgaagaaatgtggggaacatgtcatcttattacttatctgtttgttccactaggctgcttgctggttaaagtacaccactcacagcagggtggtctgcacacccccactgcccagcactttgctaggccctcggcttagtgatttgattcttgactcagagcagtgatagaagccagaaaaaggagattgagggcagtgaaaggtggacaaaacttttggaacttctggtagccataatggttgaatataggtcagtgtcaaggttgcagaaatgaaggaggacccattagggagattcttggtttactttgtaccttctgaagtagtccttttgtgttgaagcattgtgtgttttaaatattagtttcttattctgataatggtcctaggcatctgcaaaaccttaaatatgtcttaagtataattcttttagtgggagtctatatagtttaaatgagttaatgtatcctaaaatacttaaaacagcagctggcatatagtaagtgcttactacataagtatttgctgttattacatttaagagcatgagtcttagactcagacaaagctggttttgaattctagatcatttagttagtaactttgagacttgggtaaaacactttgattactcatctaccaaatattgatgataacttataaaattgttttggggaataaataagaaaatatgttagtaccatgattggcaaaaatatgcattcaacaggttgtgactgtagttattgtatgctttaaatatcagaaattttgtagtgaaatacagcatacatatcagtatttctattaaaaataacctagtcttaaatactctaaaacccaagagagttttatacttttattttagttaaagagtaaatgactcatgtatttggttttaaaaaagtaaagatcatggcacaagtctactatttgtttgatttgaaacatctaagtaactctaccatcttgaaattatgcagatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcggtaagtatcgtcaagaagtttggtccagtatgtatggtttgatagcaccctctgcatagcatgtgctgtaaaaatacttaataatcaaattagaatttaggagtgggggtaggtaaacatatgttttaattctagggggcgcatgtagatcttttgtgatatatcttttctctttctagtttttgcattttccactctatttttaattccttggagctgtgacttgacttgggtgcaggtgtggtgaagtctagttagttgacttgggtacgggtgtggagaagtctagttcagttcttgagcatcctgaattagggaatctgtgctgttaactctagcagtgaggtgatgagcacatagtaaaccaatcacaatgtacctttttaaaaatacaattcagattgtttaaatgtagggagaaaaaagatttcttggtatgaaatgaatatattacactgtccttttttacttccatgttaatatgtcattattataaaaagataaaaatactagacaagttatgaacaaaattgataacatccatgagggcacctgtaatcccagctacttgggaggctgaggcaggagaattgtttgaacctgggaggcggaggttgcagtgagccaagatcacaccatcgcattccagcctgggcaacagggcaagaccctttctcaaaaaaaaaaaaaaaaaaaaaaaaaaaaatatatatatatatatatatatatatatatatagcaatttggagagtagtttatttcatgctttacattttgttttagacttgagttagaatagaagaaagactgttggggtatatagatgagaattataaagcagcaatcatattcttattttttaattactggtgtgatgcttatactaacaattttgtcttttgcaactgtcattcctctccttctgtccttttcatcaaaaatgtaacttctgtccaggcatggtgtaccacacctgtaatcccagtactttgggaggccgaggtgagaggattgcttgagaccaggagttcaagaccagactgggcaacatagtgagaccctgtctgtacaaaaaactaaaaaaattagctgggcatggtgacatatgcctggagtcccatttacttgggagcctgaggtgggaggattgcttgagcccagtaggccaaggctgcactgagtcatgattgcaccactgcacaccagcctgggtgaaagagcaacactcttgccttgaaagagaaaaaaaaatccactaatacaagactatcataaatgatctttgttctatgttggaataatcaatctatagcggttctatgttacaaaatttaaaacatgtctctcagtccttaaaaatagttttataaccttttttagattttgccgattgaggattttcaaacacagttcaatctgactgtggcagaaggtaaggcatgctacacactcaagctcggaatgtgaagcaggcattttctcatcagtgtgaaatgcagagaactggcttgggggtattatttgagaataaccaataaaataaagggagttctggaggaccacctgatgaaacatagaggtttctttgcttgacagtttagactattaggcataaggaaaggagatattttgcagtggatattgtatgtaatgtatttagtggaagctgaatcacaccttgtgaacatgatggaggtgttcaaaaatttttgatgatttctgtaagttgataatagagactgagattcccatttgaaatacctaagtttctatctcacctggttcttaatcatacaaggttatatattgatttattgatctaaagttatttctgcatcacttttgaccaaaaatcaaggatacacagacaactgatgaaatttttcacttatgacttgaatgtttggagtcactataatacactctctcagccttaagttacttggcacacattttttttctactagaataaagaggtaaattctgcattagttctgatgtaagtttgtctctataaaatccctaggtaaatgctggagttaggaaaatctttgatatctccaaggtggcaaagtattgtggtgaatgatggcactttcagaattgagtagatccaagtttgaatatgagcttaggtactatatgttcatggaaatagtattccctgtcagctgctgtttccttatctgtaaaatgggcatataaccttaattcatagggaaatgtaaaaattagttatatgatgtgtaccaagcccttgacatttggaaaaagggcaataaataatatctatattgttattgttttatttagtttagtctcataatttcaattctgaacttctgctttccaagtacacatatcattaaaaaaatttgctttctggagtgtgtcctaaagaataagtaattaaaatagtgcttaagaatttttggtaatataactttgaattaactggaatatttagcaatttcatatagtgtcctcatggtatcttgatattacattgatttcagaatctttataggcaaaaataacagtgaacctcacttgtcttcttaattgtttatgcttctaccctttgtaatcagtttttttaatagttaaaagtaaatcttcaatataattaagtagaggaaaggattagatgagtgtatcacactatatattatcatataatgcacactaactacatttattttcatcctgtgacccaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgcaagtatttgtcacctctttatgtgtggccatttcaaattaatgattaagcagaacattaaatgcatagtttctcactgttcaccttggctttatactcagttcccgcattagaggaacactgaagagggagtcagaaaaattcagttccagttcaagctctgccactgagcagctgcatgactttgagaactcagaccaaatttcttctgtgaaatgagggtcgtgcagtaaagattctcttttgggctgtgcgcagtggctcatgcctgtaatctcagcactttgggaggccgaggcgggcagatcacgaggtcaggagatcgagaccatcctggctaacacggtgaaactccatctctactaaaaatataaaaaaattagccgggcgtggtggcgggcgcctgtagtcccagctactcaggaggctgaggcaggagaatggtgtgaacccgggaggtggtggagcttgcagtgagccaagatggcgccactgtactctagcctgggtgacagagtgagactccatctcaaaaaaaaaaaagaaagaaagaaagaaaagaattctcttttcctccccgaccccagttttaatattttatgattccaatttataattgcatgaaatcagccttaggatcagtcacagttacccatttctaaatacatggctgtgtgaggacaagtatttccctcagctgtccaaatctaagggggccctcactgtttggcaaagccattaaagctcagtaacatcattgcacgtaccatctataggaagacacgagcccaaaccagggagaggccagaatcctgcccaccaccaacaccagaggagttaggccttgaaaggagtgagggcaaatatcccagaataagagcagccttccccctcacccatggccccctgggtgctctggtagaaggaggaatggtgaaggagatggtgctggaaagagagaagggggaagatgagattttgatcttacgtggaattgaaattttaaactgggctgaaactgaaagtgactggcaaggtacaggatgccctaagggaacgacaaagggatttgagagagcatagtggagggcagcagtttgatttaaaaaataaaatgatttttactaatcagtgagacaaccaaataaaaagatagggatatgtctgtttatatataatttctatgttacaaatatataatacacacatatatttatataaaatttcttgaactttgatttttaaaatttttcaatactgtcttcaaacaccaaacacttaaaaaaatttttgactttgtaattgatcagtctacaccatttttcataggcaccccatcctatttattaatatttataccttaattatgggttccttgattccattttcagttttcttatgtaattaaaatgcataactttacagtcattgcgatgcttgaggtttttacattgctgttcggtgactgtcctcctttgctccagcaacttttggcagtgtagttgactatggaagatagactcagatctctaaaaatcaacattttactatataaaagcttaaaattgaccagcgcggtggctcacgcctgtaatcccaacactttggggggctgaggagggcagatcacgaggtcaggagttcgagaccatcctggctaacatggtgaaaccctgtctctactaaaaatacaaaaaattagccaggcgtggtgggtcacacctgtaatcccagcactttgagggggctgcagcggatggagcacctgaggtcaggagctcaagaccagccttgccaacatggtgaaaccccatctctaccaaaaacacaaaaattagccaggcgtggtggcagatgcctgtagtcccagctactcgggaagctgaggcaggagaatcgcttgaacctggggggcagagttgcggtgagccgagattgcgccactgccctctagtctgggtgacagagtgagactccatcttaaaaaaataataataataaataaataaataaataaataaatatttaaaattgtgtagataaaatcattctaaacattatttcatattagcatagcagaatctgaaaatatttgcataaatatgacaattaatatctttaatattgtaaagcatttttacactttagttagaaaaaaagatgaatatactagtaggaaaatagggaaggacatgagctgacagctagagcttcataattttatgatgtagttcacctttaaatattaataaagcaattttcttctctgtgcctgatatctgagagttcttctcattttcgttcttcaggacagtttctctacggaagacttctccaactgtctgtaccaggactttagaattcctcttagtcctgtccataaatgttcattttataaaaataacaccaaagtgagttacgggttcctctccccaccacgtaagttttttcctctcctgaccttcccttttctcctttttgttttctttcttgtttataaatcctaccatacattatagggtaatatatatattacctattatatatatataaatattacctattttatatattatatatataatatatataaagtatatatattactattatatatatatagctatatatatatagctttgtttatttattggtgaaaaattgtggatttggtctagaactaccaagggaaaaattttaatcatctaaaacttgaattttataaaattttctttttgttgggagggtagttgatgtagtgcagatatggtaagcagaacacttcatggttcctttctgcatttcttttaaacaatttgagaatattgtgaaggtggaatatatatatcaagttggaagaatatatcaaggttcttaggaagataactttgttaggataaataactttcttgtttaaaaagaaaatgcgtttgtcagagaagtaggtaaaggtagaggcttacatatgcttgctttttcactgatccagaatctctagggaatggcttttttgaagctaagtattctattttttgaaatggcaaatttgtatgttgatgagaagccattttggggccagccttaaaaggcaaaaatcagaaagctccaggtgctcaactaccgtcagcatccagttcagttcccagagtatgtgtctgaagtcagaacttggctattgcattataaaaatagaccaggtccaagcctcaaattcatacagagaagccttgtatggtgtttcgagacagacatcctgtgatgttttttctgggtagcaggtgttgttctggagccagatgttctcttttttcttttcactgtgaaaaagtgtaaggaaagaagattgtcaacacaattccttttagttgaaatgagggcaataacgtttgaatatgtttaatttggggctcttgttattaaagtttatgtttcgttgacatgctcatcttgaaaagacttcttaaatattttatttttgtaaaggacttgaccaaacacattacattttcccttgaccctgtacttgggaaagttttacaggtttaagatggtactcagctaatttttaaaaatgctcccctaaccatgagaaactataatttcctatgttatttgtgaagaatgaaaaagttgtcctcttttctctttgtagaactaaataaaaattcaagtggaatatattctgaagctttgcttactacaaatatagtgccaatgtaccagagttttcaaggtaaataatgttaactctatatttgataattttaatgaatttgtgcacatataggcataattcatatgtaataggacttatggtctaaattaaatgaattaataccaaatacattcttaaaggtttaactttgagaatactagtacacaaaaattctacaaattattagaattatcatgtattctaattgtataattgtttgcaaacagttttggtgagaaagtatgtgatgcgcttcctaaagttatccagctaatacagtctgctaacacttatattaactttcattcggcttccttatttaactttttggaagttcttgataattgtctatgttttcaaatgaatagattttacatcatcattaactattgcagcatttgacttttacaggaataaaaatttagttacttaaattgatgtatagaatatcaaaatataagcatataaggagtttttagtctaatttatatctagaatacttgtgaatatttcaaagttaatattcagatattaataggaaatcggaataatatgccttgtttgtgtttgcgatgttgctatgcttaatgatgacatatgatcacaatttcaacatgatgtacttgttcagggatgtctcaaagagagttgggttcaacgtttgtctgtgagtcctttcaaaggccaaagctgaacaatgaatttttggcctcacactaagattagagccaaggctgggtgtggtggctcatgcttgcagtcccagccctttggggagtccaactcagaaggactgcttgaggccaggagttcaagatcagcctgggaaacagtgagatctggtgtctagtctctacaaaaaattttaattagctgggcatggtgatgtgcacctgtagtcctagctattctggagactgaggcaggagcatctcttgaccccaggagtttgaggctgcagtgagctatgattgtgccactgcactccagcctgggtgatatagcacgactctgtctctaaacaaaaaacaaaacaaaacgaagactgaagccaaacttgactttatctttatttactataaatgctaattttgaatcatggtgttaatttatttcacacgtcaacatggtcccttgttcttttgaaactacactggcttctatcttgtttcagttatatggcgctactttcatgacaccctactgcgaaagtatgctgaagaaagaaatggtgtcaatgtcgtcagtggtcctgtgtttgactttgattatgatggacgttgtgattccttagagaatctgaggcagtaagaacatatttcattactcttaaaaataggaattaccatccagtagaaatgggattaccatccagttgagtcaacagaaccttttttatccagtgtcgtatgtttatgtgtatgacacttctgactacacaggaagcctcttgaaatatctgattaattttgatgttttgctcaatgttcagtaaaatatttttaggtaaaaaagtagtgtttctcacccattcagttcagttgaataatttttgcactcagtttaaatgctgaactcatttaagatctctgtgtggctgattgttaagatatgatcttaatatattgtgagtcagaagatgaagaactctatggtgtggctacagatatcctgagtctaggaatgaatagggttataaagctgcagtgcttggagtctggtggccttgggtgaatgttatggcttttacccaactgtggctggaggggcatgataaaaagcaaccgtctgaaggaaaccatcagtggtgcttttttaaaaaagagagggaaagaacatcttggaaactggttgatctttattgaaacaataattacagcagtttgggaagcaattttgctgttaagtccgtaggaaaaagactgagattccactgagattcagcccctctcagaactttcctactctcccaggctgacttagatatatgtgacttacaaaatacatcagaaagcacatcaatttgcaaagttacagttttttactttcccttgaggcataaagctgccttagaagctgtagcactggagaggatacagaagagaactgcatatgcttcctacccacggcttcacccagagccctctgtttaaatctgttttatagattatgtttctacataaggtcatatttgaaaacaatgattccactgccttaaattttgaaagatgttgaaaaaacaaacacagccttaaaataggagaatgactatgaggtaaagatgtttgggacatctttgataatatacttcagtttaaaaaattaagttattaaggaagaaaatccagttagaacaaacaattcatgacaacatgtcctctctgaaggggctggaatagaaaattcctaaccagttctttctctgcccactatttgtctataatcgcctagaagttaagactatcaataatggtttacactcttggtcataggtgttcaaaaatgacattttcttttctttagtgtttcaatttcaatgtctttaggtagaactaaaagaattctaaaagtcaataaacttctacagaaaataaaaattatttggagtgtgtttatctgcctgtcttctaattattgctctcaatctggcagagtatgttgaggtattgtgattactagcttcttatatttaattatttgtttgaatttgatttttatatgtattaaaagcatgctctactgaaatattcatcaaaaggaagatagttatttctttcttaaaatgaatattggcatgttttacagaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtggtaagtagcttttgtatatttactttgcatgttgaaaatctagacatatgcatatttgtttatgtcacccatctgacattacagtgagagaaagcacaactctgagtacacatggacttcgaaattataggatgcttttaaatttgatcttttaagatgacatatctttggggaagactacccttgtctgcttttacttttttcttttttttttttttttttttagagatagggtctttctatgttgcccaggctggtcttgaactcctggcctcttatgatcctcctgtcttggcctcccaaagtgctgagattgcaggtgtgagccaccctgcctggcccctttgtctggtaaagatactaaaaatcagatcagaatcaaactttgtatggcttaaccactaaagtctaggtttatctgaagtatggattttctctttttttaaaactggatgtataatttcaaagtgtcagcactgttataaattaaagttgttagacaacatttcaaattttctgtgtatcacttaattataaaaaatcttttcctttcttatcgtattgtcatcccagtgtgtttgggaataattggtttatattatcttatttgctcagaattttaaaaatctacattgtagattgggacatcaagactgcataacattttagcaattatttttttttttttttgagacagagtctcactttggctcccaggctggagtgcagtggcatgatctcggctcaccgcaagctccgccttctgggttcacaccattctcctgcctcagcctcccgagtagctgggactacaggcgcccgccaccacacccagctaatttttttttttttttttgagacagagtctcactttggcttccaggctggagtgcagtggcatgatctcggctcactgcaagctccgccttctgggctcacgccattctcctgcctcagcctcccgagtagctgggactacaggcgcccgccaccacacccggctaatttttttttttttttttttttagtagagatggggtttcaccgtgttagccaggatggtctcaatctcctgaccttgtgatccacccgccttgtccttccaaaatgctgggattacaggcgtgagccaccgtgcctggcctttttttttttttttttttggagtcttgctctgtcacccaggctggaaggcagtggcgtgatctcggctccctgcaacctccgcttcccgggctcaagcgattctcctgcctcagcctcccgaatagctgggattacaggcacctgccacccatgcccagctaatttttgtatttttagtggagatggggtttcgccgtgttggccaggctgttctctacctcctgacctcaggtgatctgctggccttagcctcccaaagtgcgggggttacagtcatgagccactgtgcccggcccattttagcaatttttaagttttctcttatggtgagccaaaatatatttctttcagagtacttcctacatttccttttttttttttttttcattgaagtgacaccaagtaagtctaaacctgaatctgcaaaaagatgtagctttcataccagtcccaatgaatgggtggtaggtacctggagttaggatcttgagacccagtatgagctcagcaggaaagagtgctgtatccactcattcattcactactactttgattcaccattcattcctttgatatttataatcaggtgctctaggtactgaggacacagcagtgaacaaaatagtgagctcttctctgggcccaagagtagaatacaatgatccgtttgccatccctgatggtagtagtctttctatatatcgttaaaattcatgaagatatgtctctccttaattgtttctatgataaactttcagaattacttgttcctatagaacacatttctcattatttttccctttattctttagaattaaatacagaatagcaagattttagttggttgcctgatgattatctgactccactgaaagttgtcagttttgtgggcattgttggaaacatgcagctattccctgcttcattatttcgtttgagagattatattgtcattgaatgtatcaattagagtagggttctgcagcaaataacagaaacccctttgcagtggcttaagcaagtcagggattcctcatggaacagcaagtccagctgcacacagtcctgggatggcgctttgggtcaactgcaccattagggacccagaacttttccctctttctgctccaccattcttagcatgtggctttggcccacgtgggcttcttcatgcatctttgtaggtaacacattctcataaaaactagtatttgtgtagtacatttgcacacatcattacgtttgatcctcaaaataacccgatgaggaggatacagataaaggaatcaagacttatatgttaaataactttccttagtttacctgatacgattgtcacagaaccagcctcttttaaaaaaattttcaacttttaagttcaggggtacatgtgcaggatgtgcaggtttgttgcataggtaaatgtgtgccatggtggtttgctatatggatcatcccatcacccaggtattaagcccagcatccattagctattctttctgatgctctccttccttccaccccctgccctccaacaggccccagtgtattttgttcccccacacgtgtttatgtgttctcatccttcagctccctcttataattgagaacatgagggttcgcttttctgtttctgcattagtttgctaaggataatggcctccagctccatccacgtccctgcacaggacatgatcttttatggctgcatagtattccatggtatacatgtaccacattttcttaatttagtctatcattgaccatatacaccatagtattccatggtgtgtatgtaccacattttcttgatccagtctatcattgttgggcacttaagttgattccatgtctctcctattgtgaatagtgctgcactgaacatatgcgtgcgtgtatctgtataatagaatgatttatattcctgtgggtatgtacccagtaatgggattgctgggtccagtggtatttctgcctctaggtctttgaggaattgccacactgtcttccacagtggttgcactaatttacactcccaccaacagtgtaaaagcattcctttttctccacaaccttactagctagcgtctgttgttttttgactttttaataatacgcattctgagtgattctttacattattcagatattctttcccatgccatgtaatttctgttttccccctttttttaaccccacgccattgaagtttcttaaacctatgtaatgcaggaccatctgttccaggtatagtttcttttccccaaacttgaagcatctaattaaacaaacatgcatggtatgtattagaaggaaagctactcaagaggagagatgatgcctaacaaatcatgtggcacgttccacttcagagctgaaatctcgtaaatgattaaactggggagatggagcacttatagaagtgaactgagtgttctcttggtaacttttcttttatatttcctattctcctagcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtgactatctttatgagaattttaaagtggttctggatatcttttaacttggagtttcatttcttttcattgtaatcaaaaaaaaaattaacagaagccaaaatacttctgagaccttgtttcaatctttgctgtatatcccctcaaaatccaagttattaatcttatgtgttttctttttaattttttgattggatttctttagatttaatggttcaaatgagttcaactttgagggacgatctttgaatatacttacctattataaaatcttactttgtatttgtatttaaaaaagaaaaatattcctatcctgctcactggtaattaacataggtttaaaatggcttcaaatgtggccctatagacggttaaaattgtaccttatcttggcaaaacttcagagcaccagtcagtgcatgcaaggtgccattttttattgagatgcttagaatgtttctttctgtgcacaagacttaccctaccagcagcagagccattctctgttgagtggttcattttgaagttccacagattgaagagaacatgccaccaatcacctcacatcttcttggtggacatgataaatgacacaatgaacttgatttctttactaccttgactgtagctttttgtccctacctgtgaaccttcaaagactgcattaacttttaggctacataggtccaattgaggtataatatcagtacaccaaagatttttatatgtccttcgtgtgaccattctttaacggcctaagggccagctgcaaagacttttggaaaatacaatttacaactcaaaattatttaataatttaggaagttgctttttttttttttttttttcagtcctgcagtttcctgaagctctgtatatgatatttttttcagcctgcttctctctgttgttcagattaggtaattttattcttctgtctcgaagctcactgattctttattctgtctaatctgttctgctgttgagcccatttattcctgatttttatattttagttattgtatgttttatttctaaaatttccattcagtttttctttatatcttctatttgctgagaatttctgtctctttgctgagactttctacgttttcatttgtttcaagtgcatttatacttgcttgttgaagaatttttatgatggctgctgtaaaatccttatcagataattccaacatctgtcacctcattgtttgcatctactgatggtcttttttccattcggaaacattttcctgtttcttggtgtgtggaatgattttttattgaaacctggatatttttaggtattatgttatgagactatgggtcttatttaaaccttctgctttagccaactttctcagataccaccacagcaggggaattgggagcactgcttcattattaccaggtgtggctaggagtccaggttccccagtcagcctccctttatactgagtaacagggtcccctcattactactgggcaaggtgagaattcagtttcccattaggtctttattgattcttccctggctggaatgtgcagcggcaccttttgctgcaccctgggaatctccactaatgctatgggacagagtgaccaggaagagcttcattacaccaggtgggaatgaaattcccagtagcctacacagccttctccgacaccactctggagttgtattcttccagcacacaaacatacacaatttaactcaaagcatcttagcagagcttaattaaatggatagatgcctgttccctttgctggataccaagaatacaaaagtcagggagttggggcacctctttacagcttggtgagagtgtaagtctggactccccactcagcatttgctggtatgggtggggccatggtgtttttccatggtgtttggttggagtacagccttttttacccttgcttggctacccttttctggtcctttggcaggagagagcaggactctcttagggcttttttttcccctgcatttattgacatttccaggttgctgactttttcagctccaagttggaaatatatgagctgaaaagaaaatgtagggaactcatcacagtgttgttacttgggccccaatgttcctagcctattttctgtctactattcagagtcttgctgtgttttaatataatatccaggatttttatatgcatttagcagaaggatgtctactctgcctttgtagaagtgtctcactgatttttacatatttttccagcacacaaacatacacaatttaactcaaagcatcttagcagagc

SEQ ID NO: 13431 - DNA, 12042 bp, Human
atgcttaactgggcataaggacatattccaaaataaaaaaaaatgtaaatcagaaacacttctggtcctatttcaaataagggatactcaacctgtataaaatatccagtgtgtataaatgaagcatatgttaagccctaggaggagctctgcctgtttgagttttaccaaaaataaggtaatattttatggttttttttttttttttttttttttgagatgaggtcgctctgtcacccaggctggagtgcagtggtgccatcacagctcactgcagccttgacctcctaggctcaaatgatcctcccacctcagcccctcgagtagctgggaacacaggcatgcgccaccacacccggctaatttttgtatttttcatagagacagggttttgccatattgcccaggctagtcttgaactcttgggctcaagcgatttgcccaccttggcctcccagtgtgctgggattacaggcatgagccaccacacccagccaatatcttgcatttgaatcaagtagtggacatttattggatcccttggggccgatgccatttctaaaagtgattgagtaaatatcacaggtgggcaaatcaaagagaaggatattctggttgtttcaaggtccaggtaattcaggccatggcacaggtgatcctgagcttaggaagaactcacccatgcctcaggggcccagctgccctcctcccctcactgctggagcacctacaacagctgtgaagcatcttgtgcttttggagccttgacatgggaaggaacaggagaaagcaggactgatgtctccagaccaccccttaggcaaaccctctttggtagcatcttagacccaaatatttttttccttcacgtcacgttgcctgaattttttcaccttagtttgttgtactgccaaatattttatttggaataacaagtacctttgaaaaaaaaaaagcacatacaaacttcagctcccctttgaggcttagctccaacagcacctttcctttccttcttagaagtaagctttctgggtttgaattcctacagcacacattctgactcatagcatctgtgacttgttatttcacatttccatggatgcatctcatctgccttgctgcactgtaggcccttcggcttttatttttttttaattcttaatctttatgggtacatagcaggtatatatatttatggcatacgttagatgttttgacacaggtatgcaatgcctaataatcacatcatggaaaatggggtatccctcttctcatttatttgtgttacaaacaatccagttatacttttagttattttcaaacgtacaatgaaattattgactatagtcaccctgctgtgctgtcaaatacccggccttattcattcattataactatttttgtcacccattaactatccccacctccctcccaccctccctcactacctttcccagcctctggtaaccatccttctattctatatctctgtgggctcaattgttttgagttttagatcctgtggcccctttgaccatgcagatcatggcctattcatcttcacacctagataggagcctgcgcagtgcctggccaggagcaggcataagtgtgtgcaaatagaggaataaatagcagggcagcaactatgtctggaggtcattgtctttcctgtctcagtagtaatcaatcactgcttatcttcaaaaacccagagtaggggatggggcagttagtggggacagagggcagatgggtaagattcagagcacaggctagtgtgacggaagtttaaacttgtgagttaaatagggtttggcaatctagctggatagcatccctgccccttgaagagatgtttttgtggcgccacactactgacttaggcataatgcctagagatggattagaactgcacaatgaactagtggtgaggttcagtttaatggaaattggtgaaagcttttaggataaaatgataatctttgtttctttcaggaaaatggcagacaatttttcggtaagtgttttatgcctgtttcttccccttgatcagctccacatggttgagggttgggggttttgtttttaccatgactttcccttttcactctcccactgcgtggcttcccctggactcatttgtccaatgagggcttgcaagctggagccttgtttttccagcagcagatttgggaagaaagccaggcagagcgaggcctgggactcactcacagtaaccctttcaccaaaaggcccagggcggaagggagtggactctgccggcaggagctgagaaatcctctgagtagcgggaagtgcggtacagtctgggcattctgatgtttgtgattgtttttctcacggtgatgaaaaagtatgtgctataagtagaggagcgctaactcctgacttgagctaattatgaaaatgcagccctccctgatctgagacgttgggaggcaagaataaagtgaaaaagtatatgtaatcccaacatctaattttagtcttagaaactcaaactattaataagtggaaaaagtttaatgatatgcatgtaatgcctttgccatattcctctccttcttagatcacatattcctattttcctgaaaattctgcttttgagaatgctttctgtcccgtaattgtgtatgtctttctttccagctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactggtgagatggcattccttctttcatgtacttgacatgcagagggcttcagggagaccctgagctttaaagctgctgcttagagccacttctcaagggccagccatgggtgtatgttggtagagtcaaaaaattaagtgttcatattgagcttattgtgtgtggttagtataaacagaaggtaatgagtattttgaaggcactgataaaactgcttatgaatataaatcaagattgtagtaatggagaacattttggttattattaacacttacggagtacatgtcaatagtatgcatctacatggataatctcatttaaccccattaccacgctataagatactgttaataaccccatttcacacatggggaaatggggcaatagagaagtgatataatttgtccagggtcattgagcaaacatgtagaggaaccagggtaatctggttttgaaaaaccttctaaagataattttgtgatctaagggttgaattttcacgcaaattaaaatatgtcatagcaagtgaattctaagtgtaaaacataactccatgggggatccagatacatctcagccacaggatccttcctttccagatttataatctagttggatgataaaacatataataaatatgaggaaagagctaagtaccagtatgggattagaccatttcaggactatgcagaagacagcacaaggtagcattgtctccttttaggtcagtttagagtagaaagacttgggggagtgggtggcattgagagggcctataccagagatggttagtcagttgcagagagagggagacatgaaggctgtggaaaggaacaggcagatgtaagagagattacagaggaagaacccccagaatctactgattatgtcttaggagtcatagaggactctgacttttcaaggctgagcaactagagccatcagcaaagctttagcccaaactgggaactcatgaaggggaactgatgggggagggggtagggaagaccattctagttcacacttgttgaatttgaggcactagcagcaaatctaggtgggaggaagtacaggactagtacacaccaggactagaaagaaaatatttggataggctgggtgtggtggctcatgcctgtaatcccaccactgtgggaggctgaggcaggaggatcacttgagtccaagaggttgaggctgcagtgagctatgatcacaccactgcactccatcctcaacaactgagactcggatttttgagaccttgtctcaaaaaataaaaaggtttgggtgatagttaaacccagggggaagtcttaaaaagggaaagaaaagaggccataaataaatagagctttggggatattcacagtaccttgaatgtagttggtcaataaacatttgtggaatgaacctcacagtgttaacagtgttcattccataaatattgagtatctgccatatgcaaagcactctgctggagccatgtgagtacaaagcatatgagaacccacaagcccagaatgtgatatgctgcttgcccccaggaagcagaatatccacagtaaagcatgtaccatgacagggccttaagagtgatacaaaaatgttaatgttgatcacaagatctagcttaagcctttccaaaaatagtcaacatgaatgagtacaaattgggatggccgtagtaatgagatttactgatggctttcttttcaattatttgtacatctagggagccttatctctttggcccctgggcaaagtggcctgagagtctggacagatggcatatactagagttatgtgtttttcacacatattaatagtgatggaactttagcaacatcgttttttccccaaagaaacatgactccttattgacacatatgtacttgttaattcccagattgtgccttataacctgcctttgcctgggggagtggtgcctcgcatgctgataacaattctgggcacggtgaagcccaatgcaaacaggtaaggagagcaaaattaacaagtctactctatttgtagattggtttttgaataaagaatggcctactttttttcttcttgccctgtcttacagtgctattttgaattttagtaaaattttaaaaactacatatttagaatcttggctataccatcatataggattatcccataaatccatacatattcccatataattttgctaagcatcatggcactcatagtaaacggtaacacaccttattctatactttgatatgtattatgtcagctaatcttcatggctgaaggcaggataaggaatattgctctcccctttttatagacaaaactgaggttcaggttctacagatgatcagtggcaggcctgggaacccgtcttttgagcagatactatttgcttatgggtttgaagagattctacaagttaaaaacttcatcattataaatcaacctttactattggaagtagtttgattgatgaggtgggctaggatggggtgaggctttatttaggaaaatacatgctaattatggctgtcctgggctgcttggccctggttgtcaccactggttatgtagtacttacatatcatacaaggaagctggccatgtcctgaaaccatctgagatgcctgcccctaaggttagtggaactgtctctaggtcttatggacagtacctaaatggcacaaattcaagccatgtacacaggtttatgcaagaatccataaacagtctcagtgtctgtcaccttgctccacatcctgcaatcaagagatggacttcacttctgatctgataatttcacattcaaatgctcattccctccacctcagccagcctcctctgcttctgcaatggtagtcactatcctaagccaacccatctttccacacagcctagacaatttctgtaagcacagaacttccccgtacaataatgcccgtctcatagcaaattacaaaatatatacatcctctacctatgtccttatccgtatttcctcccaacatcacatagaacccagcacaccttatcctgtgcacacagcactcatgatttattaaatatctgctctcctcctcccacaacccctaacgcacactgaatacccagtttggtatccttgtcttgttagagtcatttcactggaaagtttagttctaataatgctagagatgtagattgagactggcagatcaaaactaattctggttgaaatggttaatggtagtaaacttaaaaaaaactgttgcttagtcctgcaaattctatatgacgaactgtgtagaaaaaaaaagtgcttaaggtgacagagatgacaacattgtatatttagtcaaatacaaattctatgctgttttttccttacaaatttaatcactggaagatcatttgtggttgaatgtgactgttactgggtgaatcaaaatacacagacaatctttgttagttggtctagagtgcagattaaaatacgaatacctactgatgactctggtgttaccgctctatagagcgcactttgagaaactcagggatggggttagtcaaagaggacttgtgtttgcattaacctccagggagaaggaacagggtcaaaaagctaaactagcaatttcattggttctggctcacatcatagaatgtttaccacatttactatcatgactttacaacttagcaacaagatactgaatattaactaccttatctcattcttgctgttttagaggaactagggcttctggttaattatgaggaagccaggtatttgatggctgttaactatatagctggcttgcctttaccaggtattgaaagcaaactggaagagcaggaaagagataaccattatctatagtaagggataaagtgtcctcagagtggctctaaacctctgtaagaaaacctcgaagggttttcatgagtctgtaggggcattacagatgaatggaaatatgatcgaagacaatgaggcaaaaaattcaacatctattgtcttgcttacctttagattttgtgatagtacatagaatatcaggcataggatattttccagtttgaacccattctgatttatttgctttccattcagaaaaatttcctaggtactgtattatgaaattatttgctttttagaaaattacatgttctttacacagtgcaaatgtacagctttaatcattttaataactggtctttggtttaaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaagtaagttattgctactattatatattgataatgtatatttctcatgaggaatcactctaaaaccccaaagcacttgaagtgagagtttttatcacctctcctaaggtgcctaaccagtttatcttctccctgcccaggggaccaggctcagcaggctgagaacatggccaggagtggcacactccccagttcctttcaggcacctctccatcatcactgctgccacccctctgagtttaagcctttctagaaatgaaaagaatataatctttaacaaaaaaggcaaaaagtctttatggtacagttatactgcgactttgttgcttaaaacacagttggcagagagatgaaaactaaaggttttttattctaaaattaaagttttatgaaaagtttataaatttttaaattaacaaagtttcctatcttttactccttcccccatcctcacaaagttgcaattcgatgagtatcttcccagtattttctgacatacagcacgctttttatttgtaagcactgcttcaacaaattagatccacagcatttagggttgactatagagtggtgaataaaacagctggagtgtaaactcttcaacaacagggacaaataaggaccacagtctacatttggtggatatcttttcgtatcagaatattgttacttaatagcactttttttttttttcgagacagagtctcgctctgtcgccaggctggagtacagtggcacgatcttggctcactacaacctccgcctcctgggttcaagcgatgctcctgcctcagcctcccaagtagctgggattataggcgtgcgctaccatgcccagctaacttttgtattttctgtagagacggggtttcaccatgttggccaggatggtcttgatctcttgacctcgtgatccgcccacctcagcttcccaaagtgctgggaggattacaggcatgagccaccatgcctggccagtagtatttcatttttagatatgtgataatttaaccagtaccctactgatgaaaatttacagaatagaaacactccaacctggaaagattttactaaaatactgtaataactatccttacaaatctttgcttcctagaagcaagtcttctagaaatctttgcttcctagaagcaagtcttctagaaatctttgcttcctagaagcaagtcttctagaaatctttgctttaaatatacatgtttacaatttagatattgtcaaattgctgcttccaaaaagatataggaatgaacatccactattgggaagagtagatttctcctacccttgccaaaactgattatcatcaatccttacaacatttgccagaggaatcctattttcgtgtttttcttttaggtgttttagaccatatcagaacttttggttgttttgagacagggtctcacactgtcactcaggctggagtacagtggcatggtcacagctcattgcagcctgtcaacctcccaggctcaaacgatcctcccacttgagcctccttagtagcggagaccacagatgtatgccacccacgtgtggctaatttttgtatttttcttgtagagatgggatttcaccatgttgcctgggctggtctcaaactcctgggctcaagatccgcccgcctttgcctcccaaagtgttgggattacaggcgtgagccaccacacccaggctcttttaagtttttatgcaggcaaatctttagcctccacctttatggcttcacttatgtatccttctaataaatttgctgctttaaaaaaaaaacctgaataacttggaatttttttgttgttgctttttgtttttttgagacggagtctcactctttcgcccaggctggagtgcagtggcactatctcggctaacttcaagctccgcctcctgggttcatgccattctcctgcctcagcctcccaagtagctgggactacaaggtgcccgccaccacaatcagctaattttttgtattttcagtagagatggggtttcactgtgttagccaggatggtctcgatctcctgaccttgtgatccacccgcctcagcctcccaaagtgctgggattacaggcgtgagccaccccgcccagcataacttggcatttttgctgtaaagttactttctctggatcttaactggtcccacaaatgataaggatgaaatgttggacatcctgggctcaggccagactggtttgaaattaatggacattttttccctttatttcagttgacaaaaaattgtttctatagtgcagatgaaatatgtatatattgtggaatgcctaaatccagctgacatatgcattacctcatgtaacagtttatgtatatgccatttcagatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaattacctgtctcaatatgtcatttaattggagtggtttattctagataatgcacaatggaaaaaatatgtagcaatattaatactgcattggggcctcaaggtttcctatacttgttaaaatatttttcttaaggagaaagtaaatattaccacaaaattatctcttccagaatttcataaaaatcagctgtttcaagaaaattattctctcattttcttaaggaaatataacatgttcaggaaatcagaatagcattaagaaaaagttaacctatagatgacctatgacccatagacaattattgttaggattctggtatatttcttgacggctttttaatcctattttctccttctatagttcactgctttcaaatcagtaatttgataccaatataggaccatctccctggtttttatgaaatctcttatggagaaaaaggtatcttatatagtcggctttcaaaatttaattgttcccatcgtcaacattcttgcccatgcctttctacccttattagcagcaagcccaaagattaataaaattccaaaactaggatgtggcaaaaccacttcatcttatagaagaccaacatttttttttcttttttgagacagaatctgactctgtcgcccaggatggagtgcagtggtgcgacctcagctcacggcaacctccacctcccaggttcaagcaattctctgcctcagcctcctgagtagctgggattacaggcacctgccaccatgcccggctaatttttgtatttttagtagagacagggtttcaccatcttggctaggctggtgttgaactcctgacatcgtgatccacccgccttgcccaaaatattattttatacaatactatcttttcaaatctgttaaatcagtaattgtcacaggttgggtctcccaggaagcagagagattagatctcaagaagcttgtgagggagtgtacttgcaatcaatacatgtggggatgggaaagacatgattgagttgagggagaagttgagcagcaataacttaccctaccctagggggagttctgaagctgggattcttcttcagagcttcaagcggggccaggcctttttatacccccactttgatcagtcactgactataggacacctgggaaagagaatgtgacctgagatgaagtggctctcttcagctgaggcaacataatcctcacaagggatgtcaactgagggctgcctgccagcagcacttcctgtagctcaaggaataagtcctctatcgctaaacagggatgtgggcagcatatcatagcatatttcaaaaaatttcttaccctaacattctggtcttgactattctattcttattaaacaaatggaagaacatagctttggagaaaagagagaacttggtttatacaaaattacttaaatcctctgagccttggttcctgtgtctataaaatgcacacagctcttatagagttactgtaacattaagtaaaatattgtttgcaaagggactgtcaaaaagtaagtcctcaataaatagaaattcccattctatttttgtacaacttttttctctgacaatacaccgcattaagaactcttgctctgtccaaagcagttttctttcattttgtctctaaaaattttcctaatacctcataattctagactccaatagccaagcacattatctagtaagggacactgatggttgcctacccaatatccattccatttcctaagagccatggttttattcaggtgtgatcccagattcaacagggaattctgattaagtcagtcccctgctggctcactgatctgcagatggggatgtggcattagttggtctaatcaggccaaagggaaggacataactctaactgccactagcagccatcttatgaccccaaaaagacccagccatagaggagaagccgacatcaaggataacagaatgaactaggaatagaaagttggaccttgatgtcatcactga

SEQ ID NO: 13432 - DNA, 76553 bp, Human
ggagtttcttttagtattttgttagcacatgattccttttcccccttaacttgttaaaaccttgtcttagtaaatctagggtataactaatactattaaaaaattgcttatggaagtatgaaatgttacttcagtcatatagattaatagcatgcctgttgaacaaacgacagtcattccttggtatatgcaggagattggcttcaggacccctgtgtatacctaaatctaagcatgctggaagtcctggagtactgtggaacctgagtatacaaagttgaccctccatatacttgggtttcacgtccagcaaatacgtattttcagtaacaattggttaaaaaaaaaattcatgtgtaagtgtacctgtgcagttcaaacccgtgttgttacagttctggcaaagtcttatattcaataaactcacatttatccaatttaaaatcaggtattttcttaggtgtaaaataattcttagaataagttacccgtttaggtagaatttggtttctttatctaatcatgacatatcaagactctccaaattgataatttaaaaacttaaaaaattctcagatttatttttacattaaaagtgtagcaattaactttaatttgctttatcctaaacatgtcctgatgtttaattatatctgtattatataccttgtctttttctacaacacatttgagatgaataagaatacaagtcacttttatgtggcttatgcatgtttgtaaggagcatcaatatctagaatctcaacatcagaatcatttatactttgagatttaattttagcagaaactacccttcacgtaagtgatatgtatattcaaggcagatgttggtagtcaaattacatcgccacccgcccccttcccgccccgggcgtacttactgagtccatctaaaagtagggctgatgttctgttgatgaggcaaagccttttatttagcaatttcggtaggatgttgatggcagcctcgcttttgctgtataacttgttttgtgcagtatggggtgcctttaaaaaactgagataagttcctaacttgtaatttatttcactattttatttttttgagacagagacttgctctgttgcccaggcttggagtgcagtggcagagtcacaggtcactgaagcctcgacttcaaaggctcaggtgatcctctcacctcagcctgcaagtagctgggactacaggctcacttaactacgcccagctaattttcttgtctttttttttttttttttttgtaaaggcagggtttcgccatgttgcccagggtagactggaactcctaggctcaagtgatccgtctgcctcagcctcctaaagtggtgggattcaggcatgagccactgcgcttggtctgtaatttattttaatgcaaaatgccacatcctaacatttcaattttaattttattagatttttatatccttgatagatcccactgcatcatgaggctgatagtcactggtgtaaagatgcaagcagttggtgactggtcttaatctgtaaataaaccacctctttttgcgtgtgtgtgcatttcagaatatgacacttttaatgaatgtccattgagttggtaatagtacctccttattttcacgtgtagtagttatcaacactgtacaataaacaaaaaagttaactactaataaagtaccaaaagtggatatttcgggaaaagaaagtaacgaatatttaaattttttctcttcaattaggatattttcacatgatttagaaatggaaggatgttttctactccttctagttaccacttgtcttatttttcatagtatatatgaattgtagttggcaaataaatcaagaatgtgatttaaagaactaacctgtttagatttgtaggtcaggttagatttgaaatgccacttgaaagagcagcagttttgactttaatttttatgagactgacaggttctttttttttttttgtccccaccttcttccctatttaggtgttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcggtattgtaatctatttaatctatttaattttattgtatgatttggagcttggaattgagatattctgttaggtacatacacagaatgtttaatattgaatttgaaaccatgattattcatttcattatgtgtttgcttcattaacattaattgctggtagaaattagtattgatcataaaatagcactttaaacttcagggcctgatgcagtggctcatgcctgtaatcctagcacattgggaggctgaagtgggaggaccccttgagcccaggtgtttgagaccagcctgggcaacaaagtgagacctcatctctacaagaaattaaaagaaaaaaaaaaaaccccatacatcttataaatatccaactttggctgttttacttaaaaccacttaggacctgtaaatatcagcagttacgaactttctaaatgatgtggtaagaattaaaggtgaaaagctaaaatcagatatcatttctcacccttgattgcttcattttgctaacatttatcatatatctgttttatgctaggcattatgctaggtattagggctacagagatgaatagtgcattttcgaggtagtcgtgtgctagctgtagacacagataggtcattatgaaagatttagtgtaatggtctagatatgtctaaaccagtgtaggaattctaaggtagaccacttaaagcaagtaatgccagaaatttttaaagtttggttaagtactagttaggttttttgggtggatggggaggggagggagattccagggaaagggggttgataggtacaatggaaaagccttgaaaattggcgtggcgatgtgtgaaactgtaaacagtttgttttatttgaaaggacttgtatgtaccattaagtcatttgtgtgtcttaacttgtaggaggttatatttgatttttttttttttttttttgagatgggagtctcacactctcacccaggctggagtgcagtggtgcgatcttggctcagtgtgtcctctgctgcccaagttcaagtgattctcctgcctcagcctcccgagtagctggaattataggcgtgtatttttagtagagatggggtttcacaatattggccagagtggtctcgaactcctgacctcaaatgatccgcctgccttggcctcacaaagtgctgaaattacaggcgtgagccaccacgcttgacccggttgtattggattttaaatatttgcatgtcagctaggatcaaggcatagtaagaactacatgttttagttggggaaaaggacacgtaagccagtaaaaaaaatgtggtttatgtaggagatagagaaagtatagaggaaatatagaagctaaagcaactactgcttatgctgggctgaaaggctttacaggggaggcagttcctgagcattgaatcgcttcatcaagcagatagtggggtctcattactcattggcagaatatcatgtaaaggcacagagctgcaagagtacagtgtattattgagccatacaacgtgaggtatagagagtggtagggaacagagctgaaaagatagcagtggctagatcatggtggtttttggatactgtgccagggagctaggacttcttaggttagccattgttgaagattttcaagcagtttagttacatggtcatatttctgttttagaaagatttttttggcagagctagcaagaacagatttcatggggcagtatttgatgccggcagactagttaagaggttattttagttttctaaaattaagatgtaggcctgaactatggtagtgacagaagaaacaaagttgagaagtatgcaaagtaagaatgacacgaataacctcactatatagaggtgtggcagataaaggagaagataggattaaagctgatctcccaagttctgagttaggttggggttggcaaactgcaacctgtgagccgcatgtagcccacttcctttttttatgcccatgaaccaagaacactttttgcattttaaatggttgggaaatagaataatattttgagaaatgtaaaaatgtaaaaaaaagtcaaaatctcagtactcataaagtgtttttatatgcagctacattcattcactcattcataatatgtttatgactggctttcatgctgcagtggcagacttgaatagttgtaccagagaccatatgtcctataaggtctaaagtttttactacgtggccctttgcagaaaaagtttgccaacttgtgcttggcagatggttggtagcactaaaataggtaatactggagagagactagatgtgaattgagaagagaacacttccagtttgtgtttccaatgcctgtggggccatctacgtagagcaactcaggatgcagtagggtatgtaaatgtagaaaagtagattcagaagccttaagcgtgaaggtagtagaaggcatgggagtagatagctcatccaagggaagtattttaattgaagccccaaccctgagaacaagcagtattcagtagaagcagttcccaaaggataccgcaaaggaatatttcaagtgtaagaagagaattatcatgggaactgataggagataatttattttatttatttttattgtggcaaattacagcatgaaatttactattttaacaacttttaagtgtgtagttttgtggtggtaagtacattcacattcttatataatcatcaccactagccaagtccagaactctttcatcttttccaaatgaaactctgtacgcattatacactaattccccattctgcctgcctcccccttttcccccgtccctcccccttcccccatatcttgacaattacccttctactttctgtctttatgaatttgactactctgggaatgtcatataagtgaaattatacgatatttatctttttgtcactgccatattttacttagcataatggagaggagataattttaagaaaggggtagagaccaaaagtataaaatgccaaagagtagtcaaataaggagtaatgagtatttgtagaatatggcatttgggacactgggggatctgagttaatcctttcgtggaatgaaagagataaaaatcaggttgcaattagctgaggaatgattggtagaaaaggaactaagagtattttgtcaatatgtaaggaaatggatgtgggatgctgggaattatggtgatggggaagggttttctcttccttcccttcccttccttcttttccttcctttccttcccttcccttccttcttttccttcctttccttccctttctttcttccttttcttctttctttctctctttctctctctcttttctttcttctttctttcctttttctttcgacagggtcttgctctgttgctgaggctcgagtgaatggtgtgatcttggctcactgcaccttcgacctccggggctcaagctatcctcccacctcagccccagagtagctggaactacaggtgtgcgccaccacacctggctaattttttttatttttttcgtagagatggagttttgtagagatgaggtttcaccactttgcccaggttggtctggaactcctgggttcaagtgatactcctgggttcaagtgatccacctgcctcagcctcccaaagtgctgggattacaggtgtgagcagctgcaccttgctgtttattttttaagatgatagagacttgatcatgcctataggctcagtagggttgaaaatagctgaggaatgggaaaggaggagtaagtacattgaagagctggtgtagtggagtaagaaagctagaaaaagttattggtgagagcgttatatgtcagactttaaatttttagtggtaaaacattctgggaattactcagtgattgcatcttttccgttatgttcattgtttgccacaattattttttttgtttgtgtttaataaagatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatggtgagatgtttagatatgtatttttataatgctaattctagagaagtacaccagcacaaggaccctggaatctcacacgctctttagctcccagtttaatgtgtgctaatgacaactgtaatactaatgcaggtctaaaattatctttagccttatgactttatagcgctttgacagatgggcagggtgtacatttgagatgaaaaagtttatataccatttacaaagggcaaagcatttataaatattcttaactcagttttgaaaaaataaatagcatacagaccatagaagaaaaacattcttgaaattttgtgctttttaatatcacttaaaggtaatgcttaaggacattagctagatctggcattagcttacatttccaattaattcctaaacagaactcacatgtgtatatggcaagcatcagattataagagatggagcaatcttatttgttcacagttttccagggaaagcttggctgtgaaatttgtgaagactaaacaacttaaaattatgacatatcaattaggtatgagagaaatattacctgaatatatttgttaaaattaaatgttaaacaattttaaataaaagaagagacatatataagtaaagaagctctttttgaaaggtaggaatgaaaagaaaagagattttcatctgggtgtggaagtttgtatctctaaccagcagacattaggcttgatgttcaaactcttcaaattcttcccattaaaattaggaacaaaataaagaggcttccttcttccacttttaatgtattttggaagttttagcaagtgtagatgtgccatggaaattagaggcataactcttcagaaatgagaagctatctgcaaggagcactgtggtttttgcacttagcaagtacaaagaacttgtttaaaaattatcaactacagtaagttggtaaagtaccaacataaataaaaactaatagttttccttgagcactaattaagtggaaataattcttatattaaaacaaaaattaaaggagacttaaggatgcataaaaagtttttagataccattagaggagatatgctatacacttttagatgatttaaatgatttactataaaataagactgttgagctggtacggcttcattagaatgagtgttttgacttgttaaatgacgaaataggaatttaaaaccaatttgagctaccagtaaatgtttcaaaagaactgcatttatcattaaattatgcttgcatgtcatttactctgttttgtaaaaattctaattatgattttgttgaacttaaattgcagtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaaggtaatatatgggatttatagtctttgttgtactataaaaacacatttctgagttctgatggagtcatagatttcattttctcatagaaacaatgcatttcaaaagaatcaaatccttgtggtagaagacttattggtagtcttttagtccagcctcctcagttttgtagatctggaacttgaatttgactttttaaaggtcctacagctattttgctatctgatgattatttcccagctactactgtctcctgtgaggtttcttggctaattcataattgttgtttttttttaatagactgttttttttagagtagttttaggttcacagcaaaattcattggaaagttcagagttcccacatatcccctgtttccacataagtacacaactaccttttaaaacttataatttagctgaagtattaaaagcccgaggctcctttgagtctgatgggtggcagctctttttaagaagaggttgttaatgcctaatacgagaaccttgggaaaataagggtgggtgggtcaggaggtgcttgatgcatggatttttaaaatgtcaggatggtttgcatatatttgatcttcatagaatcagatttcctttttacaattatcttagaacttattttctcatgtgtggaatttggcttaatatctctcaggattattttgtttttcacagttggttgtcagtgtgcaaggattattaaagttcattgagattattgtgaatataatagtgcagatattagcacatactagacacctaagtgatttttttttaaagtgagggtatattggcattttagtattttgcagtttgagcaaacttttagctaatgtaattattccgtattatagatgataaaccctttttttcctcttgactggagtatttgttttatttaacctgaagtatatatctgttttctttcggttattgactttctgggccatgaattcttcatgcttacctttgctgaagttattatttgtgttttttaaatgccaactctttgtttgtttgtttttttcaaattaagaaaatgctgaagtgaagtttaaagattttcttctgtccttgaagactatgatgttttctgaagatgaggctctttgtgttgtagacttgctaaaggagaagtctggtgtaatacaagatgctttaaagaaggtaagcgtgttttttgattatgggcatattcatgaccagtcattagaagttcaccaaacaagactttagccagagcaattaatatctactcccatccttaacatctcagaacatacatctggaatgccttcagaaattactttatatatcgtattagtctgttttcatgccgctgataaagagatacccgagactgggtaatttataaagaaaaagagtttaaatggctcacagttctacgtggctggggaggcctcacaatcatagtggaaggtgaaaggcacgtcttatatggtggcagggaagagggaatgagaatcaagcgaaaggggtttcctcttataaaaccatcagaccttgtaaggcttatttactaccacaagaataatatgggggaaattgcccccatgattcaattatgtcccaccaggtccctcccacaacacatgggaattatgggagctacaattcaggatgagatttgggtggggacacagccaaaccataacattccactccagaccctcccaaatctcatgtcctcacatttcaaaaccaatcatgccctcctactggtcccccaaagtcttaactaatttcatcattaattcaaaagtccacagtccaaagtctcatccgagacaaggcaagtcccttccgcctatgagcctgtaaaatcagaagcaacttagttacctcctagatacaggggtaggcattgggtaaatacagccactccaaatgggagaaattggccaaaataaaagggctacaggccccatacaaatctgaaatccagtggggcagtcaaatcttaaagctccaatatgatctcctttgactccatgtctcacatccaggtcatgctgtttcaagaggtggattcccatggtcttgggcagctccgcccctgtggctttacagggtacagcctcctttctggctgctttcatgggctggcgttgagggtctgtggcttttccaggctcacagtacaagctgtcagtggctctaccattctgggatctggaggatggtggccctcttctcacagctccactgggcagtgcttcagtggggacttagtgtgtaggtttcaacctcacatttcccttcctcactaccctagcagaggttctccatgagggccccacccctgtggcaaacttctgcctggacatccaggtgtttccatacatcctctgaaatctaggcagaggtttcccaaaactcaaatcttgacttctgtgcacccacaggttcaacactacgttgaagctgctaaggcttggggcttgtaccctctgaagccatggcccatgctgtaccttggtttcttttatccatgcctagagtggctgggttgcaggacaccaagtccctaggctacatacagcaggggggccctgggccctgctcaggaaaccattttttcttcctaggtctccagcccatgataggagggcccttctgcaaaggtctttgacatgctctggagacattttctccattgttttggtgatttacatttggttcctcattacttatgcaaatttctgcagctggcttgaatttctcctcagaaagtgggattttcttttctatggcatcatcaggctgcaaattttccaaactttattctctgtttccctcttaaaactgaatgctgttaatagcacccaggtcacctcttgaatgctttgctgcttagaaatttcttccgccagagaccctaaatcatctccctcaagtctccctcagatctctaggacaggtgcataatgccaccagtctctttgctaaaacatagcaagagtcgcctttactccatttcccaacatgttcctcatctccatctgagatgacctcatcctggatttcattgctggtatcatcatcagcattttggtcaaagctattcagcaagtctctaggaagttctaaactttcccacatcttcctgtcttcttctgagccctccaaactgttccagctctgcctgttacccagttgtaaagtcacatccacattttcgggtatctttacagcagttcctcactcctggtaccaatttagtgtattagtctattttcacgttgctgataaagacatacctgagactggtaatttataaagaaaaaggggtttaatggactcacagtttcatgtggctggcctcacaatcatggtagaaggtgaaaggcatgtcttacatggcagcagggaagagggaatgagaaccaaatgaaagggattttcccttttaaaaccctcagatcttgtgagacttattcacgaccaggaaaacagtatgggggaaactgccttcatgattcaattatctcccaccgagcctctcccacggcacgtgggaattataggagctacaattcaagatgagatttgggtgggtacacagccaaaccatatcatatattcacactaatcaattcacttatttaaaatgtcatctgttgtcatctgatcctttgacagagccaattgcttaaaataagtaagatgatttatattactttttttttttttttttttgagacagagtcttgctctgttgcccaggctggagtgcagtggcgtgatctcggctcactgcaacctctgcctcctgggttgaagtgattctgctgcctcagcttccagagtagctgggattacaggcatgcaccaccatgcctggctaatttttgtatttttagtagagatggggtttcaccgtgttagccaggatggtctcgatctcctgacctcatgatccgcctgcctcggcctcccaaagtgctgggattacaggtgtgagccaccgtgcccggccagatttatattacttttaaagtcatttggcccttggctaaactgtaccgtgctttgctctgactagaagtgctaaagtcaaagtcaggtgatttctggatagcatgtatgaacggtttttgtgactgaagatcacaccgttcaaagaacctcaggactattgttgtgggggggatgtgtgtgttgtgtttgtaatagtactcttctaaaagaaatgatttgaatggcataatcactgctatggctgatgttttaaaaaaattgtaaaataaaaaccccatgcagccaacatctatattcttatgggtcatattcactataatatcatatgtactatgtcatactgggaaaggtgacaaattttcaagggttacctatgtaaaataaagtgatatgttgtctgctattcaatattagatggtgcatttaactgtctttattctaaaaacacacacatgcacacctttccccataacctcttgcctactttcaaaccttcagtggtttaattttttcttatactagtctagaccatgacctttcacctgattacctacagtagtctccagattgatgtttctgcttttcctcttagtcctctaattttgtttttttcccacataactgtaaagtgacctttaagagataaattgttatattactgctttaaaaaccctttggtgtttttctcttttgtagttaaaacataaatccagattccttaacaggtctatgtcctgcctctctctgcagcctcatctaatgacattttttcttattccctcaccaaatttcacccatatggagtcttctctggttcttctgtcataccagacttgtttcttctgtctgtcctatctcccctttcctcccaaaccctcccttccaatttctttctatgcccacttcctccttcaagtctccacttaaatgtcattttctcatataaggctaacctgaattcacagtctaaattgtttgccctgctattctttcttacaaccgtctggatgtttttgccacagcatttatcatagcactataagtctgtcatacttctgttgacagtgcattttataaatctgtggcaattttacaatgtagtatgcttgttagtttccgtgtgatgccagcaatggcccagagtaaaaaggtaatcagtaaatatgataaatgtgactttaaatacaaagacagatgctttattgcaaggaactttcttgattatttttatttttgtttttatttttttgagatggggtctggccctgtcacccaggctggagtgctgtggcgcaatctctgctcaccgtagccttcaactctcgggctcaagcgatccctccatctcaccctcctgaggaactgggaccacaggcaatgcctggctagtttttgtattttttgtagagatggggtttcactgtgttgcctatgctggtttcaaggtcctgagctcaatcagtcgtcctgccttggcctcccaaagtgctaggattacaggtgtgagccacggctcctagccttgatattgattaaagaatttgtccttcggtttattttattgtaattgggtgagtaaatacttaaaaaagttgttagttatatgtggggattgggaaaagctcctagcagggaagaaccttgctgaagttactatgttactatattgctgtttagagttaatgctttttaagattaaaagtaattgctttaagtgtctctcttctaatgaaagatgttgctggtagcttatgggggcaagagtaatcattttattgtctgagacagctttcaactctagagtctgggtggtaaatcagactaccctttatctattttaggcaggccttggaagaagttggaaactattaaagatagcatggagcaagtgttttgaaactgttcacatttttccccttttccttggagccatttggttttagattaaaatcttattgttcttggtttctcatggggcggttctgttctctactgaaggaactctgcctttgtaggtctcctgaatctgagtaagactaggtaagttgaatttctcctttttcctgccagaactgagttggtcagagcttttcacagactgttcgaagtcgcagaggtaattgaatccttgtgctgaataaagacgactttagagcaagggggaagataaatacagggcactggcataggataggattttttgagcagttgtatgtagtggctaaagaagagtccatggtgactgcttgttttctttcttgagtaactggatagattgtggtgacagtggtttttgtgaacactttgtagagagtagaggattgagaaatttcagaaagctgttttaggcatcccttgtgccatttaagtggatatagtcattttacaattaacatatttctctggagtagaagaaaggctacaatgggagtgattgaggaagataatccactatcaacagtacatatggtagatgtatattagatcagggaggatgtgagaggtgatagaaggctcaagaatgaaccccaggaaacaccaacaatgaaagggcaaggaaaatcaccatgaaagatactgaagaggagcgaagtggtgggaggaacaccaggaggtagtggaatcacagaaactttgagtttgggaagtagggagcttgggggaatgatcaacagtaacatgctttagagatgtcaaggaggattaagattgtaaaactgggtttgatatccttagtaaaagcagtttcattgcagtacaagactataaataagtaccaaatgaatgggaaaagtgacagcgagtgtccgctacgagtaagcttaggtgggaaggggaaaacagcaaaagctagaagggttggagcagggatgttatgttgtgtgagtgcacacatgcccttgtattcgagttatgaggcacttgagagtgtggttaagatcctgagctctggagtcagacttcccaaattccagtctggactctgccacttgcagctttgtggccttagataagttacttagcttcagtgactcagttttcccatggctaaaatgggaatgatcaagttttgagaattaaatgctagtgcatgttaggtgctataaatagcatataataactgctgaaaagtgtaaactattattgtaattattagtaagaaaatgtttaattattaattttttatcattgacctttaaatatacttgcttcagttatattttaaactttaaattattaacaatttgggccccatgctgtgtagcaggaggaactactgttataccacttaaatttttttcctagcttctttcttccaccagtctcaactttcattaataatagtttttctgtttgtcagatacttgtaatatttaacatcttttctgtgattataattttcatgttttagttttaattttatagtttaatggtgggtccagatctcaatgttagtacttttgtcatagcttctttattcatctcttggttagctgaagttgtttttcctgggattttgtcaaaaaattttcgaaattttggcaagttaacatgcttttcttgtatttgtactcaaataatagtttggtggggtataacattccagaatttcatttttttttccttgaaacattttatgcatttgttgtttcactgttctctttattcatattgctggtagaggtctgacgccagcctgcattttgcacccttttcatgtatttttgttaaactgcactctcacaataaaacattctttgaataatcaatcacgtgtttattatttactggatttttttcagtgtctgacctactctacacacatcaagggattcaatttctttggcattcagtaattgtactataatatggcttgacattgactgctctgttaaacttcccttggacacagtatgccttttcagtcattagattcaagttagcttttattactgggaagttatatataatgttcttgaaataagtaaaataatggagatcagttaaatacatatgggctctccactgcctaccttcgttgtcttttcatatctttaacaaaaaaaaaaaccctaacacataaccaaagaaaactttatttctactttttatttatttctcttcaccattgtctctatggctcttactgtgtttacagcggcatgtgcttttctgtttgctgcttccaactgtagtattatttctgggatggtgttgcttttgcttccactttagttttgccagctcacgtttcatctcgttttgtgttatcttttctctgagctcttttattttccagagatgattactatattagatttttaaccacagttttttcctgctgtgtgataacctttttctggtgatttttcttcacttgttatttgtgtttttcttattttcattttttggtatcgtgtatagatcctgttttgttttgttttgttttgtttcattttatttactactactgttcttccaatgaggggtgtttttcttggatcatctttgtgctagagcttggtgttgttgaagggtcagggatggctggtgttctccttggggactgtgtatgtaaaatgatttttttagcctttgctgcttttcagataagaggcttagggtctccctgtagagaatcttttgactgcctcactggctagttgctccctttgagtgatgtttttcctcttgagatgtgggattttatctgcaactttttttttcttttccttcttgagaccttcttccaagaaagttcctgcttgcaatctttgcacttgtttgttgtttcccatgtcaagttggggatggctggttttacctttcaggatgtgcctgttaatttcagagaactacacatctatggcacctctgtagccatgggtatattctgacagggtcgtggagcatctgaatttgatctttactatatttggtggtctttccttatatgctttgagattacaggttactgtcattcatagcagcttacattttggtttcatattctctcttttgatctagcaggagaaggaggaaattactgtcttgactctgagtttaaaactggaattcctgtagttcttcgtaaaaatctgttccttggttgatatgtatctagttggaaatttcaggatacacaacattaaagagatttttctgaatatttcactgatcagtatttggcagttattttactttttatgtagtacagaactctgcattgacccaagaacacttgatgttagatacttcattttcataatttttttttaatcttagcaccttttattttttattttatttatttatttttcttatactttaagttctgggatacatgtgcagaacgtgcaggtttgttacataggtatacacatgccgtggtggtttgctgcacccatcaacctgtcatctacattaggtatttctcctaatgctatccctcccctattcccccacgccccgacaggcatgttgcccttcctgtgtccatgttccccttcctgtgtccatgtgttctcattgttcaactcccacttatgagtgagaacatgcagtgtttggttttctgttctggtgttcgtttgctgagaatgatggtttccagcttcatccacgtccctgcaaaggacatgaactcattcttttttatggctgcatagtattccatggtgtatatgtgccacatttcattttcataatttttattagcccatggtaactattactaattctgcattgctttctcaattgcagtcaagtaagggagaattgactacgcttatacatcagcttcaagaaaaggacaagttactcgctgctgtgaaggaagatgctgctgctacaaaggatcggtgtaagcagttaacccaggtgaagacattcttatgtacgagggatatacttcccaaatcagaagcaacaaaagattttagaaattgtccataatcagtagtttaattatttgtaatttatgtccaacaaaagtaactttcctttagagttttgggagggtagatagagctgtctctctcttttgtgatattatagcctatagttgaattatttaaaataagagtacttacagatatcctagcttcagaataacaaaagcactctgtacagaagcatgggaatttgttttaattggatctgacctagatctgttctcaatagaaacacagaatttggtgtgatcttgtttaagtctgattaatggaataagtgtgaaactcttaacataggtaatttatttatggagcttcttgtgataagtataattttttgtcaagttcttcacatctcagaaattttactttgagaggttaatagtaaaaaataccagaaaagccaatctttaaaacatcatgaaactgagagaacagaattgaaactatagaaaatatggtttaattattcctgaagtgcttgtttctctttctagggattaaatgcagtagaatacatgatgtttatttatgagtcattcacctagccacttgatgacattgtaagagtgaatggctttgtttgaatataaatcctttatgtgaatttgaagtaaataaaaaaagtcaatggaaaaagttggcaagattaattaaagttgttaataaaattagaaactttaacatagttttttgtgactatatgactatataaaaaattaaaaattaggataactaatttgataattcattgagccgcatacttatgatgtgtatacttctaagtatgttatacaggagtataacaatttgtaaagatgaatgaacaaactcaggcagccataaattatgtaatatctcaaattttgtcatacaattgctttagagcaggaacatgattagtcctaatgatacctgcagctaactttaaaattgcttggctttcatgtactttgataattaatatttgttctaggagttcatagtaccggcaaaacaaaatgaaatccctcatttaagatttgacttagtggccgggcgcagtggctcatgcctgtaatcccagcactttgggaggctgaggcgggtgaatcatgaggtcaggagatcgagaccatcttggctaacagggtgaaaccccgtctctaataaaaatacaaaaaaaattagccgggcatggtggtgggtgcctgtagtctcaactactcgggaggctgaggcaggagaatggtgtgaatctgggaggcggagcttgtagtgagccgagatcacgccactgctctccagcctgggcgatggagtgagactccgtctcaaaaaaaaaaaaaaaaaaaaaaagatttgacttaggaagatgataaaactttgctttctgaatttgctttcccttgtttcaaactttgactctgctatagacatcttatccctatttttttcccttaggaaagagaattatttccttctaggccttttttccctgaaagagaacgtgtacctgggaatgatagagaatgaactgttgtgctttaaaatgttctttcgtgtaatcaagttagaatgtaggatttattctaggttcatagtctttaactcataataaactagaaagtgcatttgaattaagagtaaacaacagtggcaaagtgtttatgaagggaattggcgtgaagagcagatgagatgcagaagactgtttttaaaatcttttgaccttgctttttttaagcaagtacttaatgttttatcattcatgattattttactgatgttaaataacatcattgtttatcattgttgcaggcttatgatacttattaaataacaagtttttaaatttctgggatattcttttaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaaggtatattttcattctttggaaacaagatgaaatggttgcattcactttattagcaaacttttaagtggctagtatgtacaaggccctttcttgggccatcaacatacagtggctagtgaagttcactctgcgtcctaagtaaaacaacttttctaggtggggatgaggtagggaggccggatgcagataaatatgatgatagagataagtattggcgactttagagcaatggtgatgggaggtaaggaagaaaaggatttgatagggaagactttttagaagtgatatgcagactgtgttaaatcttttaaatcaattaggcattatcaagtaagagagtaaagaaatgggcactgaggataagagttacttggtgtgatttcttagtccatctctggaggtgatagttcagtgggtatattttgggacccaggactgagctttttaatgagtgcactccaggtgttaccagtacagattgtctagagtaactgctctatgagaaatacagtaagagttgtggtatttggtaatgagggctggaatgaagaagggatattgagaagtagatagaggccccatcttaaagggccttgtatacctgaagactggggagccagtgaaggagtttaagcaacgcagcagtcgctggaattatactactattttaaattttcaccttggtagcagtggggaaagtggagcaagggatagttggaacactttgctagaattcaagtcaaagaacaagggcctgaaattagatgttgacaatgagagaatgagtttgagtatacaaagagttagttagatagggcttggtgttagtgtgaaggggagaggtgatagtgaagaatgacttccaaggttttggcctgagtgattttgtctgttgttgcttcctaccctttcacctgtcttctgtcagaaggctcagtttttacagtctgtcttttgtatatattttccattttcatgattctagttaggactagaccagtgaattttttttttcttatttttgaaaagattgaaatatctttattactgctaaagaggttattgaagaatatggcttgagtctgcttgcttggtggtcatgtaataccttccttaatttaactttcttgaccagtgactttttgaaattgttacttccatctgctggctgatccttcaatttggaaggtctgtcattacctcagatttaatatatgtctaaaactcacctattgataaggttgatatatatatatatatatatatatatatgtattttttttcaggccaatcatgagcaatgatgtttttaatattttgaggcattattatctttatgcttgaatcctgtgacttttctctgcctggcttaggctacaatttgttctgaaatcttaaagacactttatttctatggctaggtgccgtggctcatgtctgtaatcccagccgaggtgggaggatcacttgaacccaggaatttgagaacagcctgggcaacatagtgggaccccattctataaaaaaattaaaaagtttgccaggcatggtggcatgcccatggtcccaattactcaggaggctgaggtgggaggcttgagcctggaaggatgaggttgcagtgagccatgatcacactattgcactgcagcctgggtgacagggtgagaccctgtctcaaaaaacaaaaaactccaaacctctttatttctagttactcttgcattcaattcttagacatgtctttagtttattattacatactgggataattatggctgatattaataggtttgtcattttcattccgtcttgtatttggtaccagatttttttttggtaaaatattgctttgataatatcgctagtctgctaaaaattttaaaatattctttgctgctttcagagtcccagtgttttcctctgaaatgccactaatagcaaaaaagaagtgaatgatgctgttttcatgttcttaccctatccactgcttttagcatttgtttaactcattccttcatcttctcatcccccagcaatttgagttagtgaagaactgattttcctagcctcaagtgatcttttcttcttaattcctaattcctgttaatttgaaaattaggcagatacttgtagcagcatcttttgttgaaggtgaaaggtatttaagtgattcatcctgttttacttgattacttacagaggtcaggatatagattccatatgataacttctgtgaaaaatagaaatgtataccttaatttcccttaataagcaacagtttcttttgaaagaattattaataagattatttcatacaaaaacatgttcttatgagaatataagagtcagtgtgcctttatctttagattctttaatccaaaatttaaaaattagaagaagaaagttagagtggtggtcgccaggggctgcagggagaggaatgggagttattcgttaaaaggtgtagaaggtgttttacacaatgaagagagttatggagagatgaatggtggtcatgattacacagcattatggatatatttaataccagtgaactgtatacttgaaaatggttagaatggtacgttttatgttatatgtattttataatgtaaaaacttggaaaaaaaattaagaggtcagaatattttagcaagcaggtttttgtgttatctatatgattatggcccaatttgtaacttaatataaagtgtaccaaacatattttcagtttttaaactttggcttactaaagactttaagaatattgctaatgtataattgacataagatcaggacaagcttaattttgtatgaatctattcggtaggaaagaaatcctaaatcatatttagttctgaaacatcatctctaagcatgtttatcttgtatttcaaatatgatagcagctagcatctacttgtattcttgaatgtggtgacagtttgtatttgatttgcattcatcactaacaaaatataattcttttaaatttgtttatatttatttgagaagaatgattcaaacttcattctattgatgttttttatattctcattttaataaagtttattttaaaagttagctttgacagtctttgttttctaagttttatgtgtgtaaaataattttagtttcagcaagttcgtgagcagatggaggcagagatagctcacttgaagcaggaaaatggtatactgagagatgcagtcagcaacactacaaatcaactggaaagcaagtatgtttccaaataccttattttttaattgaatggcagagtattttcttgaatcatcaaaatattaatagcgtttgatagtaattggttagacttttgtttttttacatttgtttctaaaatgagttacttttaaaaacaattctcttttgctttgtgaagaacttcttcagttatacatatgtaaactatgttatattaatgtcatactattatatacttatacaaatacattaatatatatcatatattacatatttatataaacatgtatgtgtatattgtatataaactatgtaataaatactagtaccaccaatggaatggtctacaagcttatgagtttataagttttaaaccatctgtcccctttcacagtagctcccaaacttcagtgttctgaagaacacctggcattctaattaaaaggtgtattcttgagtcctccccttaaaagattatgattcactgactctgaggtagagcccaggagtctacatattaagacactttcgggccgggtgtggtggttcatgcctgtaatcctggcactttgggaggccgaggcaggcggatcacctgaggtcaggagttcgagaccagcctggccaacgtggtgaaacccctgtctctactaaaaatacaaaaattagctgggcttggtggcacacacctgtaatctcagctactcgggagacaggagaatcgcttgaacctgggaggtggaggttgcagtgagcccagattgtgccactgtactccagcctgggtgacagagtcacactccgtctcaaaaaaaaaagacactttccttgtgatagtgattggctctgaggccatactttgagaaatagtaccttagagagactagtaataccggtacacagtaccctgactggctgatttttaatacgttttcagaagaccagtttgaaggtgacactatttatggtcatccatttttcttgatattttacagtgattttagaatttgaataactcattagaattatataggaattatacaactaaactttattgttagtagtcacttgtgttctgtttcagttgggctgtaaatggaactactagctcagctcagcaaaactaacaaagtatgttttgtttatttcttatatatatttgtaataacggaaggctcctaatccagttactgttttcaggcagtctgcagaactaaataaactacgccaggattatgctaggttggtgaatgagctgactgagaaaacaggaaagctacagcaagaggaagtccaaaagaagaatgctgagcaagcagctactcagttgaaggtgatatattctcacctttatttgtcatttcatgaataatataggcgtattagttcgttttcatactggtatgaagaactgcccgagactgggtaaatttttaaggaaagaggtttaattgactcacggttcaacatggctggggaggcctcaggaaacttacaatcatggcagaaggtgaagaagcagcaaagcatcttcttcacgaagcagcaggaaggagaaatgccgagcgagggggaagactcccttataaaaccattagatcttgtgagatctcactattacaagaacagcatgggggaaaccatgcctatgattcagttacctccacgtggtctctcccttgacacgtggagattatggggattacaattcgagatgaggtttgggtggggacacaatgcctaaccatatcagtaggtatttaatttgatgacttaaatgtgtatataggtttgaaaaatatagtttgaagcttaatgggacctgtagtctaaatactatgccctgatgaaagaaaaagaagcatgtgccctattgaaagaattgaatataggcttgaatttgaagttaaagaccgtttgaagatatggtaaatgatgttagctgattgacagatataaattgtagaattttatcatatatatgggggttagggtctacagtatagggcagaaatcatgtagttaaaaattacccttaataccactttatcacccatagcttggatttttcagtaggtccagcagaacctagttttctttcagcactggaataggtagtttttcctttgcttcagcacaagactaagtagtgttccagtggcttgcactcgacccatgatgtacaaaaagtcacatactgtatctttagacgccagagtgtcacttggtccagtgagatgcttatactatgaagagatgcatggctttgctcaggctgactgagggaggagcagattcatttatctcattttatatgcattctgaagcatatgtacattgaatagaatgatgagtataattctctattcctgcttttattgaagaggaaatttgttgaaagtatagttcaatttgtgtaagttaaatgctacctcattataatagattcctacctaggtcattgatagaattgtactttgataccagttccagagtaggagttaaaaaggcttcaagagtaattgagtatggaaaatagtgtttttcttaagtcttgttgggagattgatataagtatcctttcttttatttaatattgatcttgctggtgggtttactactggcatagatacggaagtctgttctctgtggatatggataaataaatgacattaaagattatagtcatgattggagtgttgtgttataaaaatacctcaaaataagaatttttagctacttagatttagcaataaagacaccatcctgtccttcggaagcttatcagctaaaggaaggttagtgggaaacaggttattgctaagtggatcagatgtatatagtagtagctatcttgatagaaactcagcacaaatattgagtctgaaataatctccaaactgtaaaccctgtaatgttggaggataggatggctatggctgataaataaatggcttttagactgtgtgtatctgcttgtcttattgaaatgtaggagactagttgcaataagcagttttatgatacaacagtaaaggtagaggatgctttttttccctctttttcaaagtagaaattctgtgtttgtgctaatttatcctttctcccttttaaaataccaaggttcaactacaagaagctgagagaaggtgggaagaagttcagagctacatcaggaagagaacagcggaacatgaggcagcacagcaaggtaaggggaagaagtattcatgtaaactttgtatataattttgggtaaaatttcctctctcttccatctgtgaagaaagtataatttggcattttggttatagctcaataaaaatagcttttatactttcagaatatctttctttctttgacatttgttagggttttaaaataagttacctactagctttgcctgaagcattaaagttgcaggcaaaattatagtacatgataggttaatgggatcctggctgtgtgtgtttcttttctgtagttattctctttggttctttggttaattcttttttttttttcccaagaaaatactcacttcttattttgaagagaaaaacagagcattaccatcccaggtagtttacttaaaactgcccatttaatacatgctaacgtttactcatttactcttaatttgatggatccatctgggagataatggagtacgtgttatgtgtattgtttatttctctactactccctttctcccatgaaacgcaagtatagcctgctacaggagcatgcaagaatggaagcaggagagattcaaagaaggttttctagaggagagaatgcctacacgaaagatgagtatgagtaactaggcaaagaaagagacctctgtaaaatgtaatgttttattacagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggtattttttcttctttttttttttttaaaaaaatacaggtggtcacttattagatctgtgtgtctagaagagagactaaagtctaccttatcctaattctgaaatgatgatgaataattataactttgtcttttgagcacttgtcacaatatggtgtgtttgaaggtgtgctcacccacagtcttaggctctttgtgttagattaggaatagcacaaacatatctttaacttctgtcttataagctaactcagattgtctaatcattgtttaaaataatgccttttggaatctaagaatgccttaaaaaaaaaaaagaaaaagataaacaaatgtacctataatacattgtgttcatatacatggggttatttattagcatgctttttctctttttggttgctatttatgaaaggatattttggagcagaatgaggctttgaaagctcaaattcagcagttccattcccagatagcagcccaggtaatgatgctttcttattgcttatgattaataacttgcagccatttaaacactcacctgaatgtctgttgagtgccaattactggattaatagctgggagactagtcaatgaatcaacaaatgatgatcctgagtgctaaacacttgctaattatgtacggtgctgagggaaaacactaagaaagaaatccataccaactaattggatgaggggaaggttagagagcttttattatacaaaaatgtccccaatcctgtcacaaaacaaggagagagaattggccaaatcctatctagaatagtggcttatgtattacagatgttcattaaatatcagctagctctggaaaatcctaatatatcagcagggggaacagtatggtaaccatagatcacagattatatttgcaaaatgatcaattgaaaatttgtacctcagtttagtgactcagccttccaaagttttcaagtgatagtgtaagacctgttattctttgatgtgacatacatgtctttataaataatataaagaaaatcaaataaaaacaagtattgtgaattttgagcttcagtttttcaacttgaaaattctgagagttatttgtagcaaaaagtattggcttagaagtctgacatttctgtataaaaagtggtttttaacattaaaattttgtttttaaggttcggagaagttcagactcccaaagctttgaccatataaatatatttttcccagttgctttatctgtagaaattatagtctaaagtaattgaggaagaattaatgcaggaaagggtgctggtgtggatgtgtatgtatatgtgaattaccaactcagattgaattgtgatctttagttatcagctgagaagtagctctaaaaaatttatcaggagttaaatacatagagaatgctgtaagaatcttttaaatagtaaacatgaacatgggtattactaaactatattagtcatggaatggataattttattattaaaagttgttactaaggagaagaaacacaggatgacaaatggcctttctggctgtttttcctactcatttgttgcttgtcaattatttagtttccaggcctgtcaacttgttttattctaaatgtcttgtgatatgtaattcgtgactactggctgttggtgatcaaacttgctttcagaatgatagttactctttattgaacacttaccatgggccagatactttcataacaatttatatacattaacttctcttaaaatttaaagctgttatgattattgtatagctataaagctttctcttaaatacttttatgttgacactatttttctttcttagacctccgcttcagttctagcagaagaattacataaagtgtaagcctaccttttcacactcttataattgtgtagtcaccactaactgatacttgttagatgcgacacttatgattaactttatacctctgacgacctgttcagaaaatactctgaactagatttggagcaacttttgctttttttttttttttttcctttttcccattagtgagttgggtccctaaacattatatattctgcttttatttatgtttttattataacaagagttggggagactttcatttgagtgttagcaattatgtggaagaggtaattgtttagaaagtagtggaagtaaattagtttttgtgtcttataagtagttgtagttcttctgtgtccagctctgtggtagtatacccaaaacaaagttatatgctttttttgtgccgtataattttgcatggacactgatcacttgagttcggaagatctgaaatctggttttgacatagctagctttaacaaattaacctcttttatctcgagttttaaaacagggttatgtattttaaggagttatagtaatgtgtgtgacagttgttagtaaactgaaaggggctatagaaatggaaggtatatgagaactactgaagtaaggatgatgctttttaaggctttaaatccttttgatttgtgacttctgaatgtttattgaatgtacaaatgtctttccttctaaaggattgcagaaaaggataagcagataaaacagactgaagattctttagcaagtgaacgtgatcgtttaacaagtaaagaagaggaacttaaggtatagtaatttgtataaatggctgcaatattttacagaactgaaatttaaattactttgatgcacataatcagtaagtgtatatgaaaaatggaaaatagtctagaattcatttgaaataactgtttttctaaactacaaaattctctagctctctacgaggaaaaattcaaagggcttctctcatgtgatataatttacaataatttgataggaatatgctaaataacaggaattggtggtttctcttgattatttgggaaattttgtaagttgagacatttgcttaactcttttgtagaaaagatgctttacaaactttaaaatcagttgtattaagtattttaaatgctatttttccttgttctaggatatacagaatatgaatttcttattaaaagctgaagtgcagaaattacaggccctggcaaatgagcaggtagatctttattgcttttgagcattgatctcagaatttcaatttgcgtattcttattttcattgatattgtgagccccaatttgattgtgtaagtaaaaaatataatggtttatcatctttggctgcatgatttgatgttactgtttttatgttgaaataaatgtttgatccagtgaattaatcacttcaagatatcacaggaggcagttaaaattatcttactatgctggtttgtttgagtcttttatttgagccatttaattcaaaaaggatatacctttttgttagtgtatatgaagaatggaaaatagtctagaataaaagaagtaaaaaatatcgaacagcaaaacatgttacagaaatatacagtattgctgtaacttcaaatatatggaaatacagctttttaatatgtaaaaattagtgaaaaaaatagttttgagcacttcctgtgaagtgatatcattttcttctcattccacacacaggctgctgctgcacatgaattggagaagatgcaacaaaggtgactaaagtattgtacatctagtcgttcatacatttatgtttaattataattgttgcagaaaatattgctgcttataactgatagttgtgcccataattcttgtagattttctgaatgtatgaagtattttaattttttttttcaccctcatagtgtttatgttaaagatgataaaataagattgctggaagagcaactacaacatgaaatttcaaacaaaatggaagaatttaaggtgtgtgattaagcttgtacactcaggtttcttagaacaaccttgtatacttttcagttgagtgattccagaaatactacgttttgtatgaagtcactctgaaacaatgtttctgtagtttattaggggacttatgcaaaccatgaattttatcatagactttccccctagattatctgttcttttagtggagcttggagatttatttttggcccccaatcttttctcagctgatagtttctatttgggactgtcttatttgtctccactgttgctgtagttctagtttctggtcatggccaaccaagtgctagggtgcatctctgtgtccagtgaaatttgaattatgtcagtgtataattcacctgtcactttgaggactgaaagctgagataaaggtttgattgttcaaaaacccattcaaatgattgctttattaccttttttcttaataaaacagtaaattgagactctttcttccagattctaaatgaccaaaacaaagcattaaaatcagaagttcagaagctacagactcttgtttctgaacaggtaaggcttttcctaaattacaaagtagaaatacttgttatataacaagatctggttcttcttatttaggtaccaaattactaattgagaaattttgcttaagcttagatatggctgttattgcctttctattcatcctgtatctaaattcaggaaattttttctccctgaggtgaagctaatgccaatctgctcaaaagcacattccagaaaaataaaaatgtgtaataggatgcataaaaataatttaagccattttgatacatttgactttcagaataaatgtcctgccttagacttggagcctcagctttttcttttagggagcatggtgtctttaaaggttgaaacttattactagcacttaaaagcagtgtgatgttgatcaaatagcttaacctttgtgacacctctcattccaagcctttcacatggagattatattatatttacaccataaagttgttagatttgaaaggagaagcttatgtatggtgcctagtctagtgctttgtttatgacaggtatctaaaccttaattcttttcccttagagtatttattttatccatctcatctccatcccctgccaccatcactattcattttatatttatagcaagacatcaaaactatatcagctttgaataagcatggttccataaattagagcccagtggtatctgttctctgcctgttcctcagtgctgccttcgtactcttcttctacgcagctcttacaattacaatttattaataaaacacaaactcttgatgacacattagaataggaagtttgcgtttgttcctaatattaagtttttgaattgtacttttattggaagccgaaatgtaaagccattgcaaatgatagcacttctttagcaaatgcatgcgttctttcatttattttaaaattcacatttatgcagatattgagctggtgtaagtagctgtgcctctggaagtattttgttaacttgtcaagaaataatccatttattctacctccccgtatgatattaagtgcattattacatagtcttactacttactttgtatttgctttacccttgtaaactaaaggtaatagaggagacagtgctgaagggatgatatttagtttaaatggcatttaaggcttattcttttttttttttttcttcttgagacagagtcttcctctgttgcccaggctggagttcagtagcactatcttggctcactgtatcctccacctcccaggttaaagccattctcgtgcctcagtctcctgagtagctgggactacaggcatatgccaccatgctccgctgatttttgtatttttagcagagacggggttttgcaatattagccaggctggtcttgaactcctggccttaagtgatctgcctgcctcggcctcccaaagtgctgggattacagatgtgagccactgtgcccagctaaggcttatttttgtcttatttccttttctggtatagcttacaaaaaagatatgataccaattataagatttctctccccccaccctcccttaccatctctgaaataagaatgtatcttgtagtctctggttacagtttagttgtttagttggcaacatttttaatttttactgttaaatagcagtggtgagatataacattggtgacttggattagataaaatgtaatagatttttgtgtgtgtgttcttacttggaaaagcagagtatagtttctgtgtgttagttaccagagatttttgaaatgctgataaccagtgtatgaagttttaaactttaaaattaacttcatggaggtaaaacaaatgcttagaaacttctgaaactgtcctagaattcttatattctagtagtatccaggtgctggcgactcttatttaaacagaaaacttctgttctttgctaaaaatggtattttccatcattagataaaagtaaaaccaccagccttaaatttttcttttcctttaaaatcatgtaataccttgagaaatgccattgtaataccttatgtaaaattcccaatcatatttatgaaagttaatattattgctatcttattaagtcagccttttattataatgtttctacgtacttttagatgttttgttaaagtgacaacttttagtatgagatgtgcttttgttatgaagaataattcacaggataaaattttatagccacattttttgatttatttaaaagaattatttgataagggggaaactcattttgtgatactaatttaagatctgttgggtaattcttagaattgttcttctgactctgaaagctttttattaatagtctagaaagcatatgactgaggttttggttatagttgagacttctttcatcttggcagacaaagaatcatttctgtggcttttcctctagtcgtttttattgttgctgctagtgaaagaagagaaaagattggtataatcttaatttctgtcatttccacttttctttaacccctttctatcccacagtcagaattccaagtgacagttgagagattgaacagtttagttatgtaaaaatttcagtccttttaccccatggatttttattctggaggaaaagattgagcgtataaaagcagaaaccaataatggtgccaagttgttgtttcttcaggtgtaggaagcagaaagacaacaggtaccaagtaagttaacctgttgataccctaaaggagggaaggctgcatttggatttaggcttgcagatggtcagataatgcaaataaatcatttactaatatttcatttactcagaataagactttttttttttttttttttgctgtgggggagcacattttgacttttagtgaaggagcagcatgacattcttattccagtagatttttaagattcagtgatcaagattattaagtgaaaactataagaagtttcttctttttgccctactgccttgttaaattgtattgcagaatatattgtatatggtttagttttggaaatcatctaggggaggaaacagtaggattggattaaaccaataaagtatgaagtaaagtaaaaatgttggaggagatgcaaactaagctgagtcaggtttatgcaatagagtatttgatgagctgcagaccaagaatactttctaaactggaacttcattaaaaaaaattcatcaaatacttatttactagttgagtatatgctagttgcttacctacatgctgaggttgcagagatgaatgagacttgattcttgccctcctaatatggagatagatatgttaaacagaaagttatggtgaatgaagtttctgaactctatacaggtttagaggaagagataatgcattctattaatatttgaaggaggtggggaggtaacacagggaacaactaaacctcgttttgaaaaatgagcatgaatttgccaaagagctaagagacagtccaggctgagggaatacaatgttcaaagacatgacagtgtggcaagattggcatattcagagtattggtatattgcagaagtacaaaatacaggaaggatgtaaggagtagagaaagatttgctaagacctaattatgaagggctttgtatgctgtgtcaggaccatgaacctgatgcagcatgtgggtaagccactaaagagtgttgcaaggataaatgagcatttagcctaacattttagaaagaatactctggtaggtaggagtaactaaaggtacaatacagtaaatggttaaggtgcaggtaacttagacttaatagtgttatgtctttttgtgagatggcattcattgaaaatatagatggacaaaagccatcttcatgaatgatttaaaggcttaatgcatgatttgtttttcatagtataaacctgatttaatgtacttttgacaactcctatttcccttctcatgtttggattattttttcccattgggaagttttttcctgtgcctcctacaaaacaattcttatgaaatagaagcagagagaagaattagggtattatgatatttgagatgagtaagctgagggccaaaacttaggcattaaagagaagggtttaatttcataaatatgtacagagtggaattttaggacttggatagggcagtggaaaaattaatatcatttgtaaaaaatgattgtaataagattgggaaaaacaaaaaaatgggaaaaaagtaagaaactagcaagattgggaaagaggtgcacagaagagaatgttctaggagaaagaccctaaatctttttggtcaggctgcttggctgtctgaagataagggaagataagggaatactgagggagaaatcccactttggacataagataaattttaacattggggacttgtgtgtgtaccagaggatgccaggagaagtttcaaaggggactcatcttacatgtcatgttctaatgctttataaatagaatgtattcctgttgcttttgcaatttacaatcagttttaaaacattttatatcttgatctggttggtagttacataatatctatctaccaaaattcactgagctgtgaacaggatttatgcacttgtctacgtaaatgttacaccttagtatagaaaaaaaatcaattaaaagagcccatgtttgtctgtctttctttctttcttcctttttttcctttctttccttcctttcctttcctttcctttcctttcctttcctttcctttcctttcctttcctttcctttcctttcctttcctttcctttcctttcctttcctttcctttcctttcctttccttctctctttctctctctttctctttctctttccttctcttttcttcttttctttctttttttttggacttgcgaggtcttagagtctggattctttgtatttgaagaattgaattaatgtaaaggaagtgaggcagattgtcttaaggttatcttttctagtgattaagatttttttcataagatactaattcattttgccagcccattttacactgctactttttctgtgtctcttgtgtagatgtatctctttgttttgtgttttctgaattttttaattatcaagtcttcagataagttattgtcctaaattttgtatctatttaataaccctaaacaattttcacaaaattacatttctcatctggttttacttcatgcaaatttggtaaagttaaactttttttggtgatttttattttagcctaataaggatgttgtggaacaaatggaaaaatggtaagagtttagttttctttttatattttgatgagttacttctaccaaattaactacattaattagagttttaaaattctctttaaactttgtaatggaagaaatgtagtatgctgttgatttgggattacattaccgtttgtgggtttcacgtgtggcagtaattttacttgttgaggctagcatataagaatgaattacttgagtacattttacttgtaaagaggaagtatcctcagaccatgatcaaagatccctagaagcctttctagaattaaaagtttataagaaatgatggacaaaagagttgatccatttaaaatgattagaaataatatcattaactgctgggcgtggtggctcacacctgtaatcccagcactttgggaggctgaggcgggtggatcacctgaggtcaggggtttgaaaccagcctggccaacatggcaaaccctgtctgtaccaaatgtacaaaattagccaggcatggtggtgcatgcctgtaatcccagctacttgggaggctgaggcaggagaatcgcttgaacctgggaggcagaggttgcagtgagccgaaatcatgccattgcactccagcctgggcgacaagagtgaaactctgcctcaaaaaaaaaaaaaaaaaaaaaaaaaaagagccaggcatggtggctgatgctggtaatccccagcactttgggaggccaaggcgggtggatcatgaggtcaggagatcgagaccatcctggctaacatggtgaaaccccatctctactaaaaatacaaaaaattagccaggcgtggtggcgggcgcctgtagtcccagctactcgggagggtgaggcaggagaatggcatgaacccgggaggcggagcttgcagtgagctgagattgcaccactgcactccagcctgggcgacagagcgagtctctgtctcaaaaaaaaataataattataataataatatcattaactttgaaaaatagttaatacatgtgttacaaatttataatttcagcattcaagaaaaagatgagaagttaaagactgtggaagaattacttgaaactggacttattcaggtggcaactaaagaagaggagctgaatgtaaagcattttgtagttttgttttccttgtgattattcagtgacataaaaggatttctctgtaatttgtgtaaggtttttcccatagatcttaaacttaatagtacctctcacatttataaatttatataatgcttttttaattaaagtttttttagaagttaaaaatgcataacattgactgccttaatgaggtagatactattgttatagtttgtcagtttccccacttgcaccaaaattataaccaaatgataactagcagacttaattcatgaaatagtactggaggccagagaagagattgccattctattttatggttgtcattagctttacctaacttgattgggaaaaggttgcgggaagaagtaagttaaaagatgtatttgaatgtagggagaggagtagcttaactaacaagttgtatactgtatatttttgaggttgtccagacatgagtggaaatatatgtggatgtaattgaattaaaaatttgtttggatagctatagaagttacagaattatagacattacagaattatagacatggaaaaaagtgagagttttgggccttccagagtagaaaagaagcagctaaagaaatgagaaactaatgtattttgaagctagctatatttttcagagagtaaaatcatgttttgcttatgtgtctttgaaaaaggcaataagaacagaaaattcatctctgacaaaagaagttcaagacttaaaagctaagcaaaatgatcaggtaatgtaaatttttacaactgttctttgtctctgtgttttttgtttgtttgtttgttgtttttaaattaaaagaaacggggtcttgctcttttgcccaggctggagtgcagtggtacaatcataactcaccgtaacctcgaactcctgggctcaaccgataactcctccctcagtcttctaagtagctaagactgtaggctcatgccacaatgctcggcttttattttatttttttgtagagatagggtctcgacatgttgtccagactggtcacaaactcctggcctcaagtggtgctcccaccttagcttcctaaagtgttggaattataggcatgaggcactgtgcccagcccattctcttttaaacagtgggcaaactgttgcataaaaacaagtctgttgtttctcttcctccaggttggaatatgtcaattatagttttaatttatgaatgataatcagtaatagaggctgcaatttaatactgattgccaggtactgtgacaaatactccagatagggtgccattgcctcttactagagtgataaaaaggttctaagtatacaaatataaagtaagactctagtaaaagaggccgcctgaaattaggcagtttcttagttgtgttttctctatggttggaattattgattaaataattttaacatttatctaatgattttttcttttggcatatttataagtgaccttaaagctacctatgttcaaaatgctatttgttgtcattattatgacattaaaaaagtctcgaaagaatgcctgggcttttcccatttggattttgattgtattggaaaatctaaggataatgtgcatttctatttctgacccatttctattttgaacaaattactaagtaggatactttcctatttccaggtttcttttgcctctctagttgaagaacttaagaaagtgtaagtgataacattattataaactggtttttcttctttggtccattttttttttgtgtgtgcttagaaatctagttttattgtgcagttgggacagctgatgtatgtttaactttcactctataatttttcttaatggaataagagaacttagctgtgctttcccaaattcagtataattaaaaaaaaaaaaacaaaaaaaaactatttccagaggatgggagtcagtatagttgaatggaacttgattctcctctgtattcctcagggtacaaatcttatatttctgatgtacttctgaagcacttaactgacttcttgtgtgcataggcttcagctgtctgttaggaggagctttatgttcaccctggccattctacaaagacatgttgctattttatttaaaatgggaaagggttgatttggagagccatttcattatttggtgctatttttatatcttggtgggtcttggtgatttctaatcaaattatactgcatttctttattgaaggatccatgagaaagatggaaagatcaagtctgtagaagagcttctggaggcagaacttctcaaagttgctaacaaggagaaaactgttcaggtattgggagacagagaactgtgttttatgtttttgtttatcaactttagttaatatcatttaatttcgtgtgtttttgtctgtgcattgcattttatgtcaatttctgtgtttccattgtccaatcttgtctgttttgtcattgtcaaggatttgaaacaggaaataaaggctctaaaagaagaaataggaaatgtccagcttgaaaaggctcaacaggtaaaaatcccagagccatagcatgacagatttattagttgtgttatttatgagctatttgattttttttcttgttactcagaaaaaacttagtatgctgtaggtatattgggttatgtgcttttaattttattttttgcctgatttgagaaagtattcttgatattttaatctgtatatcttaaaaattttaactgttaatggttattttctagaacattttttgtgttaatgtttcattttagtttgccaattacaaatgaaacacgaaacagtttggcaatttttttaatccccctgcccccttctaaaagaaaactgcatggaccaaaatgttatttgaatatacattgctctatctctgccttagaacaaagtacaagtttcattgggatttcagacatagatgtgattactggaaattgatgagttttgctgattttaatctgataaggctttcttgaaaaaatagtgagatttcattgaagagatgattcattcatctcatagattcattcagcaatatttattgtcaaagcagtacttgtcaaagcactgtactcgtgattggtggatcactagctagtgattggagataatgtgttgaatgaaacaggtaggatgaaaagatcatacttttctaatatagattgagagttcaggaaagtcttctcctgaggaactgacatctaagccaagaatctgaagggcctgtgagaagagagtggaggataaaaggtattatcagactgtgtatgattaagaaaaaattaaaaaaggacatcatagagtactgttgagtagttggccttgaaaactgggatggagaagagctctgatacagtagggaggtgtgtggagagttaatattctaattttcagtactgtagaagtatgactggtctgagtgcagtggtgtttacaactgattgatcacaaccagttacagatttctttattccttctccatcccactgcttcacttgactagcctaaagaaaaaaagcatcacattagttagacttattattcataactattttccttgtccctcccccttattatttttagtttattaattttcctgttattggagtcaagaggaggtaaactcaaaacacatctcattttgtcatgaaaaattcagctagtttctttgtaatttgaagtgtacacattataaagacttataaagcttaataagttaaattgaaaggattattaattgatttttctgtcctttgtatttcagttatctatcacttccaaagttcaggagcttcagaacttgtaagtaccatttatctcatttccttttactatttctttttcatgagttaaatagaagtataatgaaaattatagcttcttgatttcaagtggtgttttagaaaatacgaaaatactgattatctcaaaactcctaagggccctaagtttcttatttggctttaacctattaagtttttttgtgggaaggaggtaggaagtcttttcatgatttataatctgaatataacctcaaattgagatgttgctctttgcctattttaatagccatgtgaaattggtatcttccacatccagatcaattgtagtaagttttccaaatttgtttgtattgacttaaacaaggtgatacagggtagaggtacagctaaactaacttactcatgtctggatattcagtgatagaatggttttccttaatcatcctatgcttcctgatttgattgtctccaaaatcttaaatgcctttttttttttttttttttttttgagatggaatctcgctctgtcgcccaggctggagtgcagtggcatgatctcggctcactgcaacctccacctcccgggttcaagtgattgtcttgcctcagcctcccgagtagctgggactacaggcgcgtaccaccacgcccggctaatttttttgtatttttagtagagacggggtttcaccgtgttagccaggatggtcttgatctcctgaccttgtgatccgcccgccttggcctcccaaagtgttgggattacaggcgtgagccactgcgcctagccttgtatgcctttatacttgataagttttagtttagttcaatcagctggtctgtgagtactacccaaaatatacttttttcagtgtctaagatttttgctttttatggtcatgtaacattttcatttagagttctgattaatttattatcagattaaaaggaaaagaggaacagatgaataccatgaaggctgttttggaagagaaagagaaagacctagccaatacagggaagtggttacaggtgagaaattaaaaacaataaaaaatagcctttttatacttgactatcaatttaatttacacctattctttttaaggatcttcaagaagaaaatgaatctttaaaagcacatgttcaggaagtagcacaacataacttgaaagaggtatagtataaacaaattaccaacatgttacataaggaatgataaatctttgtttaaggcattagaaagtaaagatgttaatatgttctgagtttctttgccagaaaaattatgttgtaccatagttttgttgttgtttaaataagttagcttttatttctggcaagtcatacttaactgcttaatctgtcaacctgagcctacaagcatttccttatctctaccttttcaaatagactcttagttcatccttaactatctgtttaaagtattagtctttaatcttttaataagtatgaaaaattgtttaataaaactcattctgtccttgctttataaatgacccaatcttaaatttactgcatataattatgtttttgtttttattggtgggtgattccatatatatgttttagcacctacaacataacatttaatgctaacagcattaaaaatatgattctgtttctcaggcctcttctgcatcacagtttgaagaacttgagattgtgtaagtatgctttaagaccacattttgaagagaaacaaacgtctcattattttccagggtgtgcttgaatataatgatgagtttcctgtacatcattaactttattgttaagtggaaattataattccagacgcaaataggctaagtctctgttgggtaaaataaaggttatttaaatgctttcagatacctggagactttatcctttccaaatccatcaaacccattttttcaattattctttctgcaaatataggctggttttaagttattttttaaaacaaaatatgcaattattatagagattaaacttatttcaaatgaaaattagtatttgaattagatgttagtaacatctctgaattaaccaaaagataatcttagccataatcttgataatgaattttaaacctttctgtaattttaatttatttatagggaaaatggaacttgtcatattatcctgtgctgaataggaaaactgaatctagtcagcataagaggtgtcagtttctgtagatattaatcttagaaaatgttttattctagagagtctgttgtcttaaggtacagcaggttacaatggtgggaaagggtatctggacctgatctttttggccccctttaaaattgcttttaacaaatttttcttggtgataccattactctttattgatatttgttttaaagaagtgccccgttttaaactgtcaagatattgaggatatttattaggttattatctttctaaaagggagattactctgttcttggaagattactcatttgtacaattattgtttgtcttttggctatggtgtaactgtcgaggtgcttatctcttatttgcttggaaagcttagggcctcatttctggcctgtttatagtagagatatgtagaccattaaagtaggtaattttaggtatatttctgccttacattttttttttttttgccattttcttttttaaattaatagattttattttttgtggtggagaactttttatatttataggaaaaagagaaataccaattctccctattaacatcttgcattagcatggtacatttgttacaagtgatgagccaatagcagtacattgttattgttgttattaactgaagttcatagtttccattaggaaactatgtgggttttaacatgtataatgacatgtatctatcattacagtatcatacaaaacagttttactgccttaaaaatctcctgtgttctacctgtgtatccctccctcccttcctccacatcccggcagcaccccccggcaaccaatgatcttactgtcttcagagttttaccttttccagaatatcgtagttgaaatcatacagtatatggcttttctggtttggctcttttcttttctttttttttgggacagagtctttctctgtggcccaggctggagtacatggagtgcagggctgtgatcatggctcactgcagccaggacatcctgggctcaagcgatcctcccacctcagcctttcgagtagctgggactacaggcacatgccaccatgcctggctaattttttagaaacagagtctccctgtgttgcccaggctggtcttgatctcctgggcttgagtgatcctcccaccttggcctcccaaaatgctgggattacaggcatgagccaccatgctcacccttggattgccttcttttacttagcaatatgcatttgagtttttccctttttatacatttatctcactcttcatgtatgctgttttgtcatttttttcatatagatttataagcatcttgaaattctggatcaaggtgtggtaaaaataagtgttcagctcaacgaatacttgagactctattatgtgctttctggcattggggataccgaaatggataagatttcctatcctgaggaaacagttaaacacatcattttgatggtggtgttatgctagcggtctattgcttaggatgaccagggcaattgagattcacttgggctagatagagtaagatttacgtcagcattgggtaagggaaaaacagattaaattatccatagcatctcttcagtacaaaggttagacatattttgtaatttccagggtcaacaaattatgactaagattcttgggggcaaaactccttgcttttgaagtggtaatttttgcaacaatttgataaaatatagttttgttcttagtttttgttttagagtttcttcctagataaagccacatttgcttaagaaatgttaagtatgactgagtagaatgatcctagaaatatcttttaaaacaaacttctaagttggtataatatgggggaaaaaaagctggtatgtattgtttctgccatcttttttcttaggggtgatattggagtctggttttccttttttatgtactttagttaatgcagatctttgtaaaaaattctaggttgaaagaaaaggaaaatgaattgaagaggttagaagccatgctaaaagagagggagagtgatctttctagcaaaacacagctgttacaggtgaatatggtgacttaaaattaattattttgtaaattattgtctttgcatgctttaaaataatttttaactgctgccaaaaaatagagtacagaatgagtctccctcccacccagatactaggtgtcattattggcatgttttttgagtaagtacccatgcataaaatgtgtgtatgtatgtatacttgtttattaaatactctgttgaactatactaacttgtatattttgctttcttcacaattaacagtgttttcaagatctttccatataaagcacatttctgccttaacttttaatagttttatgatattggatggttatatcatttattttatttttatttttgagacagagtcttgctgtgttgctcaggctggagtacagtggcgtgatctcggctcgctgcaacctcctcctcctgggttcaagccattctccttgccttagcctctagagtagctgggactacaggcatgcaccactatgcccagctaatttttgtattttttagtagagatggggtttcagcatgttggccagactggtctcgaactcctgacctcaggtgatcctcccacctcggcctcccaaagtgctgagattataggtgtgagccaccgcagccagcatatatcatttatataaccaattccagttgatggatacctagattatttagggctgttttttctgcacaaacagtgcagcagtgaatatccttgcacatgttttgaatacttttactagtgttatctgtatcctagaagtgaaattctggatcaaggcttatgtagcttttttgtttgttaaaagagatagttaaatagaaaatcaatatcttaccttcatgcagttagtattcaacttacttacagaagattgatttgaagtcatagcaaatgtgtagatgcctacattgtcttggattaatcttgctcacattacatgcttcaaggtttgagtctaccacattccttctccctctcatgtaggttcattttaaattttgttagacaatgctagatagacctgcaaaagtgttttcactaattgacactctcaccaactaagggccatttcaccttcttcctttccaacattgacaaggataaaaatttttgatattatacttgaaagatggtaagattatttttaatttgcatttgactgcgagagaagttaagcatttttcgtatgttcaagccatttttatatgaattgtcctttaatttttcccacactttttccactgagttgacgttttttttttttttactaatttgtaagatcctttttatgtaataagggaaattaaataaccttttgttattatatgaggtgatttattttccccattttttcttctgacttcatttgtgtttttcccctttttgggaaatttgaaacttttatgtactcaaatataagtaatttctagagttttaagtctctggaagaaaggtatctctctacgatcataaaaatgtattcggctgggtgtggtagttcacagtagtaatcccagcactttgggaggctgagacaggtggatctcttgaggtcaggggttcgagaccaaacatggccaacgtggtgaaaccccgactctactaaaaaaatacaaaaattagccgggcatggtggcaggtgcctgtagtcccagatactcgggaagctgagacaggagaatcacttgaacccgggaggcagaggctgcagtgagttaagatcacaccactgcactccagcctgggtaacacagcaagactgccatctttaaaaaaaaaaaattacattttcttctaatgtgtttataattctttttgtttgtttgtttgtttagcttatttagtgtaacttatttcagtaagctgtaacaataacattgtaaccattaaaaagagaaggctagccacattattaaataatccatcataacagtagtaattccgttccccagggggacatttgtcaatatctgaagacatttttggttgtcacagctggggcaggcgggctggggcatctagtggatgggtgccatggatgcttctaaatgtccagcagtgcataggataaaacccccacaacaaagaaaaatatgaaacccaaaatgttactagagttgaggttgatttgaaatgtcacttcatactaaattcttagagctatttcggtatatttctggattctattttgttccattgagacatgcaaactccgcagctagtactaatataaatactctaatttcatcatatgttttaataaagagcttattacaccctttaaaattattgctattttggaatttttctagcttgtatgatctgtttctagcttgtatgatctaagtttatgtggaaaaaatctgtttagatactgatgtttaatttttatttaattaggatgtacaagatgaaaacaaattgtttaagtcccaaattgagcagcttaaacaacaaaactaccaacaggtaggtattattagatgtcttgcctttcacttacgtggcaaaaaaattatataaccagtgacatatgagtatttttgccatttctgcattttcattgagaatgaagtatgttttatttatgtttatcaaattttatataaaagaaagcaacttgctatgtcatatccaaagtaaaacaaatctataaagtatacacaaataatattattgccggtattccagctctgttttgtattcatgtgtgttttctgatcctagaattcttagcaagtcagtttaaatactgtagaggttgggttaaagatatgtgtacacactcttatctcccctcttcccaaatgaaacattagtaactggagagaaactaacaaatgtatcataagcaatagtctactactatttaaaagaggttttcaagttataattctgcttggtaaatcaaaagtgtgtttttataaaagatgctacccaaaatagcctgtaaattaatttatgcatgtatatggatagacttgatagtattttgagaaacaaatgaattggagtccttgcaaacaagaagcttgagagattattgtcaccaaggaataaataccatatatgaagggctgtgtacctttgcatgttgatgtataaataactttgttaaacgtgaggaaacataacttgtcctagttttgcttttgatttctgttttttttttttttttttaacttggaagcttaacagttttatgtagtcaaatttgaattgtgcagtttgaaaatgtaaggtgtgcttccatgcacatagtgggaaattgataaatacttattaaatgaagagttcaagtacgttgcgacagtagagattggatttagcattccatacattttacagatttgtacatgtttttattaaaatcacttgattaaagtcagggttactggcatatgaaatatatactatttttacttttgttgttttcttaatttatatttgagaaaagcttcaatgtttttaagtctcctgaaaagttttgttctgaaataacatttaactcttttgataggcatcttcttttccccctcatgaagaattattaaaagtgtaagtaataagtttgagtcacagtttataaagtcgtaactatttttatgtggtaaaccattctcaaataagcaatttagtgtaactgcaaatggcacctgatttttacagttctatttggatatcttgaattgcagtttagagttgagtagtacctttggctaagatgctttttttatggtatttggatttgaatattttgttgagggagatgtttgtttttgtttttttaggcattcagaaaacatcaaatcaagttaaactatactttgcagggttttctaaatcaccttctattatgtcagttatcttactgggtcttctttcttctagatgtgattgtgtaattgaatgatgcaaattttgtcttagcttcattttttaaagaaattttaggatagatgtggtagctcacgcctgtaatcccagcagctggggagactgagacgggaggatcactgagctcaggggtttgagatcagcctgggcaacatagtcagacctcgtctctacgaaaagtttagaaattccgggtgtgatggcatgcacctgtggtcccagctactcgggaggctgaagtgggaggatctttttagcccaggaagttcgcaccattgcactccagcctggcaccaagaaaaaaaaaatacatacatatagtctttatgattgtctttcttaaggagtttttttttttttttttttttactgatacctttttcttgttggcctgtaattttctctgtgaggctacatttaaggtcatttcacataagttagtgtgtttcaacatgttaaaatgtcaaccacattaagtatattaatagatgatgtaagtgatctatcattgggaatattgttaattttttttcttttaatctaaatgtttttccatcttggttggtttacagagttgcttgtgtactaggttagaattattgactattaaatcgagtcttgagtttgactatatagagaaaaggttggcaaatattttctgtaaaggccctgatagcattttaggcctgtgggacccataggtctgttttatacatgtgtatatatatgtgtatatgtgtgtacatgtataaataaaacaacactttaaaaatgtaaaaacagctcttagtttgaggacctacaaaaacagactgtggagtgggcccatagccctagtttgccagcctcttatatggacactgattctcagggaagagctatttgttatttaactttctactccagccactctcaactataacagaatcaaattatgaatctttgccattgccttctgcgtttctgggaaacagtagcagaaaaaaacatgaatgttgagattggtatgaaaatggcaggaaaacactgagctcattttaatattatacttttgttgtgggttagccatttaaagttataactgattcattgccctctggaaaaaaaaatatatttaagggactgcttctacatcagttttaactcctctaaaaatagctactgtgtactgacccaggtaaaactataaatagctacaacagttcatatcttcataatatgtttcttaggggatgagatttctctttagcacaagcctgagcataccatattaggcataaaaacttatattagaaatcatttctgaaattcataggatgggctttgtatggtcaacagtaggtagactctttaatgtacttttcaaggtgctatctcttgatatttttattttgtaatagcaaatgttgataggtagggatctaagttgtattactgtttacctaaaatcttgctacatgtattcatgttctggtttagaatttcagaaagagagaaagaaataagtggtctctggaatgagttagattctttgaaggatgcagttgaacaccagaggaagaaaaacaatgtaagtagatctttatcagaatgaagcttttctttttattactttaacactgaaatatggttcaggaattttttttaaatctacttttactttagatttcttaatctttgtaagaaagtactattttctgtgtgtagttttttcggggggcggggcattattggagaacagttttttttaaataagtgaaaagatgaattcttattcttataaatatttaaatgttgaagctataattattatacctttagttattttaaaaagctaaaaatgcaattgactttttgttgaacttttatttggaaaaacatgtttttcagcttggtattttaaaatcaaagatatttcctcttagattgggctggcctttttgtaaactaaaagtaatgccagtattcaaacccagtatactcagtaatggggtcttttgaaagccttctggaacctcctcctgccctttttttttttttttttttaagacagggtctcgctctgttgcccaggctggaggtggcttgaacttggctcactgcaaactcggcctcctgggttcaggcgattctcctgcctcaccctcctgagtagctggaactacaggcgtgcaccaccatactcagctaatgttttttgtatttttagtagaggtggggttttaccatgtaggccaggctggtctcgaactcctgatctcaagtgatccacctgcctcggcctcgcaaagtgctgggattataggtgtgagccacggcacctggccagaacctcccatttttaactgagaggtggttcaaattttggtaattaagtgtgttagaggctttagaacctgactacatttatactagaaagggaagggatagtgctttcagaaatatgaaccctaataacttactgaatagacaaacaatttagtggaatttcttaacttttctcataccagagggcaacacctgtaagtagagtccaagcattcttgctagagaagaaatttttgtacactgtagtgtgattgctaagacttgagcaaggataaaatgttactgaaatctaagggagtattgctagtaaatggatgtgtgttttctgtttttcaaagtttgtgttaaattgttaatttaacaagttgacattttcttgtacccctgagtttgtcaaaattaggtacatgaattgccacttctgtgttggtataacagtactaacagcattgcttagccacaaaacttgaggtgaacttgccgatatactgctaacatcttaactgtgttttattattggacttctgagataaggagggcatggtaatgcagcagcagcagcagcgctggagacattgaacccgtgtgaaaagagccaggacactggaggccagcagatagcagtgtcagtctttccttctagttttgccacttcgttttctgtgtatacttggctcagtttcctaacttacttgagctgtggtttccctatctatagaatgggaataaatacctcatggggttgttgtaacggtgagaatttgtgaactgccaagtacagtggttggcatatattaagtaataaatggtgattattggctttttatttttcgttgttggtttttatctgtttagatttctcattctgaaaaaaaagactgaaatatagcagattatatttgtgaatgaaatgctgttaaaatccagatctctcaatttttaataacctctttcgcctccaagagaatctattttatagccttccagccttcccctttgctttgatcaactagctcatacaattcatgtaaggttgttttgtggcatgaatgtttggccatgccaagaaagacataggacacagtgggttactatgggattcctaggtagatttgaaacatgttaattgtattaaaccatagagaaaaaacgttacactgcagtggaaagtcctatgagtgttattgggcctcgtttaaacatcacatgaaaagctttttataatacttctatatttgctctgtctttaatcttctaatgttcaatgtacctgaaatcatgtatgtattcttggtttgtgtctttacttttgaatgctttcttctttgtcacatgtgcatagtaattattttaaaagctggcctatttgatatatatactaaaacatggaaagtgggcgtctttattttctcattcaaacttctaaacattgctttttatttttttgctaatatgcatattttcccattgaaataattttgcagtaaccagcatttaaatgcagtgcaaaatactgatgaagtaaaaaagcaaaaatctttcaataatggataaactgaaatcattctttctaaaaatgattaggaccttcgggagaaaaactgggaagcaatggaagcattggcatcaactgaaaaaatgctgcaggacaaagtgaacaagacttccaaggttgtaatgctaactcctagaaacaatccactgaacagagaaaatctgcagcttgtcttaaaatcagactaaagcatttacttttactgcaatttaaatataaaatctccttatccatatttatcatctctatcatctctgcttttttcatctactccttgaagctttaattttgggcatgctgatttgttgtgattacctgattgtttgggctttgttgagcacaactttaagctgaagagtctcagaagaccgatgttaacctcttgtcagacaatatgcgccttttgggttggttaagataactttcatgaaaactttgaaccaaagaaatctaggtgaattaacaaacacatttgaatatgtaggatgtgccataaactaggtgttttggagggcacaccaagatgtctcagataaggtagagaaatgatcaaagtcttaaatacaggaaaggcatcaactttgggtgtgttgcttggaatggttccttagaggtggtggactgaaacttcatgtattactggctagcaatgacacatggcatgtttagatgaaatattactatcaagggataattctcttgaccagagtatgtaaagtactcctgaaatatatagccccctctgtcttcagaacaatggaggacattctccttgagctcaagttgtaccattgggtgtgaagatttctaatgaattgtaatagagaagttgtttttaaagattgagaaaattgaatctgccagtccagttaagtattttgaaaattcctgtcaagtgtaaatgtgaaacaggggtattgaattttgcagacaggtaaaagaaagaacctacatgattaattttagcactatgaaaatattttgtgtgccatggtactctattgaatctttaatataagtcttagtgacacctgaaggaatgtttaagcataaaatagttctgtaaattttttttttttttagcaagtatacgtttgtagttacatttcctgtagcttagtggatttgtatttaactatatccctatttatctagccataattttcagtaaaggttaaattcgagatagctgagaggtatattgggaccagagagtaggaaaatctaggtcagataggacatttcattattatttcactgggagtagttgcaattgtacagtcatttctgtcagcgatgagggttttagtgtggtttctggttgtttatattactttgtttttgatggttaagagccacctttttggttttatttttttagtgggactgggtatgtgggtgctaatcacaccattcctacaagaagttacatgctacttgccataggcatttttgcattttatgattctaaaagaaagaatttttgtgcataatgccttcttgcatagctaaagatctacagagaatagaattgaaagtcttctatatttcaatggaatttagacagtccttagatagcatacgtgtaaagggatgttgattgacccagtgccataaattatgttgtgatgaaaaggaactatgtgaaacacttttagtattttaactagaaataagttacggtcagcttacctaaaatgtaaagaggatgatatatgctgtctttacaggattatttttaaaggctaaatactcttgaggagctactgaaagaaactcttatacatttcacttaaagatggtatgcaaattatagttcagttttcaatattagatctttcccagatgttaaagtggaatggaaattgctgtctataaccaaactactgtgtcagatgaaaactacttagctaaaattgttaataccaaataaaagtaacttcccatgtttgtggctcttggttatgttagatactttgttcttttagttagtctttttttttccttggaaagttttcaaaaagctgttcctcagtgtctcttttcctaaccggttttctttaaagattagtactttggtcaaatgataagaattacctcttaatgtccttgaaatagcattaattattttccttattttatgcagttaggtgtattcctgaaaattagtggacttcattgaattattgaaaatatcctattaaaacacctattgtaaaaatactgctgctgatctttaacagctttttgtgtgtatggaaaatggcaaaatctgtagctgttgtgtaaattttcatgtgattagattttctaaaattgaagtgtgtagaccttgaatcagtgatagatttcaaatttcacatataaatgttgggggaaagatatggttgagatgtttctagcttgcttggcttcttgtcacctgttgaactttgtgactgttgtttttagatgattttcttggcttggtttagatgtgcatttttataggggtcttttttttcaagtcttgtggaggtagttgaaatgttacatttttttttttggtgcgtgataagtcattaccctaattttgacaaaccatggttttgagtttataattgatatccattagacttggatttaatatcagcacatttagacttagacatttgtaatatttgtaaatttatagcagagtccatatacaagtgtcagaactagtttttatgatgtgtggcattagtgaagtaatatgccatcagttgctccttgttctttctttttcccatttatgtcatccatcagattttgatggtcctccttgtttagcataaatacttcacatgaccttgaagttggaaataagagagttaccattttaatgccatgatgttatatagtccatcagtgatgcattttttaatagagatataccagccaataaagctcagttgtgttcctccaatgtgtattttctactataggtagtttataaagttttagctataagaaatgctttttgtgtgtctgattttgaattgttcctggacaggcaaatcacttgatttctaaatgccagggaaaatgtccatattgtcagatattgctaaggcattatttgatatttaggatgctttagagattttgcagattttttcttatgggagcattttaatatcttaaagtgggaaattttaatatttgttagtattaaaaattttttttaaactttttcttcccgtagaattataaaacactatagtttttttcttttctttttttaaaaacattctgtgatcttgtaagtttgatttggctcatcttctgctttaggaaaggcagcaacaggtggaagctgttgagttggaggctaaagaagttctcaaaaaattatttccaaaggtgtctgtcccttctaatttggtaagactaatttattatttttttaacatgatgacattattcaagaaaggtgtgaataagcaacatcatttgcactccacttggtttcagtagagtgctgatttcttgatctttcctattgttaagctggtgcttttcagtaaagattaataacttggttcaaaactcatttctatttacctgatactattgtttctataaaattttatatatgagacattagaggattaaaaacatcatatttgggaaagaaatgttttttaatgctaataaaaccaatatggtaacattcttaatggctttatttaaaacttaattttaagtgattgcttcttagttttagcaacacttccttaatgtacttgatactatgaactaggctctttacattttaaaactcaagatttttggtcatctattaccttcttcaagcagaaatcttacagataatatagaacaacttggtttacttgaggtagtacatgttctcctttgttcagagaattaataattatttgagggcagagaaagtcagtgaatgtgcatgtgagtttcctaaaatagagtgtagggtctttttttttttttcttatttaatggaaaactgttcaacagtagagagacgagcataatgaggcctgatgtacccaacatctctccatagcacttatcagtacatggcacgcatataagcaatcttcttttagctcccaccttgcattccctagattattttgaaggaactcaaacatcagagcatttcttctgtaaatatttcagtacacatttctaaaacataagcatttctttttaaaaagtgtgatattacacttaaaaatacattcttaattttgtatagtatgcatttctccagttgtcataaattgtctgttttattaaataataacttactgtagtttgttttaatcaggatccgaataaggtcagtatgtaactggtttgagacatctcttagatattttttaatcctcgggttccctgactctttctcagcaacaccccacctcctttaaaaaaaaaacaaaaacaaaacttagtggtttcctatgaagtttcccacagtttggatttagttgactgcatccctgtggtgttagcatgttcctcttttctttatgtatcttttatgtatcaaatctgtaatcaggaatctgattcctggtcagattaaggctcagtattttgggggtagggtagagtaggggcaagaccacttcatgggcggtggtgtgcactttcatgaggagattcgtaatgtctgcttgtcttcctttggcccattggaacttatttaggtttgttaccaagtcgttttgacacaatgctgctaaactttgatagcttctatgctttgtggtatgataaggtgctcctgatttatcatatacatttcctgccccaaacatagaatcaactatttctccaaggagctctgtgggtgctaggggtggggtaagtaaacttaatggcttgttctatttgtagtctgagttaagtatagcctacatttatttcaagtaaggagagaaaactcctttgtttccattgtaactatcgaggatatgttccgatctgatcagtttaggagatctctaccacttttgagttgaactgatgaaatacctagcactgagtaaacgtatagatacactatcagttctagtgctgttgttaaattgaacctaagagaaagggttgctattaatatattcaatttttttttctttgtggcataacctgtttttgtttctactttatatttatggaaataatactgggggatgtattttttggcagtactttatgagccaagagaattaatgattgataatttctgttcttcaaagattgtataagatcaccagcagtaaaaattttcttttctaacagcaatactacccactctcagtaaccagatctttttgacactagaaatatttataagtcatcataataaatggatgatactgtttggcttttgttcatatacttgtcaaaagttgaatatttctgcatatagtctacaagaaatgtactaaactttctatgtgctaacattagagtctggcattttaggtttgtaaagatttgaaggacaataaactatttatgttataaaataataaagcaataagcttcattaatattaagataagtcaagataattagtagatataaaaatatataaatttttttactgtttcctcttgctgttttgctgagcagtcaacataggagagatctaaattatatgacctagaaggaaatttacaaactttaagcaacaaaactagttttttatcttattttaatttatgttgggtaccaatagttgaaactgttaagtaggattctgatagtgtacatttagtcttggttcagatttataatgtgagaatgttaaatagtgttttaaaactaatttgatattaaaggtattgtactatggagtgactcagcatctacttttgttttttgttatttgatagtttccagagaatcctgattctgctgcatatgtaacagtttatattatagcagttaataaaaatttcatgagtttttttcttaaatttaatccaaagacttaaaagaaggaataagaggaaatttgatttaaagtatgtaacacacagatacactttatcaaagtgtaaaattcagataagcatcaataatttagagtaatttattctaaaatttagaataaatgccaaaactgtaatacatgcatatttacatcagctaacctgtcagcacaaattgagtttttgttggatttaaacaagtgaatgtgtatgcatatcacttctcattaggatttttaaaatactgaataatatttcctaatttgaatgaaataattttagagtccttggagcattttcacagaatttgaaatcctccaaatggaacatctttatgaactcaaaatacttcactttcactttatgaactcaaaatacttcatttttgagaactgatttacctggaaacagttttgaaaaattagtctgggttttttgtgttttaaagattatttgtcctggtgctagtaagtggtagaggccagatttgaacccaggtttttctacatgcaactgcagaattcagttgaaaatactcttggttaggtatataatattttattttgatggtaggtacataggtctgtttttagtgcttgtttttcaaagtgggttatgtccaacttatgcagtagttacattcctctttgaaatttgtagcaatgtcctgtttgtctgtgtaggtttcttttataattatctaatttggttattttaaatgtttcacctgttttatttggattttttttttctttggaaattaatgattttaacttttctcgtccacagagttatggtgaatggttgcatggatttgaaaaaaaggcaaaagaatgtatggctggaacttcagggtcagaggaggttaaggttagttcagcaaatgaactgtttgtaatttaaacatagaaaaaagaagcaaataagattttgtcttcataagcttggaaaagataaaagataatcgaataaggctcttttgagaaagtgtaagaaggtgatttcattttgtttaaattttagttgaaatacagtaagttgtctttgcatttgatttgtttacaaagctagtgtttgccattcctttaactctgtattttaattgtttctaaaattgaatatttatcccttactatctttttagcctaggtttaaaaagtaaagattagtcgagataggtagaatctcactggtttgctgaagcatccccaaatacgtcattagaggtatttagaaactggattggtttttatccttggctactgaaattgggggggatttattattattgttttcttgtatctcaagtggcatgaataaaatcctctttcccatgtgtgtagcataggcattgtgaccatacttcacatgtgggtctgctttgatcttaccacctgactaaagactttagtaccaagactatttattataacattgtttaataaaaatgaccaaaagggttattgaatgaacttcatcgctacttagaaaggttgaaatgtagtgtttccttataaaacactttgaaaccatttatcataatacagtattaagtactaaaacaaacttgaagcataaaactttctggtagaattatggagtttttctttatttcgttctttgcaggttctagagcacaagttgaaagaagctgatgaaatgcacacattgttacagctagagtgtgaaaaatacaaatccgtccttgcagaaacagtaggaaatgatttttaatctacattttgattttactttaaatcattaccttcttccttcatggcctaaatagttttatcttggcattagaacatgaatttttcaaaacaactatgcttttgtctgtaggaaggaattttacagaagctacagagaagtgttgagcaagaagaaaataaatggaaagttaaggtcgatgaatcacacaagactattaaacaggtatttacaaaagaaaagcttagagcagtggttctcgatgtgtggggcttgaaccagcagcatcagcatcaccatgcacattcttgggccccaacccagctaccaaatccaaaacatgtatgtggggtggcagcagtctgtgttttcatgagccctccagaatagtctaatgcccacccaagtttgaaaatcactggttttaaagtatgactaaagggtaatcatatagaatgtagaatgctagttacagaactattgtgtgataaggtaaagaatactgggttcaaaatcagttttaaagtatttaacccataatatagaattcaagaaaaagtcattcttctattcctgggacctgaatgttattttgcaaccttaatttttctcccttttacttcagcgtgataaagagtaccattactcacttattttttggggccaatgtgcagaatttacagttgctgatggtactctaatgcacttgcagaataaatacagctgaatatcagttaatactaataaaaaattaatcacttttagccgagcctaatatacaaatggagtaggtttggaccacaatttaaatcaagttcaatgtgactcatttttaaggtcttttaaaattcatctcttttaaatgagatgcatttcaaaaccttggaagtgtcttttaattgatcagaattctacaggatagaaactgctatatccttggtggttttacttggccatgtaattgtttcacatttcagatgcagtcatcatttacatcttcagaacaagagctagagcgattaagaagcgaaaataaggatattgaaaatgtatgttatttgattgttttacttgtaacctatggatttgtttttagcattaacggttgtctgaagatctatagtttaagattactttatagttatgctcttaatatcttgggtagtgtttgagttgatatagttttatattcataagtgtcataattttgtcttgtggggaaatattatgaaaggaaattttaagtgtgttaacttttcctttgttgcattgctagctgagaagagaacgagaacatttggaaatggaactagaaaaggcagagatggaacgatctacctatgttacagaagtcagagaggtacttacaacagaatcttttcaaacttgcttctcaattcagattaagtttataacagtgatatttcagtataagttgtttgtggcagagcttccgagtagcatacaaaacatgggctatcataaggagatcaatcttaaactctaaacttcattgcagctgaaagatctgttgactgaattgcagaaaaaacttgatgattcatattctgaagcagtaagacagaatgaagagctaaatttggtaagaagcttgtcctccactgggtatcaagtaggcactgaaaacactttattgacatgtggagaaaccatccaggcttttttttctttgctaacatctttagcttggcctttttgtaagtctaagataatcttcatattccgatgattcctaagattatctttcttttcttgactcctaaaatgatccttcttttcttagctcctaacaatggcatgtttggcttccaactctttttcaaaattttccatgttttataaatcctattttctcaaacagcagtcttttctgtgaataaagaaatgaaataaagattggctgagttacgaagattttcttctcagactatcatagttaatggggccttttattttctaacctgggagaagattatattgaaagtcaaagacacatattcttcattcaagggcagtaatctaatccagtttctaattttaacctagtctctctatatattacaaatattaaaaagcgtataagagtctttattatcaacatattatttagagtatagtaatcctaaaagcataggctttgagataaagttagctaaatgtcttaaaacatataataccctgtattcctattctcaagttttctaaaaactgtactgattgtgacagacttagctattagacaaatatggctgtcttgctctctgtttcaaacagcaattgttatgtcttccttgtgagttaaaaattgttacagcacagggattagattttttttttttaagtaccttaataaactctcagaagattacagtagtaagttttttccttacccaaagttcaccctgcccagtttggaattttcttgttagcattactccatgtaccaagaaaactttaactcattcatttgtggttggtatcctatgttatggcaaacatttatgggaatcaatttttagagtagagcggtatgaaatacaggttgcgtattctttatctggaatgcttggaaccagcaattttggggggggattttggattatttgtattatatgcttgctctgtatgtgtcccttatctgaaaatccgaaatctgaaatgctccagtgaacatttcctttgagtgtcatgtcagtgcttaaaaagtttaggattttggagcatttcaaagttcagattttcagattagggatgttcatacacacagagccctacacacacagagccctacacctctaatttttaaatctttgttttatgtaccaatgttttactttaactgaactcattcaccctgcattgtgagactggttctatgctatgcattgcacagattaggactgtgatatgtcatggctataagtcctcactctatgtttttaaaaaatcatttctaactagttgttagagttttacttattaactttggtgcttagtggctgactcaacagttacatggttacatctccacttggcttaatgctttattttgattttttatccctctacttctgtcaggagatcatttttagtggttgatacttactttttttccctagtcttgagtttgggatctttattttaatgtttgtttgctcagaataactgctgctactttttatgataaaatagctttgtttgcctgtacgtgctttgtgtattcttgggccaaaagattaatttctctgatggagaatattaaaactcaaagttgtgtaaaggaccagaatttatttgggtacttacatagaattcctcagataaaatttccaagtggaatttccctccgccccactgccacccctttttaattctccctccaattttaaatgtcactgccttgtctttccccctttgggcctctagaactgtttcaaaagtgcccatgggtgggaagcaaaaacaattaccttatgagaataagaagaaagttttttgggagcagtatagttcattttccttgctcatatttaattggaaaatcagagaagcggcattatatattcgcattggagttacagaactttctgttttgacagattgggttattcataggtatatcgtaaagcatttcttgatggtataatacaggccagtgtggtcttgtactaccccttagtgaagccttaaacgatggtcagtattttgggagttttaatttgactggatttgtagtcttctattcagtgtttttaaaaatattgtataattgactctttaattgaactgtatagattaagaaagcctttaaaaactaacgggtaaagtatctatttggcttttaatttgaaataatttcagtgactgttataaatagtgatatctttaaaaggtactttactggaatttgatggttttgtttttgcatttgcagttttctactctaaactgtagttcatttctgtggcttttcttatgtttagctttacagatgggaacctctactgcttagcctttctatacatctggtgcagcatattggctaatccactgtacataataactgttagcagtcccattcattcttcagtcctagaggtatcagcataatcaaagaatgatgcaaattaagttaattgtggtgttcctttatttttacagttgaaggcacagttaaatgaaacactcacaaaacttagaactgaacaaaatgaaagacagaaggtagctggtgatttgcataaggtaggcactgttcgtcctagagatgtagtatcatgagcctgtgttgtgtgttcaatcttaagcaaacttatgctgctaattctggatttgttgttttgcatcataatattaaccttttataaatttaagctgcttgttattagttagtattttggaatgaaacgttttggcttgtttttccaggattcttaattcacctcattatttcctcacatttctataattaattgctttataaagtacagagtaaaatttagttggagttattaaaatttggctgcatccatatattttttaaaattgggatttggctgtgtattcatttacaaagtatgtttctcttggtcttttggataaaacaaagatataaatttctattttttttagatgtttttccttcatttatttcttcatacaaatatatttttcctaatctcaatgcaaatgaatgatttttaggactgcatttctttgcattggtttgacaggttatttgtaattctgttttgagatctatttttaatagtagaattcacatattcttatatcaaagctgttttagagctatgatagtgtttatggatatatcatcattagcaaaacaagtgtcactttttggaattgcaagaacaagaggtacgcacttaaattttgatagtataaaatggaatcccagaaacccaacagtagtaatttatactcctctcaacatggtatgagaacatgtatttccctataccctcaccaatattagatactgtctaacatttaaatatttgatattctaatagattttaaaagttatctcattttaaaaaataatactccttttaaagagttgaaagaaatttttttttgattctatatgcttatagtttataattgttatgtaaaagtctaggaatccacaagtgttgtcaggttattttagtgtagacagaatgtgaatttgggtctgttttagaggacaaactttgatgcttaatacactgttgtggttgagcagtcagtttactttgatacgtgattttaatttttgacctctggatcaaaatataaacatggaatttagcctagcaatgtagtttcttagaaagtactttaaaaataccaaactggtgctcaaagttatataatagatataccatcttatttacagtagctaagatggcaatgataggtgacagttaactgccccatacctatacagtagaaatattgtgcaacatttgattggaaaagcacataaatatttgactaaaaaaagtttataacggctgggcatggtggctcacgcctgtaatcccagtactttgggaggccaaggtgggcggatcacctgaggtcaggagttcaagaccagcctggccaacatggtgaaacccccgtctctactaaaaatacaaaaattagccgggtgtggtggtgcgcacctgcagtctcagctactcaggaggctgaggcagaagaattgcttgaatccgggaggcagaggttgcagtgagccgagattacgctactgcactctagcctgggtgacagagaaagactgtctaaaaaaaaaaaaaaaaaaaaaagttaataacatactttgtaaaataggtaagtataaagcagtatgtatgttaaagctcacttatgtaatattttctataagcacataatatgtagagagggatctaaactaggggtggacaaatcccaaagcttttttagggtttgtgggtcacatatgatctctttagaatatttttgtctcctttttaacataaccctttattttattatatattttttgagatggagttttgctcttattgcccaggctggagtgcaatggcaccatcttggctcactgcaacctccgcctcccaggttcagttgattctccttcctcagcctccctagtagctgggattacaggcatgtgccaccacacctggctaattttgtatttttagtagagatggggtttctccatgttggtcaggctggtctcgaactcccgacctcaggtgatccgcccgccttggcctcccaaagtgctaggattacaggcgtgagccaccgcgcccagcaacatggccctttaaaaagtaaaaaatattcttagcttgtattctgtacaaaaacaggctttgggccagatttgactaacctgtaatctagactaatactaacctaaatatcaactatggttatttctgtttttaaatttctttgtatagtttctgcattacttaagcttttaaaaacagtgaacatatgttcttataatctggtggggggtgaagctattttcattttggagggaaaaacctgtgtcgtcttttgagaggagcttttatcttctacaaaatgaataaaattattcattttttatgtatttatcaactgtattacttagtagctaccatattgttttccttataggctcaacagtcactggagcttatccagtcaaaaatagtaaaagctgctggagacactactgttattgaaaatagtgatgtttccccagaaacggtatgtattttcttcatccccagatctctgagctagttaccttgtgacctgtgtaaagaacaaaaatgtataaggtccatctccgaaagtcatctttcttgaaaatatcctgtccctaaaatgtagtgttttcattgatgtttgatctcatttttgcttattgaggtatgttaattttaagggttgtgttgagaggtatggagcgggggtccccaattcctggactgtggacaggtaccagtcaatggctttttaggaaccaggccacacagcaggagatgagtggtgggtgaatgaccattgccgcctgagctctgcctcctgtcagatcagtggcagcattagattctcataggagtgcaaaccctattgtgaactgcatgctccttatgagaatctaatgcctgatgatctgaggtggaacagtttcatcctgaaaccatccccgcactcacccatctgtggaaaaattgtcttccacaaaactggtccctggtgccaaaacggttgggtattgctggcctagagtatagactctggagctagactgcctatgtttgaatcctggctctgccacttagtagccatgtgaatttgggcagatctttagccactttgtgctttagttgccccatctgtaaaaggcaatgataatagtacctatcctgtagggtttttgaaagaagtaaatgagttaatacataaaacacttaaaatagtaggtggtacttacaacagtgcctggcacttacttactaagagctcagtatatgttaactttttttactgtttggaatgtactttcttttgcggggcaaattttctttttctgaaagaaaaaatggatatatttctgatattcatagattctagattttttttccttttgtgtccaagtgacaacatttataacatagttttctttggtgccaactagtttgcaccactagttagcaaacagtatttctctatgtggtttttgttattgttgattttcatgtcattgttcagattttttaatgtttgtgtttaaatcagcaatataacattttctgttgtttggttttacatttcttttccttgtgtatggagtttatcatcacttccatcttctttttaggagtcttctgagaaggagacaatgtctgtaagtctaaatcagactgtaacacagttacagcagttgcttcaggcggtaaaccaacagctcacaaaggagaaagagcactaccaggtgttaggtaaggacaactgaaatattgctgtctatgggtaattgatgttatgtgtctgtgtaatgtgtatttacataaataaactcacttcactagaggaaatattccttctttatctctcagaacttccagatgacagccttaagctttcttggagctttagttctattttgtgcatatcttgaaggtcttgtagcttggaggggttatctgtgcctcctttgacctttgtatcaaacagactctcttgtaacttggctgcctgggtttttgtgtgttgccttaatacctgcaacggcttcgttaatttattctgttcttagtttagagtaagtatctgtgaccttttctcccccctcccttccttcctcctttcctccctcccaaaataaaatgaccataacattttaactgaggtaaggttgctaaactggaagtaaggtcatcacagtgtcttaaaattgaaagctggtttttattcaagtttgcttttgttaggtaatctaagaaattcgttcattagctcctgaagtgagatttttacttgaggatagctaaacccataattaaccaagtcatgttatgagcttttattgtctatattaccttggaaggctcagatttggtagcattttaaaatgacttgtattccagccggtgaatgcagtttttgtttttctggttgtagggtttttttttttttttctgttgctacctggattttacctgttttatgaataacttaagtcacactgcctagagtgtaattagagtattcagatatgcactgaatacttcagatattcttcttttgaagatattttctctaaaacaatcatgatatcctggagaccctgaggggcaactcatcactgaattatccctttcagaacccctgataatactgtgttgggctatacaaggcctcagggagagcttaggtatcctggaaaagttgggatggacttccattttgatcttacaggagcgttttgtctcactttagagtgatcatcctctggcctaccttgacacatgctctccttcaaaatgctaattcaggtcagttatctctaacatgactttccatataataagcccagctcattcttcaacatatcaacaaaagtaattaagcctcagctcaaatcttttatccttggtaagctgacttctccagtttcccaatgtaaaaattctgccacatttcctcgcttttccaaattaggaaataaccttgcttcctagggaaacttccatcgcttcttcccaggacttcagccttattctttccactggctccctctgttcagtcttgaaaacatgctcagatggcttattttaaccttgtacttccttcaggttaccacccttatttttttacttttttactatttagtattcttaagaaaatactctctatctacttatttattgttattgattactttatacactctagaatggcttttcttcctgctatttcaatgaaatcatttttgcaaaaatcattaatgatccctaattgctagatccaatataggcccttcttttgcatgtgatcagatactgaaagtacttaatgaaatatgtcaaaaatgctgacattagacctttgtcttataagggaagggtttcatttctagagagcttaaacaattaaaagattgcctattaccccttgcctttcgacctaagcgatattctctctttagcatctcatagatgttctttaatattttccttttcttcctaaatacatagtctgctcattttaagtcttgtgaactatttttggcttgtccattgccacatttgttttaattgtattacacttgagacatatgaatcattgataataacactttttctttttgatttgcagaattatagtaatttattaaaatatgtctgtataccctcacaacgcagttggcaggcagctcccctcctaactgatagcacaacattcttttgtcagctgataaacataagtccaagtttggcaagtgggtggttgacagtattatatcatgaatgataggctggattgttatgaaaatagaggcccaccaggcactctcgaacttcttcattccttaggctctacctggcattgacattgataattcttccttgtgtacttatgttttggttcccgtagctcttctttatacccgttaaatgtttgtgttaccctcaggtttttatccttagctatcatttttgctacatatattctccctcctgtatactctatttaaactgacacgagatgattacattgaaaatacacatttctcaatcattagaatgtaggtaatagcttaatatatctaatgtcaagaaacctttaaaaatatacacaagtacttatgaattgtttatgataatgctgcacatattcaataaagggagagttgtttttaaaaacaaatatgcaagaaataatatgcattgatgtagtttttctaaatcctgatacatagtacttagcgtttcttagagctgtaggggtaggtgtatttaactgatatctttaatttgtgaaaacttttcttttggaaatttttttccccattacctatttttcctccccccatcaaaaaaagaaaagggtaccatcctccgctttccatttgtggggagtgggagattgattaagatgccttttatatgaattgacagtattggcattttataatatacttttttgttcccagatatctactctttatgtttcacatttgcctggtttctaagttttctaggtgtatttctaaccaaatcagaaaactttattatcccaggttaccttatcttggaaccagtttatagaatcctgttgagggaggatgataatttaaatagctgatacttcatgagtatgcctgttagcataagcatgcttccaacatgtggcaactcctttaatcttcacaaccaccctgtgtgttaggtaggtaggtattattattaccatgttacaacagacccaaagagattctataacttgtccaaggtcatacggctaataaatgggcgagctggggtttaaatcaaggtaatttgggtacagggcttgtgttcttaatcagtgcttttcttctccctaattcaggcactgtgttcactgatcccttttgtcactgttttcttttctcctcattttgtctttttatttttttttggccagcctcttagaagttttgtcaatcaattctgactttttcctaaagttgatatttggtttgtcagtagcgtattggagaggcttacagtagtatccagaagaaatggaggtgaagctctgtgtgtactctctgtactccctttaacaaatagattcttaagtgtttctgaaagaaaaagtccttttgtagggctcctgaagtacaagagttaatgctctggagaaaaacttatcttatttctacactgaaccttagctatcatatggatcaggttttcattttctgtgtttacatagcactttagagtttaatgtactagtgatctttttagactttccgatcaactgttaatagccagtgataactttgctttttaattttccaattgcttctttcctctaaactttttatttcaacacataaagttgaaagaatagtacaacacccgtaaaccctccacctgcttcatctctttctatatgtctacatattttgttgttaaactaattgaaagtaacttttagtcattatgacattttatctctaagtactttagcacacatctccgaaaacaagacattgttttaccaatcagtggtaccattattacaaccaaaaagacaaaatagtagttatgtactatccaatattaaacgtttattcacattttgtcaattgtacccaaaatagctttttaactattttccccaaaccagaatccaaggcaaaatttaacatgttgtgttttgttaagtcctcttagtctctctaatggcttttgaagtttaatttctttagtcatcttatctgacttagaaaacttcatatgacctaaaaaaaaaaaaaaaatctatttctgctcttttaaattatttattcactggggtaaggttgtattcaaccccttttcagtgctactcactcactttagctttacattctcttgagtaggactaataaaaatggattaccagtgttgttgttttaaatgttttctaacagaatttggctcacatttaaaagtatctacctaaaagcttgtttcctttgaatcctgagatttttctcagtttgattaccattagtgtgaattgctttgagtctatttgaaagggccatgctagatcaaatggaatatgtacttttggtgtttgacaaatgtcttctgattgccttctgttgctttgttttaaagtgaaattcattctttctgatcttttacagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttgacttgttctaatttttattgagctttaacagatttcattagtagtacagatcattgtaatttagaatacagctattaattggcaaccattcaacaagataggtttatgtagcctctgtaacctttctaactgatgctctgggtcctcttcagtttggtccaatgtaaagtgccccaggagtgctggggtttcagaaaggacagagcaagcatttaggatttcagactaaacacccacacttcaggtagaggagctctatttttaccattactatttttttttgaagtaataataattaactgttagttttctttttcaggcacggttacacagtttacatgtgttatcttttttgttgttgttgttgttgttactgtttttttgatacagagtctcactctgttgtccacgcaggagtgcattggcactatctgggcttactgcaacctccacctcccggttcaagcaattctcatgtagctgggattacaggcgcctgccgccatgcctggctaatttttgtatttttagtagaaagagtttttcaccttgttggccaggctggtctcgaactgctgacctcaagtgatccacccatcccaaagtgctcggattaccggtgtgagccactgtgcccagccaatgaaagtttttttaataatttgttaaaaacacttcagatgctaaataaccactgagaaatatcttgtgccattgagtactaaagtacccattaggctgcactgtggtcatcttgttatttttgtgcacataacagtcatgcttctgtcatggggcctctgcattttctgttctctgggcttggaactctcctctggtgtgtcagctttggcttgctccttcactatgttgaaatctgcttaaatgtcacccttctaattaagtctttcctgactgtccgctatccttctgccctccctattctgccttattgtctgtcatacttgatttctactctccttgttcccaccagtaagtaagctccacaaggacaagaaacatctctttggttctttgctgtatctgtagcctgagacagtgcctgatacttcattgtgctcaactatttaaatgagtgaatggataaaattcatttttggaggttgaagattatctaaagtggtgcttccttaccttttcacttcactgcacatatagtatttctaaggcatatagaaatcaactgaagtgacttcttatggccagtgaggactggtgtggggattcaagctacctttttctacctttgctgctttcagcaaatccttgggaaattgatctgaaggccagatactacatcatcagcctctttcctttgtcctttcccattgcctaaaggtgctcatgttgctgccacctgtaacgaacaaattctgccttccaagttacagtgtcttcttgctactctttctctcttcagagctaagttcctcagaataattgtgtaattctattattttttcaacctttctgtatgtttgaattaaaaaaaataaatttcaaaggactctggggacacagtccagtctcctgtcagtttgtatcccttccctcaacatctcaaccttacagtcattcatcttttgcctctgaagtagcaggaagttcataacattgccttttctaacttgacagctgtaactgttaatggttcttctatgacattattaaaagttgtgtccctgatacttgcatcaatctgtcctttctcactacagaatcacataggaaaatcttatcacactctcagtgattgttcagatatgcaaagataattctgtgctctacgttcattccccttacagttaaatattcgcagctccttagttgcactgagtgattaaaggccaaactagcctccttgcctcaatccccgactgtccaccttctcccagtatattacaaacctatctccaggagaggaagggagcatcagaagagaaggaattctgtgtcatcaaactcaaatggc

SEQ ID NO: 13433 - DNA, 24593 bp, Human
gccaaacacatagcagatgctgaataaatgccttcaaatggccatttctaacggctctgggaaattctccattctgcaacaatatgcagtcttctcgagacctccgctacgttctctttttttctcatcgtttatttagcaaacattaatagagcatgttttatttgccagacactttgctagatgatagagatacaaagattagaagccaggcatgggtgtctcacgcctataactccagcaccttgggaggctgaggcaggaggattgcttaaggtaaggagttcaaaaaataaaataaaataaaacataaaaaaaaattagccaggcatggtggcatgcacctgtactctcagctacttgggagtcttagctgggagatcacttgaggccaggagtttgacgctacagtgaattatgaccgtgacactgccctccagcctgggtgacagaaaaaaaaaaaaaaagattagagaaggcctctgacctcacagtctagtggggaaccagcttcttcggggatttttccctgcctcacctcgcccacctcaggctgtgtagaaacccccagtctaaccagttgtttccctccaactctgtacataccacggtgtgttgcctttttatttcaaacatgtgctggcctctgttctaatcacagcaacctgtatccattaatccatttaatcctcacaacaaccttatcaggtaagtattgtcattatttgcattttccaaataaggaaactgaggcacagacagattaagtaactggcttaataaggtcttctagtttatacgtagaggcagccaggacttgaaaacacaccttctggctccagctaaattaacatgctctgtttacttatctgtccccactgaaattggaggttgaacccgtggcatattcaaacgaataagtatcgcctgtgcccaccccaatatctgacactataggtcaacgataactcattcgtcaaacaggaaggaggaaggaaggaaggaaggaaggaaggaaggaaggcaggcaggcaggcaggcgggcaggcagaggtaaaacgattccacaatggtgtggttgctcacatttactaagcatcaacactgacctgcctgtaagatgcgctaacagagctcacgaataaatgaaggctgggtgtggtagctcacgcctataatcccagcacttgagaggccaaggtgggaggacggcttgagccccagagttcaggaccagccggggcaatatactgagaccctgtctctactaaaattaaaattaaaaattagccaggcacagtggcgcgcgcatgtagtcccagctacttgggaggctgaggtggaggatcgcttgagcccgggaattcaaggctgcagtgagccctgaccacgccactgcactccagcctgggcgaccaaaaaaaaaattaaaataaaaaaaaggaataaatgaacatctctgcggctcagaactttcagttatcacctcagaactttcagttatcaccgtcgagaattccaggcgaccgctgggttttcccggttgcctcttttctctcacccctgttcccttcctctggaattcggctccacctcttccttttcctttgccagcctctccgtggattccgcggtccgggtttcccgggcggcagccgccgggagaggatcggtgcgtgggagcgctccggcagcggcgggcatgcgcagaggggggcggtgtactgcgcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctggtaagctccgggacgggacggggacgggcggtggtctcccaaatccggccccctcctccccgcgccgccgccaaccccgctggccgtcgtctgggtcgtctgctccccctgggccaggcgctgcccatcacgtgctgcgaactgcgctctcccgccttctgctttcagcatctgctcacagacgtggtatcagtcttctaggcttttacatcggaacttcagagcactgttggagaaaattgctcaactttgcattagagagtccatgtttatctccttctatggactctagctgtatctctgcaacctatcatttgtttttctgcctcctctcccatccttctgctctactgcagccgtttaaaaccttgtccacgctttatatttcccacgccacagctcccattcatcaaattatctccccacctgtttgacagagaaaatggttaggaaatttggctccctttcctgcaaaggctgatttcttctcttgttcaggaccagatgctgtattccccgcggttatcagggccctcaacaaatgcattttctttttcttttctttcttttttttcttttttttttttttttttgagattgagttttacttttgttccccaggctggagtgcaatggcgcaatctcagctcactgcaacccccacctcccaggttcaagagattctcctgcttcagcctcccatgtagctgggatcacaggcatgcgccaccacacccagctaattttgtatttttagtagagacgggatttcgccgtgttggccaggctggtctcgaactcctgacgacctcaggtgatccaccgagcccgacctctccccgtattttcaatttctctgctgctttctttctataactagtagtaattaaacattttcccaagtcattatgcctggtccccctaccaaatagtttgtgattattgcctcatttaatttctcatttctcacagcagtgttttataatactaaaagattattattcttgtttcacggttgccaaaacagacttggagatgcatgtaacgccggcttgcctgtggctggataataagtgtagaaacttgggttgaagctccaaatgtctaactccagatgataaattcttgactactaaaaccgcattctaaatccatccccatcttaaaagatctctcccttgattccatatcccctcccatctactgtctctcttcctcttcacagctaaactttttttttttttttttttttttggtgacgaagtcttgctctgtcacccaggctggagtgcagtggcctgatctcggttcactgcaagctccgcctcccgagttcacgccattttcctgcctcagcctcctgagtagctgggactacaggcacccgccaccacgcacggctaatttttttttgtatttttagtagagatggggtttcaccgtgtaagccaggatggtctcaatctcctgacctcgtgatccacccgcctcagcctcccaaagtgctttcacagctaaacttcttgaaaaggttatttacactcactgtttccacttgatggcctcttattaccagccaacccactgctggggacccctatcctaagcacacttgtaagaccattctaaccaaggtcaccgacaagctcgtcaattccagcagctgttgtagttttgactacaacactcgtgttagaaaccctcccttgagcttccttgacgtttgatgctccatctgcttctctggcttctccttgtcctcatcctcttcccattccttcatgttgatttgtttttctgtttttgtttttgtccccccccccccccggtgcaggatctcactctgtcaccctggctggagtgcagtggcacatcatggctcactgcagccttacctcccaggctcaagtgatccttctgcctccaactcccaagtagctgagaccacaggcacatgccaccacacctggctaattatttttatttttagagatgggagtcttcctatggggcccaggctggtcttgaactcctgggctcaagcagtcctctcacctcagctccccaaagtgctgggattacaggcgtgagcctctgcagctggccacatgttggtattattcagggttctcttctaccgtctctacacattcttcttaggggagttcattcactcctcccatgacttctgttaccatctacatttgatcattgaacgactcagggattggggcaccaaatcccatgaaattcaaaatctgaatataactttgattcccccaaaactttactgtttgctggaagccttactgataccgtaaacagttaattgacacatattttgtatttatatgtattagttactgttttcttatagtaaagtagctaaagaaaagaaaatgttattaagaaaatcataaataagagaaaatcctactccttcgggggaattaggtcatcgtaaaggtcttcatccttgtcttcacactaagtgggctgatgaacaagagtaagaggaggagctggttttgctctctaaggggtggcagcgggtaaagaaaattggtctctaagtggacccacacaattcaaacctgtgttgtttgagggtcagctgtatattggtaccatctgtattggtggtcttaatatttgagaacgtgataaaaactctaagctcactgtggaaaaaccacttagtttgcatgtagtatcagcagatacatcccttgaaatcttagacatacagttctggtattttcagttaccatgtcataattcccaaatctataaatctccttcagggttttccagctgtctactagaccttcctacttaggtttcaaactcctattagtcccctctcatctgaggtttcacttttctttatttcagttaacctgtggtcccccaaactattaaaatgaaaattccagaaataattcattagttttaaactgcttgccattctcagtagtgtcatgaaatcttgagctgtccagtaccacccagcacctgaatcttcctttgtccagagttcccatgctgtcactgcgccctgcccttagtcgcttagtagctgtttcttgattctcagaccaactgtcacggtgcttgtgttaagtagcccttattttctcagtaatggccccaaagcacaaaagtagtgcttccagtatgcttccagtagtgcttccagtatgctgaagagaattgatgaagtgcttcctttaagtgaaaagatctaagttcttgacttagtaaggaaagaaaaaaaatcttattctgaggtcgctaagatctacagtataagatattttgagagagagaccacattcacataactttcattgtagtttattgctataattgttgtattttattattagctgttaatctcttactatgcccgatctataaattaaatgttatcacatgtatgtatgtatacgaaaaaatagtatatatagagattggtactgtttgcggttttaggcatccactgggggtcttggaatgtagctcccagggataagggtggactactctatatccagaattgaatttattactctattggtcagggctctccagagagacagaccaatactaatacagattttggtaccaggaatggttctgggaaacagaatattaaagatgagtttccttaattggggtttttggaattgattctttaatctgattagaatctaaaaatgccaagagctctacttctaatagtagagagagcactggaagtccatgacacaaactgtttatagatatgcaaaataaatgcctttttattctaattcactgcttataagaggcaaagaatttagtgacgctatatgtgatattttcaaatatttttgggaaaacaaggattataatgacattggttggttgctcctattgtctttggacaaagtgatgaaagaaaaggatgagctcagggattcagtttcatggctggagttccacataaatgacctaaaagtttctaagtgtgccctgggttagaatcttctatcctgtagccatggggctgaaattgctgaaaatcaaacacaagccttcatcatgtaactggccaaattacaatggaagttgaactcttggccagtcatggtggctcatgcctgtaatcccagcacttcgggaggctgaggcgggtggatcacctgaggtccggatttcgagaccagcctggctaatgtggtgaaaccccgtttctactaaaaatacaaaaaattagccaggcttggtgacgtgcgcctgtaatcccagctactcgggaggctgaggcagaagaatcacttgaacccaggaggcggaggttgcagtgagccgagattgtgccactgcactccagcttgggcaacaagagcgaaactccatcacaaaaataaataaataaataaaatagaaagttgaactctcttagcctcacagagcatctactgttaaagtgagggtattggttgggaaagagtggggtcctgcaagtttggatgggatcatgtgggaagatgaggctggacacattgagcccctaaattctgatgagtcttgtttgccagaggggcagtagcatttccacctacagtggtatcatcctttccacccctgtctaaggggattaattctgcattgcctgtggagatagtaatggcctcctctgaaacagttcccggacaagacagtgctgattctcatcaggacccaccccgccacccctctttgcttctagacctattactagacccaagtcccagcagacccctaaaggtgaggtgcaaagtatgactcactccacttctggtaccaaatctgtattaggtttctggtcctgtaagattatagtggagctgaaaaatttctatcacctggtgacattgtagccatcataatggtcatagcaccaaacattaccttttctatgtttagatgcacaaataccattctgttagttaccgttatctacagtattcagtcagtcacatgctctacaggtttgtggcctagcagcaataggctatactgtatagcctaggtgtgtagtgggctgtaccatctaggtttgtttaagcactctatgatgttcacgcaacaaaatcgcctaatgacgattctgagaagatgcatgattgcatgtagatatatgagagggaatttattagggaaattggctcatgattttggaggctgagaagccccacaataggctggctgcaagctggagaccttgggatgctggtagcatggctcagtccaagtccatagcatgagaacctgggaggctgctagtgtaactcctagagtccaaaggccagagaatctgaagttgttgtccaaggacaaacgggaaagagggtcccagaggatctggacttctgagaagggagaaaatagcattgattggaggtagaacttggtctgcatattgaaaaataaggaaaatttgaatgggtgagaatgcaataacctttccaaagacctcttgaaggaatattgctccccaaaacagaattggtgtagagaaacatctgtatagagaaaggtttaaccagcttggaggcagtgcttagcattttagtccctaaacttcatcttttatttttttttccacctttgaagcagctcttcaaagctacacaataaagtataggtctttaaataggggacttggagcagtggtgaaatagcttggaatttgaaaaaatatgctgacttgccccagaagatgctggttcctagagagctgtatactctgtcagggcacaagatcagcctgagtgattttcattttgtaagcctctgacttctccattcattttgcagctagcatgcaaacaatctgcctatttatcatctttttttttttgagacggagtctcgcaccgtcatctgggctggagtgcaatggcacgatctcagctcactgcaacccctgcctcccgggttcaagcgattctcctgcctcagcctcccaagtagcttttattacaggtgcccaccaccacccccagctaattttttgtatttttagtagagacggggatttcactatgttggccaggctggtcttgaactcctgaccttgtgatctcctccccccaccccgcctcccaaagtcctgggattacaggcatgagccaccgcgcctggacttatgtttctatctatatgtctgtatatgatgtctgccactgaggggcaatggtactgttgtgattcctccaagatagagtgtttttgtatttgaagaggaaaaaaaaacaaatgaatgctcttggagactgttttcccacatacatcagtatagccaatatgtaatggaactgcattgatagcaaagagtggggaaaacaaagccatcttttttcatattatgcctaactgaggtgttatttctgtaccaacctgtgatccactgtctagatgagatgggtagggaggtgtgtagcagagaagacaccctagaatgcatagctagcgaggcagcctctttgggagccagtaagtagagtgtgtaagtcctgggcctgctactctgaattaagaacgggaacctctgcagcaaggcccctctgagcttatatataaggatttaggatatttgtttatgtgtgtttcaaatcaatgtgataaggatggattttttttttttccattcaagaatcttgctaccgtagctggcccgtctcatactattagcagaggggttaaatgtaaaaatagcaatggcagttggtcacacttgtctaatgtctgactttgataggactgcttcagagtttcactgttggataccatgtttgcaagtcaccattgtcagcactgtttgagagagctggccagacctagtccctacccccaaggccagcattcccagctccagtggtgcatgccctagcaggtctacgtgttcaattctaacaactaaattaattttacagtgggattctgtctcaatgggagtattccatattggggtgatttgttaatagatgctatcatcttgtcatagatgataaggaaatcattgtgccgaggatattgttaacaccagtataaacaaagagcttcttaactgctcaccttgccttcaggcttcctcatttcccagtccttttgccatattgctgccatacttatatttctaaaccatttacttaattatgtcctagtctggttcagaaacctttggtgattctctactggttatgacataaagtccaaactctttagcattagttttatgtggtgccagcatgccctcccagcttcaaagtcaagtcacttacacactggccacttcagtgggttcccagaaacatgccatgccatatacatcttcacacctttgttcatttccggtaccacaatcctgtcttttttcttctctccccacagttgtttattcaggcaaatctggcttgctgggctaggctcagctgagggctgccttcgccatgaatccttctgtgagttccctgtctgggtgtatccctagtactgctgttgattctcttcttagagtacctatgaattcacttgccccagttttgctttatggccagttttttcttagataagagctaaacctgatgacagcctgtctggaggcacattaacattgatgttactaggagtttctgttcataggctttcattttaaggtttggtttcattttatttattttttacagaaaaacagtttctaaatgttactaccagttttatgcaaactttcagagcctctaaatagctggtaaaatggtgagcattgataatggagcttctactaatttcctggttgtttcaggaatttaaaagaaactttttatctaacgcaaaagtttctagttacccacagcatgcattgttttccattgttagaaatgctgctgtttttacattaattataatgggaatgcatagctgcctatgaaagcttgtgagcaaattttggggaaccacgtatacttaataatagcaaggagtgagcatgtgttggttgagatagatcttctatctctactaagctttcccaagtcagggacagtgttgtaatgatcgtacctgatgtattcagtatattttgtgtgtgtgtgcatgtttttttgttttgttttgttttttgagacggagtcttgctgtgttgcccaggctggagtgcagtggcatgatcttggctcactgcaacctccacctcctagattcaagcgattctcttgccacagcctcccaagtagctgggactacaggtgcctgccaccacgcccggctaatttttgtatttttagtcgagatggggtttcaccatgttggccaggctggtctcgaactcctcacctcagtgatgcacctgcctcggcctcccaaagtgctgggattacaggcgtgagcctctgcccagccagtaattatcatattcatattcccagacctttatactattgagtaaaatgctatttgtttgcattgttgttttaaaatcactaagttaaattttttatcttttttttcagccatcaaaaataaggattaatttagaagataatgtacaatatgtgtccatgagaagtaagttgattcctgaataggttttaggttttgttagtttgaacttcttatgattaaaatgatttgtttaagtgtatgagttgatgagaaactgaaatacaatttgttatgtgtacactgaaatgtaaagttgcaagttttagtaacaactcctgaggttatgggttgaatcatgtgcacaaatgccagtttattctccatagaacagtctgtatttaaggctattttctcagaattcctcctgggagagaaatgtactctttccttcttgtcccttatcttaggttaatgtttagggtatctgttagaggcgataggatgtaaatggctctagttccctcttctggaagtttccatgatagaccgccccacctcagcttcctaatctcagtggatacatagtgcatcgataagtcagtgtgaatcttagaaatactcacccttagttttgcctcagtgcctgccccagtctcacccatagttggtcactgagtttggtcagcttcacctttgatgtgtttcttgcatctgtcccataccaccaatttataataatatctaacatttattgagctcatacagtgcctggcactgcattaagctctctgcatggattgtcacaatgacctttcaaaatataggtatggattagaattcttactttataaaggcccagagaggctgaggtgagttgctcagagtcagggttgaatctcttacctctctgacgcaagagcccagagtctttaccacaacgttgaattgcttcttctcgttcagggtctaacttcctctgtagctgaagttgctgggtctccttcttagaaggcagtcagcttccaggctttccaacctggatgctggaaaaatccagggggatttgtctaatacagaaattggattatgatatcattcaacctaagttcttcagtgacgctcttttacatgtagagaaaaccctgattccttgtatatttgattttaagtgtttgcattaaattcataagccacttcatattaaaagaaacaaggcagtagagaatgggtagacagagcagaccaggcccttgtaggctgtttcttgcttaatgccgcagcctcttcttccagcatgctgccgccctcctccacagcacaagctacaccacctgtgatccccaaagcaccccaggttctctaagtctgctttgtcttctgaggtgtggtttcctctccctcacttcagcccctcaccctctgtcacagtgggcaaacaccgcccattcgccttcctgttccctatgcccagtgtactcccatcaagaggccttcccagtttccccctccagtgaaggtttgatttcttgccatcgggtgactttgaatacctctcttagcacttacctcaggacatataatagagttccttattagactacggagttgctttggtgtgaagacctctgtaatcctattcatatcccctcagcaactgtcacatttttggtgttccgttgtacatgttctttataaaataacatagaaatatgcttatcctgagcatataagaccatgccttgttaataattagtataattaaatatatgctttttaaagttagaatttctcatttgtaatcttcctgagtttgttgtagaattgtgaccctctacttccgattaaaaatccttttaaattcctaatttacgcctatttaatcttaagtgtaggaatgggctccagagagaagacatttatattatgaaatatgtacctttgttcctgaagtaaccgccagtggtctttaaactaaatgtgacattgtggaggttctgagtaaggacatttctgactgaaggtaggatggacatttctttgaggcatactgactgtggtgtgctgtggaagtagagaaaaagaaagtcatatattccacaccagagtgacaaagttattttagaaattattttttctgcaaaccaagccataagaactttttcttagtatcaaattggaaaagatgacaagatacttagttctggcgagcatgtgagatgaggcccgtgtatactgcatagaatggatagaacccacaacctgcagagcagtttagcggcacatatcaacattccttaaaaatgtccagttaaggggacatacagtagtttcgcaacaaaaaggttcattgaaatatgaagcaaaatcgtaaagttggagatggtctaatttctaatattgggataaatagcaaatactgcatacagttaagcatgcagccattaagaataatgttgaaatacatttgttgacatgtcaggatgttcacaatatggagttaaaagaacgtgttgcaaaattgcatggtcctatttttgtttttaaaaactatatatatgattggcacacaagtgtgaatgtgttagaggtgtgtgtgtgtatgaaaaccccagtcattatagtaggtgagtgagggaattaagggattttttttttgtctatctgttaaattaatatagggtagtgaatatttttaaaaatagagatactgggccagccgcggtggctcttaatgcctgtaatcccagtacttcgggaggctgaggcaggtggatcacagggtcaggaatgaattcaagaccagcctggccaatatggtgaaaccccgtctctactaaaaatgcaaaacaattagccaggcgtgctggtgcatgcctgtaatcccagctactccggaggagaattacttgaaccctggaggcggaggttgcagtgagccaggatcgcgccactgcactccagctccagcctgggcaacagagcgagactctctcaaaaaaaaaaaaaaaagagagagataccactgttgctcgaggtatgtcataattgtcttaatagaagactagtttgggctctttcaaaaaaattcatcagacaacttacactatgacatggatagagtcattaaaaggggaaaaaaagccgccaattctctgcctttgctttgtaaagaattccttaacttgaagaccaaatgagaaatttaattttaaaaatcatgtgtaattctattcctgagagtggtatggatgcaaattaatctcactgctttgtccgagaagatacagtagacttgtgaaagtccacatgttcggtggacactggttgcatatttcaaatcctcctttgtttaaatctaaagcctttgtttagagccaggataggccagtgaattttttctccaatttaagagatttatttcatagaaaccagctttgatttggtcaatgtgtaggcatttctgtagatgtctgctatctgatcaagaggaaacagatgatttttaaaaatgagttgagaaatgttatttaaaattttacaaatatgtttattttgtttcccagaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggatgtgagttgctttcaaactttttcgtggcttttgttccttctcatcaagtgacaattccatgcttaaactagatagtggcagtgttttgacaatataatacaaaggtacgacttcttgttagaagagaattctataaaattttcttgcatcatcctagagagtacataaattttttaaaaagtatttcctcagttccaattgattattgatattgggaaaatttgttaaggttgtaaaacagtggttttcacacagaaagtgtagtaaacacctagaggcttactgcctctggagttgtaattcggtaggtctgagggaaagcaggaaagtacattctcaacaggtagcccaggagattatgacgtagcgaggtgtttaaaatactgccctgaatattaaaaaaaaaaaaaatcagacagtgtctaaaagacagttgctaaagacttgacatgatgaggagaaatccaatggaaagggaagcttaagacattgacatagataaaggtatctgtgtgtgcacacatgagaatgctgttgtacctagaataggcaagtatttggggacagggagaaatagttacagcaaataagtacatagtgacctctcaggcaaatgaaaacctaccagcaaagaccataaaatgaccctaaataattaacttagttattagaggaaagggattcataaaggaggtaattttttcaatagtacagaagtacaggttgaattctaatttgagcatgtttactaaataacactaaaaaacactttaggagtttatatcggcatgcattgtgaatcactaattagaatcagatttgaaaactaccaagtaaaagataaaggcaaggacctttccctatttattttccattaagattgaaagaaaaaaatgaaaatcagttgttgcctggtcatatcatattggagtaggcactaataactaaagaaaatatgtcttttttttttttttcttttgagacggggtcttgctctgtcacccaggctggagtatagtggcacaatctcggctcactgcaacctccacctcctgggttcaagtgattctcctgcctcagcctccccagtagctgggattacaggcatacaccaccacgcccggctaatttttgtatttttagtagagacggggtttcaccatgttggccaggctggtctataactcctgacctcagttgattcacctgcctcagcctcccaaagtgctgggattacaggcgtgacccaccatgcctggcctgaaaataatgtctttttttaaatgatgaatataatcattatattcagacagaatgtgtacactagggaaagatacagactcctcacatgttagcagaggcactgtcatttagcccaccctatgttttcatgtgtaggaactcaagtactgtaagattataacttatcagaagctgcgttgtaagtactaggactgaggctgaagctgggtgttattgactcttagttcagtgccctttttatttccttaggctgcctctgctgttattaatttctgttaggttgtaatgtatttttttgaaaaagactgtataagatgaagaactataaataatttatgtacagaaggaataatggctgtctagaacaaagacggcagaagttaaaagtccctagtttctattgttgtggaaaacacttatggcaaacatttggagaagttccaataacctaacttgaaattactttgttatctcctagttggtattgatgctgacattttttttcttctaaagaggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagatatcctttaagtctatacctttttaaaatttctgcttccaaaacagattacttaagtagtagagtcagcttggggacttaatttatatatttaagatataaaattagaccattgaaagttaaatacaaaattagccaggcgtggtggcacacatggctgtaatcccagctccttgggaggctgaggcaggagaatcgcttgaatctgggaggccgaggttgctgtgagcggagatggcgccattgcactccagtctgggcaacaggagcgaaactccgtctcaaaaaaaaaaaaaaaaaagttaggtaaaagttggtagtagtataacctcaaacatacacaaacagtaggttttttaacttctgtgtggcatttcttagattaaattctggatgatgacctcaggggtacagtaccaaaccaaggttgatggtaccacttaaaatggtgagtattcatttttatagtctgaatactataaggataataaaatatttgttggcttttgtgaagttcatgtttttcctagaaatttgtgaatggaagttgatttctgaaacagtgaattgccattgaagtggtgcttaaactgccatttgtgtccacagaagcgcgttgttgcttagtagcagttttgctttgaaactcagtgtctcagggagctggggggtggggctgggggagccttgtctttggtactgacctcctgggtgtcttaaacctatatgctgtgctgttccctgtggcaccctttgaggggctcactgattctgagctatcccatacctcatatttacttaaaactctctccagcagtcaaaaacctctattcccacagtacaggtactggaaggaaaagaaaaaataagcaccaacattactgcagccaatcagaaaaaaaaaatgctagagaaatccagtaaatcacttaattggtaaaatttgaggcaacacagtgagacaagacgaaaaagactcaggtagtgagatggaaaataattttggatgaagtaacatcatacatgatagtcttgagaaacttaatctctaagtcgtttatgcctttttatagatttttttccatctttcattttaggggattcttgtcaaagccctgagtgttttttctcaaagttatagtaagatctagcttactatacctgaaaagggaatagggtgaaaatttgaatttcttcatgtggtgtatttgtgttagggactcagactttattaatatttttctccagaaattgccatcataatcataatagtagagcttaaagaaactctttaggttgtgttgtaaatattgtaaaacccttcataaaaatcttaattttatgtgaataataaagattatcaatgaattttttttttttttactgctttccttaatggtgaacttgtatctcataaaaactaaaaacattctaacattacccttgcgttaactgaattactagagataaattacctccccagtaaacagcattctgtgtagagatccttgactgagttttacactagcatatgtgacctatcaagacattcatagcattcaggccttccatgaacagatcgtcattgcagttaaagctccagcagaaaccagattggatgttccagctcccagagaagtaggtaaccctgcatttttaaaaagatttaaagagggatgagggccgactgcttaggctgtgatttattgcagtcatacttaagagccgttgtgtgcacgtgcactgtacatccgatactgctcaaggcacttcacacatttaacttgcttcaactaacacaagtcaagtagtcattattatcttaaagatgaggaaccaaaagctcacaaagatgagttaactttttcaggatcaccagaattcaaacccagttagtgtggcttcatagtttgcttttcactattgtactgcagtgcttcttagaagaatcaccaagaattggcccatcttaaagttgcaaaagtaaggtctggtgtcagccaaggcactggggaattaacaaactcttgaaagactgatgaataaaccaggacgctaggttctgaatttaaaatggaaaagtaggatttctgtgtaaatgaacattatttttgtcagccgccagctgctcagtgcgttctttcccttgcagaaaaatttgcattgaaagataattgcatcagaaggctgcttgatgaggacagaatcagaaccaaggaatgtggccattcttgggacacatcctcaagactgacagccttgatagacccatcggtgctcacagtgcagccctctgcattgccctgggggtttgcctcctgcctagcgaagaatattttcttgacccgtttttccttttgtccccagcagaccactgttcaagtgagccctgtattactccacagtgtatgggttaagggctggctttcatttacctcagtcacactcaagttatgatttcttggtgatgtttcctagttgttttatttttaagaaactgctaatcaacacatctttactttggggcataataattcattctgcagagactaatggatttttggcttttccctatgctgtgagctgcttcagactgtaattgctaaatctggctgagcctttgatcatacctgaggcttctcttagagtcctatttaaagtctctgcacatgggccctcttggccagagcctgaccgtgaagatctggggacctagtgtgatgggtggcaaactggccctcaggtcagatccggcctgctcctttttcttagaaataatttgattaggacacagccacatgcacatttgtttacatattgtttctgactgctttcatactatagtggcagagttaaaaggttgtgacagggatagtgtgacttgcaaagccaaaaatatttaccatctcagcctttatggaagtttgacaacacttaatttagtggaatgttattgttaagaaatatctattaaattgtacaggatttatcattcaaaccagttgtgacctggcactctagaagctgagcacagatgttctctagcccacttgtagtaccaggaagtcatagcaagggcaggtgaggctctgagaccgtctgagaggctgcatctccacagactcaccctggtataagatcacaatgaggtgtggagtgggagggagcagtggtgtatgtgtgtctagcccaggcctaactgcattaaaggggagaaaacagactttgttatagttgaagcagctcccaattaaagcaatcatttataactggggctgttccttaagaatttagcataattcccagtagaagcactgaagttgcctgataccttacggaaaaaaagtattttgattaatcctgaggaaatctgaaatcaaaggatgtgaatatcataatgagttaattagtcctttataaataatgtaaacgatttttttgacattttacttgagatatattttgatcttttcctgttctttcaactggacaaaagaatggcccttccattatctcaagacctgttcattggtctggaaatccaagcacatatttatcctgtgagactctagggtattctggagttctgtgtcatcaaaacactgatttttgactgaaatacggcctccttgaagggtcagctcctgagtagaaaaagacaggctcttgagtactgaggttttcacatgatagctctgaagccattactgcaggatcacatgtagctgtcttcagcatgggaattggccagtgctgtaatgtgactacagctaaggtgattttctcaaatgtctcgaaatttttgcagttctagtgagtgaaaaaatatgatttattatttcattcatcttgacgattcctgtgtcctttgctaggactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaaggtaaatataccagtgattctgacagtattttaattaagcatgcataattttattaatgtgtattatggccttaagatatttttactcttcctagccacaaaaacatgagtaaaaaattacagcataactcttactgtagtttagaatatttctgtgaacattatagttaaatttctgtagttttggtagcagtgaaaacttagaattctgtttggtcccatggtgataccaacttgcgatggtctctgaatagggcaggctttcagtcaaacagcagctccactcggccaaagagcctgcccatgacctggccgggagacttccccttctgcacatcttggagaagggaaggggctagacctgcttgacccaggcagtcaaatacccactcaactcagccaacagcccactccacaagagtcagtcctcagttgcacatttctaaggacgtcgcctctggacccatctggccagagcagtgactccatctaacctcggaacccagcttgcagtgctgtccaacagcagatcccaaatagtggaattgcctgagcaggggaccagcatcctgtgaccggcctgggcagaagccatcacagtacccagccaacagctccaccgacatccgaacaaagacccagccaactggagaacttgacaagcactgcgggccagggtggtcttcaggtggcccttgcagagccacaggctggaccgataggaagctttcactgacgaagaatacctgtaatgaccagaagagggggctgttgcccacatgcagacaacagcacaaagacacaaggattacgaagactgggggagtcgtgacggctccaaaagaaactaataaagccctaataagggaaggtttcctccattctcggacgggtgctttcaggtacaagttagagttccagtttattcttgagaggctgaaaaaattagccttatgccattaacctgagaatacgtgttcttgaccaggcatcttcagggttttctgaagtagtcagattgtgtattcttttacgtatttgcctatcagaccttcacttaggtgtattcacttaggtgtatttctctctcgtgttcttttccagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaaaggacagttctttgtggactctacccttcccttcaaggagtatgtcatatgtcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcactcttgtacagccaaaataatgtatatatggaaagtgacagacaaattctctaatctctttggtatctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagatcggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctatttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcctgcagcagtcctgccggtgtgtttctgtgcacctggggatgaagtgtgctcctcccccagcggttagcctcaatgcttttcctccctctgttttattatttgaaattagccaaagaaaagctgcagggggcactgctgatcatcactggactggtgggtcgtactgtttgacagaatagggaatacaggaggaggagcaagcctagggtaaaacttaggtttgggacatgcttgatgaaagcaagagttgagcaggttgttgtgtgtatgtaggtcaggtgctcagcggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactccatcttctggcgttgggtctctgattcttaaaacggataaaataagcatgaactcgtttctgggcccctcctcctcactaaccctaacctttccaacctcactgtcccatctctgtgcgcaccgcttcttccttcagaaaccttgagcgatccgtgtttccttcaggccgaagtgcagactctggatatagaagggcccaaggcttgcttaccaatcctgccttggtacctgcctcgcagaccttcaccccagtaaattggtctcatcgctacctgaagcacacagtgaactttcccatctcccttcctttgctcttatcctatcctcttcctgttctctgtgtttcaaaatcgcatccctattctggacctggcttcacccatgcctcccctttactcctaccctgcatgcagtttatacacagcacgcaggtggccatcttccttcctcataagttgctgcggctacgttcccagctgccattccatgttgtcagagtgtaagctcatgtcttaataggtatttctcatattaatgtagtgtatgatagggtttggctgtgtccccacccaaatctcattttgaattgcagttcccataatccccatgtgtcgtgggagggaccaggtggagataactgaatcatgggagctgtttccctacatcctgttctcgtgatagtaagttctcacgagatctaatggtttaatagagggcttttcccttcgctcggctctcattctccctcctgccaccatatgaagaaagacgtatttgcttcctcttccaccatgattgtaagtttcctgagccagccatgctgaactatgagtcaattaaatctgtttccattataaattacccagccttgggtatgtctttgttagcagtttgagaatggactaatacagtaaattggtaccacagagagtggggtgctgctgtaaagatacccaaaaatgtggaagcaactttggaactgagtaacaggcagaggttggaacagtttggagggttcagaagaagacaggaaaatgtgggaaacatttagaacttcctagagacttgttgaatagctttgacaaat

SEQ ID NO: 13434 - DNA, 36544 bp, Human
cgacagagcgagactccgtctcaaagaaaaaaaaaaaaaaaaggatcataactaagactcgaatgcggagggataacagcctctgctacttgaaacctagtccttctggggaggaaagcccaggtgtgtggcaggtggaagggagggcgagcctaggtggtcctcttgctagggcaagaagcccccaagcacctgcccccagctgagcagctccgcgcctcctggccctggacgaacttgggcccagactggcgctccgtggcaccccctcccccggactcccgcttcgcgccctcatcccgccccccggcgcggcctcaccagctccccctgggcagcccaaagaatgcgaagaggtaggtgggggtagggaggagggcgagccgctgggagagacaaagggcccgagtctgagcgagagacacaaagacgcgaggaggctggggagataggggaagtgggacaaggacgcggggagtgaccaggtccggaggccggactggagcccagccccacccagcccggccgggccagcgcagcgcgggggccggtctctgctgccccctggcgggtggctgcggtgagaaggcggcgcggagcaggtgttgggaggggaggaccagggcgcgcagggaggtagggagggaaggaagcagagaacagagcagggacagagagacagcgagagagactcgcacgcagagacaagagacgccgagagggagacacagagaaagagacagggacagagagacacagatagagacagagagagacacacggagagacagagacagagaagcacagagatagagaggcacagagatagagacagagaaacacagagacagagaggcacacagagacagagaggcacagagacaggccgatagagacagagatacacagaaatagagacagagacagagaggcacacagatagagacagagagacacagagacagagtcaaaggatggaaagagacatggggaccaagtgacccagaaacagtgacagacaggccgggcttggtggctcacgcctgtaatcccagcatcttgggaggccgagccgggaggatcgcttgaggccagcctcagcaacatagtgagaccccgccgcccccccgccccgtctcttttattgaaataaagaaacagtgactgacaaaggaagaccagaaacagagcgacaccgaagcatgaggacggaaagacccagagaggcagaaatacagggacagagaggaagacccaaagagagtgagagagacacaaagacacgtaagagagacagagaaatccagaaagaaacgagtgcagcgacacctagagttcggggcagagattagaaacgcacgagggtacgagaaacaggctcagggcgatgggctcgacctgcggggaggtcgcacaaccgggacgtgctgggggcagaaccgtaaagccccacgtgcctcaggcaactgtgatgagaggacccgggcaggcaggaaagggcaggattcgaactgtgggtgggacagaggccaggacggactgagctaagagaccgagagaactccggctagggcgaggggcggggctggtggaggcggggctggtgggggcggagtcggccggaagggccgaaaggggcgtggcaagaccttggcgaggcggccggtaggcagggggcggggcgtgggaactactcgggagcagagggggcgtggctagaccttagggggcgtggcttaacgccgggagcgaaggagacagaattctttggcaggggcgaccttagaatcctggggaggagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggtgagacgagcggacggccccctgccctcgcgcggaccccctccaaccttaccttccgagctggggaagccgagcaccttccccgcccacccccggctccccgagccccctctcgcgtgcccccttcctggctggccccacagactccgaccccctacacgtccgattctctcgaggagactctgacccctcctttctgcatctctctcaccaccacccccatccttcttaatccaattgcccatcctacgcctgcttgtctgtccccctccccatttctcggattcccgcgccgaaagggttaaatcccaggaaggcctggtgccccctccccaccccgcgccgagtagttcacccggatctgggtctctgtctcctctacccctctcaggaatgtggggaatgttccccccacctaccgcagtaaggtctcgaggaagaggcgagaccacctccctcccctatttttccttcttcccggcttgggcgtctgaggcccggagagaactgaggacaagcggacctgattcgggtcccttggagggctaaggataagagttctggcgacttagggggaagggcctgagctcggagctccaaccccgaacctcagggagttgggggttctgactccgtggactccagaaaaattaggggccgggggctccgtcttcagggtccctggtagaatggaggctaggcgctaagtctaactgggatctaggtaaaactgggggcgagagaggatcaaacttgtagcttctggatttaattgtgggcagggggcttcgttttcagggttcccggcagaaccgggggacaggagactcgatctcgtgggcttcagacttaattgtaggcagaggaacgtcttctgagatccaaacagaagtgcgagcagcgggccccgtctcttgggctccagatatgatcaagggtcgaaggctctgtcttgaggctggagtctcagtcgcctgagtcccagatagaacgggaggccccgagtcccagaggctgggagactcctccctttccctatgaatggtcgggggcgacggagacgtcgccggggaagttttcctggtttcactctcgccgagccagggaggggcggggcgggcgctcctggctccgggttccggactccccggtttcgggaccttatctatcctctggtagcgcctttgtcctcagagccatagcaggaggtggacgagtggagccgccgcccttatcccccgtccctcccattgctatgccttggaccccctggcgtccttccatccaccccactaggggaggagagcggcccccctggggagggaggggctgggagggaacccttgaaagaggcgctgccccgcccttgcaggtgacccggttgtgtattcccagcgacaaactctgggatgctagagtttcccgagggtttgcgcagaagagagctcagggggatcttgggggaaccccggccacctctctggcctcatttcccccaggatggctctcactggcctcccagctttgacccagagctgggaactccgcttccatcccctgcctctcccttcaggcagaaataggcagatgagatcagaactggcacctctgggtgaattctccgaacccaccagaccctgagcctactgttagcttggtgcatgatctcaccgaaggctccagcttgccctgggaaacaggtcctgtttctgtttccatcttagagatgaggaaacaggctcagcaaaggcaagcagccttctcaaggtctcacagcaggtcccggggaagccgggctccggttcttcagagccccgcaccgggtgggctccaggaagtgcctctgagtttccatttcctccctcgtaaaaaaactgagataacaatcctttccctgcggaccatccggaaggctcccaggccccactgattccctgtgaaacctcttagcccctggagaaggagctgtcggcccctttcttgaccacccccaccccaatccttcgcctctgctgtccgctggctggccggctggcatgtgctcgctctccctctctctctctctcccctccccctccctgttttcctccttccctcactttctttccccctcttcatctctcttcgtttctcaccctttctctctccatccctctccaagctctttctctcttctcctctccccatctctctctctcctctccgtctttctctgtatacctgtctagctccactgcctcccccgcttggcctcctcggggaatgcgggtgcaccacctgggcccccagctgggccggctcccctcccccagctttcttccctgcccatccgtgtgtccatgtccgccaggcagccccacgtagtggagggggaggggagcagagggacggcagcctggctgtctcctctcattagggaagggggactgggcagaggagaagttggggggtgggtatatagagaggctggagctacaaggatgggtacagaggccaatagagggaagcggtcagacacagatttaggaatggggtcagagacacgtgtaggaatggaatcagaggatagaaggggagtgaaatgccggcacagggtcgggggagtgaaataccgacacagggatgaggctgaaagacactggaatgggacggaggagggtgggggaagggagctagacatagataccagatgaaggcagggacaggaaaaggaaaggggtttggtgacaggcagggagccccaaagactccagctgtgggacagcagaggtgccgtgacccacggaggtcagggtacagggggcctcaaggccagcgacatgtgggggccacagggagtgatgaacacagaagggacagggagctgggcacatgggccagctcccccgcccctgcctgggacgctgttacatttttaatgtcccagcagtgctgacaaatggagcaggaaggggaggagaagaggggacccagcaagatgggccaggctgtgagaaggtgtgtcagaaatatggggagacagggcactggagacccaggaggcagggagactccacagtcagagacagaaacagagacgtagaccagaaggcttgtgagaagagaaccccaggaatcaaggcagagagccaggttccagacacagggagacccagacggagaaagagaccggagatgtcagacatacagaggaaagaggaagagagtgactaacggggacagggtatcttctcaggctaatgaaaatgttctataattgctcgggtgatggatggctaactctgaatatacaaaagccactgaactgtacactttaaatgggtagattgtatggtatgggaataatgtctcaataaagctgttacaaagagacagagaatataagaggcacagagcagagaccagagactctgggggacacagataagagtgacagaggccaggcacattggctcataccagtaattccagcactttgggaggctgacgcaggagaatcgtttgaaccgagttcaaggctgcagtgagccctgattgcactactgcactccagcctgggccacagagcaagaccctgtctcaaaagagaaaagagtaacagagaccccaagagagaccctgggaattggagacacagagggacagggaccctaagaactagacacagagagagatagaagaggccccggaagacacagataagagacgctaagagacagcagggataccattaaaagactttcaagaagccaggcatggtgactcatgcctataatcctagcattctgggaggtccaggcaggtgtatcacttgagctcaggagttcgagaccagcctgggcaacacggcgaaaccctgtctctgcaaaaaatttaaaaattagccaaaggtggtggtgtgtgcctatagtcccagctacttggaaggctgaagtgggaggatcacatgagccaggaaggttgaggctgcagtgagctgagatcacaccacagtactccaccctgggcaacaaagcaagatcctatctcaaaaaaacaaaacaaaacacacggattagaggaggccagggggcaggtgcagaaatccaggcacagacagacagccctacatcctggctgctgcagccgctgctcactccctgaaccagctcctggatttccgctgtgggggttgggcactgtgattaatacaattaattaactgacaaggtgactgaggcagcagctgaggccagtactcaaagcctctggccttcaagggccttctctagtcccgacgtgccttgccatgggaggctgggtcgctgtgctttatagatctgcgggggaagccaggccctggggagccagccaggcaggagtccacgagcccagctcctcctcccctagacccaggtgtccagcttcaggccccgcctccctcagacccagaagcccaggccccagcctctcctccctcagacccaggagtccaggccccagccctcttccctcagacccaggagtccaggcccccatccctaatccctcagacctgggagttcaggcccccatccctgctctctcagacccaggagtccaggccaccagtgcttcctccctcagacccaggagtccaggcccccatccttcccctctcagacccaggagtccaggcccttagtccctcctccctcagacccaggggtccagcctcagtcccctgctccctcagacccaggagcccaggccccctgctcttcctccctcaaacctgggagtctaggcctccagctcctcctccctcagacccaggaatccaggcccccagccccctcctttctcagacccaggagtccaagcccccaacctctcctccagggttccataggtcactctgcaccctcctcgctgccttggtctacccatccctggatctcggggtctcaagctgtgtctgtccccattgttctcccatgggctcacactacaccctgggcagcctccactctgccaccacaggaagcctgcaggtgcagtccacagggagaggaagtgtgtctggggacccagctcacacttcatgaagctgtcaccagtctggcttgcccagtgacactgagggaggctggtgttcccatggccacagtcccctggctatggtgctggccatgtcctggccaagttcatggcacagcccctgcctagcagtgtgctggatgatgggggctcactccaggctgaccaacctcctggctgtatctcccttgcctccacctgacatgcagagcgtctgggcagcggccctcacccctgtcccctttacctccgcagccctgtcagcctccaagtcccaaccctcccagcttctccctgtcacccccaccgctggtcctgctttcccattccaagttctgagtgtgtttccaatctcgccatcctccgtccccacagccccgaccctgatcccggcgcctccccccgagacccctgccccactgagggctctttcttttttcttttttttctttttttgagacaagagtctcactctgttgcccaagctggcaatagtgtctcactctctcactctgtcttccaagctggtacagtggtgtgatcttggctcactgcaacctccgcctcccaggttcaagcaattcttgtgcctcagcctcccaagtagtggggattacaggcgggtgccaccatgcccagctaatttttgtatttttagtagagacgggctctcaccgtgttgcccaggctggtctcctgagctcaggtgagccactgcacccagcctgtgagggttttttctttctctttttgttttttttgtttttttttgagacatggtagccaccacctgtaatcccagctactcaggaggctgaggcaggagcccgagacagagcaagactccgtctcaaaaaaaaaaaaaaacagaaaagacttgggcttgtttcctgagggctctgtgcagaggagggcgtgttctgcactttctagcaggatccttctagctgtgcataggaacaaaccacaaggacaactgcagtcctccaggtgggaagtggcagtggattagaccagggcagggactggggaggcgtcagaggtggtctaactagataaatgtcaaagaaggaggtgacagggtttcctgatagattgcttatgaggtgagagagaaagaggtgaaaatgccttaaaaatggactgtaggcaggacgcggtggctcacgcctgtaatccaagcactttgggaggccaaggcaagaggattgctttagttcaggagtttgagaacagcctaggcaacaaacagtgagaccccttctctacaaaaaaaaattttttttaattagtcaagtatggtggtgcccgcctgtagtcccaactactgagaaggctgaggtggtaggattgcttgaacccaagaggttgaggctgcggcaagctgggatcctgcactccaccctgagcaacggagtgagatcctatcccagaaaaaaaaaaaaggaatgttaaccccacagggcctgaactatcctattcattcatttggaattagaaattcagaatggggaacttacagcaatgggattttttttttcagacggagtctccctctgtccccccagctggagtgcagtggcgcgatctcagctcactgcaagctctgcctcccagattcacgccattctcctgcctcagcctcccgagtagctgggactacaggggcctgccaccacgcccagctaatttttatatttttaatagagacgtggtttcaccgtgttagccaggatggtctcaatctcctgacctcgtgatctgcctgccttggcctcccaaagtgctgggtttacaggcgtgagccaccacagctggcccttttttttttttgagatggagtctcactctgtcccccaggctggagtgcagtgctgcaatctcagctcactacaacctccgcctgctaggttcaagtgattctcctgcctcagcctcctgaatagctgggattacgggggcccgccaccacgcccggctaatttttgtatttttagtagagacggggtttcaccatgttggccaggctggtctcaaactcctgacctcgtgatccgccctcctcggcctcccaaagtgttggaattacaggcgtgagccattgcgcccagggattttagaacctcattcattcgttattcagcaagtactgagcatctactaggtaccaatctctcttgcagatactgagggtacaggttgtgagcaaaacagacagaagatccctgccctcgtggcgctggcagtcagtttccaggaggatgtgatatatctagtgtgtgagatggtgagaagcactatgcagacagagaacgtaacagggcaaaagggcggaagagcagtcaaccagggaggggagaggaggtggcagctgaggtggagtatctcggggtaaaagaaccccccgaggagtgtgccccacaagaagctaaaagtggtgggtttgtttgagaccgagtcctcactctgtcacccaggctggagtgcagtggcgcaatctcagctcactgcaacctccacctcctgagttcaagcgactctccctaaagtagctggaattacaggcatgcagctaatttttgtatatttagtagagacagggtttcactgtgtcggccaggctggtctcgaactcctggcctcaagtgatccatccaccttggtctcccaaagttctgggattacaggcttgagccaccgccccatcctaaagtcggtttttttgttttaatcctccaaatccagtagtgctcagatgccatcctaaatggaggattggaggggagcctcccttagaaggaagatctgggcccctggaagccacaggactgctccttaagtcaagaactctgaatctggccaggtgcagtggcttatgcctataatcccaacactttgggaggccgaggcgggtggatcacttgaggtcaggagtccgagactagcctggctgacatggcgaaaccccatctctactaaaattacaaaaattagctgggtatggtggtgcatgcctgtaatcccagctacttgggaggctgagacaggagaatcacttgagctggggaggcggaggctgtagtgagcccagattgcgccactgcactccagcccgggcaacagagtgagactccacctcaaaaaaaatttttttaaaaagaactctgagttgccgggcgcggtggctcacgcctgtaatcccagcactttgggagtcccaggcgggcggatcacgaggtcaggagatcgagaccatcctggttaacatggtgaaaccccatctctactaaaaaaattagccgggcgtcgtggcgggcacctgtagtcccagctactcgggaggctgaggcaggagaatggggtgaacccgggaggcggaggttgcagtgagccgagatcgcgctgctgcactccagcctgggcgacagagcaagactccgtctcaaaaaaaaaaaaagaactctgagtcagcctggcgcagtggctcacacctgtaatctcagcactttgggaggccgaggcgggcagatcacgaggtcaggagatcgagaccatcctggctaacacgatgaaaccccgtctctactaaaaatacaaaaaattagcagagcgtggtggcgggcgcctgtagtcccagctactcgggaggctgaggcaggagaatggcatgaacctgggaggcggaggttgcagtgagccgagatagtggcactgcactccagcctgggcgaaagagtgagaatctgtctcaaaaaaaaaagaaaaaaactctgaatcccagagacccagggacttggaggaggtgaagggtgtggggctccagggacctggggctcagcttttcaggtctcctcctccaggaagctcttctttcgttcatcgtccctccctccttcagacaggtcaagcctcttcaggttcctcccataccacccctactccgtcttccaggcattcttggtgataattatttgtgcaatatttgtaccccctgcaatctggatgtcaaccctggaaaacaagcacctgatttgtcctgttacttctgcagcatccacacttagcaacattcattcacttggcagtgtttactgagcacctactacatgctaggccctgttgtaggtgctggggatacagtaggggaaaaacacagacaaacctcagggctggagagggcagaccctctagcacccaggacctgtttgttgagtaagtatttgttttttggatttgacctataagatgtgaaagaacagccagattcttccaggttctgccttttcctgatccctccctctctccctactaccaaatcccttccattttaaaattttaaatcctggtggggcacagtggctcacgcctataatcccagcagtttgggaggctaaggtaggcagatcacctgaggtcgggagttcgaggccagcctggccaagatggtgaaaccctgtctctactcaaaatacaaaaattagctgagtgtggtgacatatgcctgtaatcccagctactcgggaggttgaggcagaattgcttgaacccagaggcagaggttgcagggagccaagatggcgccactacactctggcctgggtgatacagcgagaatgtgtttcaaaaaaataaaatcctgagacctattagcctcctccccaacactcagtctcagtcttaacctcttgttcttttcattgccaactttttgtgtcattttgctgtctggtcatctatctctgctcagcccaccaccttcccctcaggcctccttggatgaagttaagtcattctctatttgaagaacccgcaacggctcccacttgccacaaagaggaaactaacttcctcggccccagcctactttgctgtctctgcagttcacacaggcccaaatggctttccttgaccctcattgagtggccttccccccttgcctagctaggaaggggccagagcgcttaaccaccctgatcccaaccttagtgcctttgggggccaggcgggtgataagtcccagcacctggggaatctggaggagccggaagggagtgtgccttgtgggaggggggtgatgtccttcctcagccccacccagctgttgcccccaggagccacatatccggacttctgtctggagctttagacagcaatctccaggccttctgtgtgggctgctacttcccaactgaaataacactctgtgggccaaagcaaacatgcaccacagtcagatctggcctgcagcaggcggctgacccctgctgctctgctcacctgggccacgccccgtgaacatcccccatgagcaagtccttccctggaactggcacaagggaccctggagggtggctgaaacatccccattttacagatggaggaagttgggcttggagacaaggctgccagctggaaagggtgtcagcgttaaataacaagattcagaaaataggattaagtatagagtttattcaagcctaaagcttgaggatggccaccccggagtgtggattcaagttgccccaaataaaccctttgactagctgtgattacaagtggactttttttttttttttttttgagacagggtctcaccctgtcactcagtctggagtgcagtgtgtgatcatggctcactgcagcatcagtttctcgggctcctggccttgagtgattctcctgccacagcctccctagtagctgggactacaggccctagccatcttgcccagctattttttttttttgagacggagtcttgctctattgcccaggctggagtgtagtggcacaatctctgctcactgcaacctccacctcccgggttcaagcgatcctcctgcctcagcccccctagcagctaggattacaggcacctgccaccatgcccgggtaatgtttatttttttagtagagatgggatttcgccatgctggccaggctggtctcgaactcctgacctcaggtgatccacctgctttggcctcccaaagtgctgggattacaggcgtgagccatcgtgccgggtttttgtttttttttttttttttttaagagatgaagtctcactatattgtccaggctggtctcaaactcctggcctcaagtgatcctccacccacttcggcctcccatagtgctgggattacaggcatgagccaacgcacccagtctgcaagtggatttttaaggaacaaagaagagagagttcctaaattgttaccaagaatttacattgaaacagcataaggtatctgcaggtctggctcagaaaaaaagataacagaaggtattgattggctatgcactgtttattgtatcacaaattccaggaacaagaagctaatggggagggcagctgtgcaggaaccactgcctcgggcatgggtggaggaggcgtgtgaccgaagtcccctattcactgtacagtctccctgggcctgatacatttcgcatagctcagactgatctgagctatttttcttttctcaagttgggtgggggtggcccctctggactggaaaagcctcatttttcccccaagtgacacacctgagtttgtttgacttgtttcccccaagtgacacacctgagtttgtgggacttgtgtggagatgatgtatttatgtcacacttcagtcttcgctgatggcttttttttttatatttatttacattttttcttttaaggtaggcagggccccattctatcgcccatgttggagtgcagtggcgaggtctctgggttcaagtgattccccttcctcagcctcccaagtagctgggaatacaggggcccgccaccacgcccagctaatttttgtatttttggtagagacggggtttcaccatattggccaggctggtctcgaactcctgacctcagggtgatccacccgcctcggcctcccaaagtgctgggattacaggcatgagccgcagcacccagccttttttctttctttcttttctttttgtttcccctcccgagaccgagtctctctctgtcacccaggctggagtgcagtggtatgatctcagcttactgcaacctccacctcccgggttcaagcaattctcccaccttagcctcctgagtagctgggattacaggtgcctgccaccacacccagataatttttctatttttagtagagatggggttttgccatgttggccagtctggtctcaaactcctggccccaagtgagcctcctgcctcggcctcccaaagtgctgggattacaggtgtgagccaccacacctggccttattttatttttaatttctgttcttgtattgctataatttactgatgatttcttacccaaagatcctcggcctgtccccacccaaggggactgccttccaccggggacccctcataagagttactcattaggatggtgttccctggggttcctgtgtgtatgacgccagggcctgtgcaccgcctccatggcccatctccatcagacagagctgggcagtggtgttggccctcgaaatgaggcttgtgccctggcctttcctggcctgggggctgagtgccaaggccacctgtaattaaactgagcttcctatgtttacttagcaagcactgacctctcatttcctggggccctatgctgagtgttccacagctattctttaatctttaaacagcccttgggacgcaggcactattattaacctcacatcacagctggggaaactgaggcacagagaggttaagtgacctgcacaaggtcgcagagccaggattcaaacccatgaactatgggccactcagtcgccatgctgtactgccgtgcacagcagaggaagatttgttcttgttcttgtttatattaaaagtgagaaaacatgggccacacgcagtggctcacgcctgtaatcccagcactttgggaggccaaggcgggtggatcacctgaggtcaggagtttgaaaccagcctgaccaacatggtgaactctggtctctactaaaaattcaaaaatcagccggaccgtagtggctcgcacctgtaatcccagctactcaggaggctgaggcaggagaatcgcttgaacccaggaggcagaggttgcagtgagttgagaccgtgccactgcactccaacctgggtgacagagcaagactccgtctccaaaaaaaaaaaaaaaggtgagaaaccacttaggctggctgagaactgcaaacatgcgtccacataaaaacttgaacttgcatgatcccagcagctttatttatcagagccaaaaagttgaaacaacctcaatgcctatcagcggctgaatggataaacaaaatgtggtccatccatgtagtggaatattattgagccttaaagaagagtgaagcgtcgacacgtgttacagatggatgaacctggaaaacaagatgccaagtgaaagaagccagacacaaaggctacatagtctattacatgaaatgtccagaacaggcacatcaacagagacagaaagttgcatcgtggctgggggaatgggaagtgactgcttaatggataagggggttacttagggaattataaaaatgcccaggctgggcgcagtggctcatgcccgtaatccgaacactttgggaggccgaggcaggtggatcgcttgagctcaggagcctaagcaacatgatgaatccccatctctacaaaaaatacaaaattagctgggtttggtggctcgcacctgtagtctcagctacttggggggctgaggtgggaggatcacttcggccccagagacggtttgcagtgagcagaaatcgcgccattgcacgccagcatggacagagtgagatcctgtctcaaaaaataataccttaaaactgattatagtaacagatgtaaaactccaaatatacttaaagccactgaattgtactgtattttttattttacttttttataaaaaaattatatatatatattgttttttcttttcttttcttttttcaagacagagtctcactttatcacccaagctggagtgcagaggcgcgatctcggctcactgcaacctccgcctcctgggttcaagtgaacacgtccggctaatttttatatttttagtagagacagggtatttcaccgtgttggccaggctggtctcaaactcctgacctcaagtggcccacccacctcggtctcccaaagtgctggaattacaggtgtgagccactgcacccagccttaattgtatactttaaatgggtgaattgtgtagcgtaagaatttatatctcgataaagctgtttaaaaaaaaaaaaactacgtaaaaaatgagcaaaggacccgaagagacatttttctaaagaagacatacaggcagccaacaaacatgaaaaaatgctcaacatcattaatcatcagagaaatgcaaatttaaaccacaatgaggtgccatctcacctcagtcagaatgtctgttactaaaaagtctaaaaaaacagatgctggcaaggatttggagtaaagggaccgcttacccactgttgatgggaatgtaaattagtacagcctctatggcaaacagcatggagatttctcaaagaactaaaaatagaactaccatttggtccagtattccactgagtatcctcccaaaggaaaagacatcattatatcaaaaagacacctgcgcttgtatgtttattgcagcactattcacaacagcaaagatatggaatcaacttaagtgtccatcgatgaatggaggattggataaagaaaatgtggtctatatctacaaagatttcatgacgaaattgccaaaagcagtgcagcaaaagcaaacattgacaaatgggatctaattaaactaaagagcttctgcacagcaaaagaaactatcctcagggtgaacagacaacctacagagtgggagaacatttttgcaatctatccatctgacaaaggtctaacatccagaacctacaaggaatttaaacaaatttacaagaaaagaaaaacctaaaaaagtgggcaaaggacacgaacagacacttctcaaaataagacagtcatgcagccaacaaacatgaaaaaaatgctcaacatcactgatcgttgagaaatgcaaatcaaaacaatgagataccatctcacaccagtcagaatggccattatcagaaagtcaagaaacaacagatgcaggcaaggttgtggagaaataggaatgcttttacactgttggtgggaatgtaaattagttgaactattatgaagacagtatggcgattcctcaaagatctagaaccagaaataccatttgacccagcaatcccattaccggtatatacccaaaagaatataaatcattctattacaaagatacatgtatgcgtatgttcattgcaggactattcacaataccaaagacatggactcaatccaaatgcccatcatggatagactggataaagaaaatgtacaggccgggcactgtggctgacgcctgtaatcctagcactttgagaggccgaggcggcggatcacgaggtcaggagatcgagaccatcctgggtaacacggtgaaaccccgtctctactaaaaatacaaaaaaattcgagtcccagctactcgggaggctgaggcaggagaatggtgtgaacccaggaggcggagcttgcagtgagccgagatggcaccactgcactccggcctgggcaaaagagtgagactccgtctcaaaaaaaaaaaagaaaagaaaaaagaaacctgcacatgtatcctggaacaataaaaaaaaaaagaaagaaagaaaatgtggtatatgtctaccatggaatactacacagccataaaaaaggatgggatcatgtcttttgcaccaacacagatggaactggaggccattatcctgagtaaaatagaaagtcaaataccacatgttctcacttataagtggaatctaaacagcagatacacaaagattggaataatggacagtggagactacaaaaggtgggagggagggaaacgggtgagggttgaaaaattaactgttggaggctgggcacagtggcgcacacctataatcccagcactttgggaggccgacacgggtggatcacgaggtcaggcgttcgaggccagcctggccaacatagtgaaaacccatctctattaaaaatattaaaaaattggccgggcgcggtggctcacgcctgtaatcccagcactttgggagcccgaggcagcagatcacgaggtcaggagattgagaccatcctggctaacatggtgaaaccccgtctctactaaaaatacaaaaaaaaaaaaaaaattagctgggcatggtagtgtgcgcctgtaatcccagctactcgggaggctgaggcaggagaattgcttgaaattgagaggtggaggttgcagtgagccgagatcacaccactgcactccggcctgggcaacagtgcgagactctgtctcaaaaaaaagaaaaattgactgttggaagccaggtgcattggtgcatgcctataatcccagcactttgggaggctgaggcgggctgctcactttgagttcaggagtttgagaccagcctgggcaacatggcaaaaccctatctctacaaaaacaaaaattagccgggcactggtggcacatgcctgcagtcccagccactcaagttgcagtgagccaagattgtgccactgcacttcagcctgggagacagagtgagaccctgtctcaaaaaagaaaaagaaaaattaactgttgggtacgctgtttgctattcaggtgatagatatgctaaaagcccagacttcacctctatgcaatatatgtatgtaagaaactggcacttgcacctgctaaaaatataataattttaaaatttttattttaataaaaaaatagaaacttagggccaaggggggagctgatcatttgaggtcaggagttcgagaccagcctggccaacgtggtgaaagcccatctctactaaaaatacaaaaattagccaggcatggtggcgggcgcctgtaatcccagctactcaggaggctgaggcacaagaatcccttgaaccagggatggaggttgcagtgaccaagattgctccactgcaccccagcctgggcaacagagcgagactcagtctcaaaaaaaaaaaaaagaaacttgagaaaaaatgctatgtaggaggtctgtaggtttcataggaaggtgagagaaagtatattactgaggggggatgaagacaatactcagcctttaaatgttttaaaatgtattttatgaaagtttttttttattgatttattttcagaggatttcccccccccccaaaaaaaaatcttatgaaaattttggggtgggctgggtacagtggctcacgcctataatcccagcactttgagaggctgaggtgggaggatcacttgagtccaggagttcaagaccagcctgggcaacatagcgagacattgtctctaccaaaacaaacaaaaaatacaaattagccaggtgtggtggtgcatgcctgtagtcccagcttgaacctgggaggtcaaggctgcagtgagctgggtggcccactgcactctagcctgggtgaaagtgaggccctgtctgagaaaaaaaaatgtagttgaaagaaaagaaaacttttatttttttattttcttttttaattttaaaggcagggtctcactctgttgcccaggctgttcttgaactcctaggctcaagcattcctcccaccttggcctcccaaagtgctgagattgaagtcttgagccactaccctggccatcatgtcaacttttaaacatacaaatataggtaagaatggcctggtggccgggcgcggtggctcacgcctgtaatcccagcactttgggaggctgaggcaagcggatcacgaggtcaggagattgagaccatcctggctaacacagtgaaaccccatctctactaaaaatacaaaaaagaaaaaaattagccaggcatggtggcaggcgcctgtagtcccagctactcaggaggctgaggcaggagaatggcgtgaacccgggaggcggagcttgcagtgagccgagatcgcgccactgcactccagcctggtcaacagagcaagactccgtatcaaaaaaaaaaagaagaatggcctggagcctccctcaccttctccacctagacccacttgacaatgggtgacatattttggtttttgctgaaccatttaggagtaacttgagatcatgacattgcgacttcatatcttctgggaaaaatagtgtgtgcacagccacaatttaattatcacacctcggaacatgaacagcaattccaaaatcatatgtaatatgaactcatagtacacgttatagttgtataatagaatagtcattttagtcttccctaaaatgtcttttccaggtggcttttttggaatcaggatgctgcgaagctgcctacgttgcatgtggagcctgcatttcccgtggggcccccttcgtggtggccctgcctggaggtgtctgggtccctcccccacccgactacttcactctctgtcctctctgcccaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcataggtgagcagggtaagggcgggaggcaaggaggtgggagggccgcggtgtgggagcatccccttgcgggtcagtttctctcttggcttcagctgtgaggttcacattctctgtgggtttccatccatcagcaaatgttcattaagcacctaccgcgtgccagatgcttttctgtgtgctgaggatgtggcaggcaaccaggcattcttgggaaaaacaaaaaaataagtattggctgggcgcagtggcccacccctgtaatcctagcactttggaaggccgagatgggcagatcgcctgaggtcaggagttcaagaccagcctggccaacatggtgaaaccctgtctctacgaaaaataaaaaattagctgggtgtggtggcccgtgcctataatcccagatactcaggaggctgagtcaggagaatcgcttgaacccaggaggcagaggttgcagtgagccgagattgtgccaccactgcactctagtctgggtgacagagcaagactcggtctaaaaaaaaaaaaagtattgaggttgggtgtggtggctcacgactataatccaagcactttgggaggctgaggcaggtagattgcttgagcccatggtggtgcgcagatgtggtcccagctacttgggaggctgaggtgggaggatcgcttgagaccaggaatttgaggctgcggtgagctgtgatcatgccactacactctagcctgggtgacagagtgaggccctatctctaataaataaataaaagagtaagtcaggcagttaaaggggccatggaagttggagagggccaagttgcaattctagctaaggaggtctggggatatttaggcagaaactaggagaggaggagccctctgggtatctaagggaagagcgttccaggcagacggaatggcaagtacaaaggccctgagacaggaatacctggagtatttgagggccaggaaggaagtcagggtggctggagacatatgagtgggggaaagtaggaagcaataaagtcaaggagaggatggggacagattggcaaaagccttgtggactataagaagcctttggcttttgcccagggaggataagagctgtagtaggttcttagcagcagacaggtttgatctggcttgggttctcaccagctcctcctggctgtgttgggaggggaaagaatgggagctgagaaaccacagggtaaggcaactacaaagtccgggtggggccgggtgctgtggctcacgcccataaccccagcactcagggaggccgaggtgggaggatcccttgagcctaggaatttgagaccatcctaggcaacatagtaagactcttgtctcaatgacaaaaaaaattttttttttttttgagacagagttttgctcttgttacccaggctgtagtggagtggcgcgatctcggctcactgcaacctccgcctcccaggttcaaccaattctcctgcctcagcctcccaagtagctgggattacaggctcccaccaccacacctagctaaatttttttgtatttttagtagagacggggttgcaccatgttggccaggctggtcttgaactcccgacctcaggtgatccgtccacctgggcctctcaaagtgctgggattataggcatgagccactgagcctggccaggaaagaaaaaaaaattgttttaattaaccaggctcagtgacttacctgtaatttcagctactcgagagactgaggtgggaggatcacctgagcccaggaggttgaggctgcagtgagctgtgattgtgctactgcactccatcctggacaagagagcgagaccctgtcttaaaacaagtccagtccgggcaggaagtaaaacggcttagaagtaggggacatagtggcctcattgagataggatgtgcagggaaggcgtcttagtcaagtcctagagtctgagaaggagctacctttgggcatagcagaggggcacgggcacagaaacctgggaggtgggcatgagatgggagctgggcgcgttccaggaatggaaagggggctggtgaggataggcaagggcttgggtgaccctcagcggggccacattacacgggcttcacaggtggaggcgaggaggctggactatgccctcagcatggttaagagccatgggaggtgtcaagccacaggagagatctggacaaacgtttgaggttgcaaaaaatgaccggcagcagtatgaggagtgattggaggagtggacggaggtagaagggagctgggacgagaggggagaagaggcattgctgggaagacggatgaggcagtggggggcagagggaagcgggcggcatatagtggtgtttttagaagatagtaggtgctgggcttgcccatggattgagggggaagcaggatcagagaggagtcccaggcctggtgcggtggctcacgcctgtaatcccagcactttaggaggccaaggtgggcagatcgctttgaggtcaggagtttcagaccactctgggcaacatggtgaggccccatctctacaagaaaaaaaaaaattagctgggcatggtagcacacacctgtagtcccagctacccaagaggctgaggtgggaggatcgcttgggcctgggaagcagagattgcaagtgagccaagattgcaccactgcactccagcacgagaccctgtctcaaaaaaaaaaaaaaaaaaataggactcccagcgggaaggtgactgatacttggcaaaaatagagaaggcagggaagattttttttgaaggatgcttttttttctttttcttttcctttttctttttttttttttttctttttttgagacaaagtctcactacattgtccaggctagactcgaactcctgggctcaggggatcctcctacctccgcctcctgcatagctgggattacaggcatgagtcaccacatccagctacgaatgctctttctttaaatcttgaggctgggcgtggtggctcactcctgtaatcccagcactttgggaggccgaggcgggcggatcacgaggtcaggaaatcgagaccatcctggctaacacggtgaaaccccatctctactaaaaatacaagaaattagccaggcgtggtggcgggtgccttagtcccagctactcgggagattgaggcaggagaatggcttgaacccgggaggcggagcttgcagtgagccgagatcgcgccactatactccagcctgggcgacagagtgagactctgtctggaaaaaaaaaaaaatatgttggaagtcccctgggagcccaccttccctaggcaacttcccagaagccacgtcactctggatgccttttcttcccccttctcagcccagagcgtctgagaaggtcaccctgtgctatccttgagtaaacacttccctttccagtaacacatgaaaccacagccgttttccataatacaaaggacagctcttctcctccccaccctcacaaacgcctctcttcttgtgcaatcatttgttctcatccagagataacttcagggctgggcacggtggctcacacctgtaatcccagcactttgggaggctgagaggcaacaagagcaaaactctgtctcaaaataaataaataaataatgagactcagaaaatatgattaagggccaggcgcagtggctcacgcctgtaatcccagcactttgggaggccgaggcaggcggatcacgaggtcaggagattgagaccatcctggctaacacggtgaaaccctgtctctactaaaaatacaaaaaaattagccgggcgtggtggcgggtgcctgtagtcccagctacttgggaggctgaggcaggagaatggcatgaacccaggaggcggagcttgcagtaagccgagatcgcatcactgcactccagcctgggcgacagagcgagactccatctcaaaaaaaaaaaaaaaaagaaaagaaaatatgattaagtgtagggtttaatcaagcccaaagcttgaggatgaccacctgggagcatagattgaagttgccctgaatatacacttcaagcaggggccaaggcaagcagctcttgcaagtgagcttttgtttgtttgtttgtttcttggagagagggtctccaaaactacaaataaaaattagctaggaatggtggcgcacacctgtaatcccagctactcaggaggctaaggcaggcgaattgctgaaaccagcaagggcaggttgcagtaagctgagattgcaccactgcactgcatcctgggtgacagcaagactctgtctcaaattaataaaaaaaaaagagagagagagagataacctcaagagcttccgtatacacactggtgcagaagtaaggaacaaaacagccaaagcctctgtcttcatgatgcgtgagccaccaaggaatagttggccagagtcggcggtcaggaaagtgcccttgacgaagtggggcttggagtggggtctggagaaggaggccaaagcaatccaggcacaaaatcaccaaccaaaaccccaaagtgggtggaggcagagactgaggagggcgtggatggggagcatgtggagtggccaggggaggtggccatggggaagtggtgggctcgggccctgagtcactattctaacagcttggagggcggccaggaggatgtggggaggcttgttggatgctccacgatggtcaggggagaaggcggtgggaagggagagctgggaagaagaggagagtcagaccgtgttgagaagttcagaggtggatacccaggtccagaaagcaacagaagatgtgagtctgggtgggggacacacatcataagcatgagctgctattcttcctggagttttgtttttgtgatttttttccatgttttccaagagaatgaggtggaaagggtataaaaaaaagaaacggctttgagattttctgcctttatcacacttccagtcattcaatcatctaatggtgattacaggaaaaggaacagggggcctttccagctggacctttgaaccacagtactcagttactcgctcggccttgatttgctttttttttttccttttttttttttttcttttggagacagagtctcactgtcacccaggctggagtgcagtggcacgatctcggctcactacaacctctgcctcccaggttcaagcaattctcttacctcagcctcccgagtacctgggattacaggcacctgccaccacgcccagctaatttttgcatttttagtagagatggggtttcaccacgttggccacgctagtctagaactcctgacctcaggtgatctgcccacctgggcctcccaaagtgctgggattacaggcatgagccactgcgcccatcctaatttttgtattttcagtagagatgagttttcaccatgttggccagactggtctcaaattcctggcctcaagtgatccaccctcctcagcctcctaaagtgctggtattgcaggtgtgaaccaccacgcccgaccagcttttttttaaatctcagcctcctctaggcttttggaccctgtctctgcatctctggcagggcgaagagacagtataccgaaatggccaggccaggcgcctgtaacctcagagctttggggagccgaggtgggaagatggcttgtgctcaggagtttgagatcagcctgggcaacatagcaagaactcatctctacaaaaaaatttaaaaattagccgggcatggtggtgcatgcctatggtcctagctactctggaggccaaggcgggaggatcacttgagcctaggaggtgcaggctgcagcaagctatgatcacaccactgcactcgagaccaggtgacagagcgggcccctgtctctaaaaaataaataaagtaaaataaaatgggcaacacttggatagggcagtgcaggccagacattaccctaagccatttacctatcaatgtattatttaattcacacagcaatcctaggggtgggtactttcattatccccattttacaaaacaagaaacagctacagagttgcaaaaccacttatcccaagccaggccgctgataagcagcagagctgggattggaaccccggcagttagggcctaaccaccctgctcctctgctgagtgtttgttgaatgactgccggtgaggagtgacgcaccccctctcctcctctccccagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctgtgagtgtatcgggggtgacccctcccccatcaaaactgcctacactggcttctctaaagcactgtctacattgtctctgaatgttgtctacgtgggttccctgaagccaaattctgcactaccttcctgccattgtctacactggctcccatgggcaaatctacatacttccccctcattgtctacattggctttactgggttcctgcatgctgtgcctagtctgtggtaacctgggatgggcttgcaagagccagtttgatacatttctttccaattccacatccaatgaagtcttctcggtagcttgaaatcaaccttggggaatatttacaccaaggaaattggcaaaccctagaaatgggggcttcttttattccccagagagttggtttaccagcaaagagctgcccccaacagtgtcttttctggctcccatggaccccggttgacactgcccctggaccgttagatcaatcatgctgggccatgtccacatgtctacatgtctacactgcccaacctaacatcgtctccacaccttcccatacttctgccttgacttccctaggtgccatctatactgagtctcccagagtctctacaccgacccctgatccctgatattatttacattgtatttattatttattatttattattatatttttatatattatatattatataaaatatataaattatatattatatattaacatatattttgtcattatttattattgttatttaatataatataattacattatattatatattacattacaggctccaccccccgggccctgttgatcctgacccctcccactgggttttttgctagctcttccagaaactgcctatactcacacctcgtaatgttacccagagaggccaccctggcactcttcacacagaatccctcaaatactggcttaaccacctcttccaccactgtccaaaatgaccacatatcccaactcaatgttgtctacactagctccccaggcaatgcctccacttacacagattccctaagccaagtctacaccagctcccccaggcaacatgcatcacgtgcgcccataagtgcaacagctcccctgagcctcgtctgtgccactttcctcccgggacctacactggttgcccaaaccctgttttgacatcctccctccatgccaaaaacacacacacaggccgggtgcggtggctcacacctgcaatcccagcactttgggaggccaaggcgggcagatcacttgaggtcaggagttcgggactagcctgggcaacatggtgaaaccctgtctgtactaaaaataccaaaattagctggacgtggtggtacatgcctgtaatcccagccatttgggaggctgaggcggagggatggcttgagcccaggacgtggagtttgcagtaaaccaggatcaccccactgctctccatcctgggcaacagagcaagatcctgtctcaaaaacacacacacacacacacacacacattatttgtagtggctcccttaggcactgccagcactgaacaataactcccacaaaattatccacagtggtttccctgaacagtgtctacactgacatcagcacacaacagcctggactgatttgccccagacagttttgactgctgtacctcctgccaacccgccccgtttctttagcattcctgtctatctgctaacttgtccacccgctctgggattctcctccttgctgatccagtccccccatttcccccagaccctcctgaagtgtccatctccggctatgatgacaactggtacctcggccgtactgatgccaccctgagctgtgacgtccgcagcaacccagagcccacgggctatgactggagcacgtgagtcacgtggtctcagaaccctgggtctgagggaggcgggactgggggcctggactcctggatctaagggaggaggggctgggggcctggactcctggatctgagggaggaggggctgggcctaaattcctaagtcctccaggatgaagggagcttgcattttggcaatttggggtctccgggagtacttaggtccctggagcttggctcctggtgggtgtatctttagggatgaggcctgtgctcccctctcgaccttggtatccctctcacctgaccccacacccctccaggacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgaggtgagtgggtcttgggggccgtgtgtggagacctgggtccgctcccctggagttctgcccttcaggacttggggctgcactgggggaggctgcgccgccgacctgggagggatgcagacctgcctggctgaggggagatgagggttggccttcccctcgtggcctcagactggggtctggatttggggtgtcggggtaggtgaaggcagcagagttggggggttgaggactttgctcggggttcctagaaagtagaggcctgggtagggtcctcacgaatagacccgaggaagctgccctgggctccagctcctgagaaagacgcacacctagagtcaggcatgcaaacttcaaagagacagaaaccaagagctcccacccccagaaacacaatccggccccaaggcacggagccaaagaggaaaagcacaaagccagaccatcacccagtgatggaaactgggtcaaactcacaactgcagggccacacacctagagcgcggccgggactgttaacagagccatgcttcctgggacagagagacccctgggtcctggagatagggccagagacccctcctgtcagagccacagctggcaggatccacagccacagacactccctgtgctgagaaattctgttgcagagatgcatcagaatccagacactcacctggatggtaaccctgcacgctcaaacccattgtcaccaagacacacacccaggaggacagtggcaccagccaagatagactgaacgaagccagatgacacctggaaagggacattctttttttttttttttgagatggagtctcgctctgtcgcccaggctgaagtgtagtggcgcaatctcagctcaccgcaacctccgcctcccgggttcaagcaattatcctgcctcagcctcctgagtagctgggactatatgcgctcaccaccaaacccggctaagttttgtatttttagtagagacagggtttcaccatattggtcaggctggtctcgaactgctgacctcaggtgatccacccgcctcggcctcacgaagtgctgggattatatgcatgagccactgcgcctggccagaaaaagacattcttagaaacacgccagggcgacggtccatgcagcacacctgtgcaaacacgcaatgtgcaggccccccagaaacatgactgaaggtgtagggacaaactcccagacaggggctgtccctgtcatgcagacagactagccacggagggacagaagcagacccccttactgagtcataatcttagaatgcacacacacttgcagggacacccgagggaaaacagacccctcttcaggaatccagatacagccagggagataggacacccctacgggaaacactgtcacagacagcaaacccagagagacagctgtcccgctctgggctcgcctggcgcgtgaggatgcacataagtccccggaggaagacgtcacacagacacgctgggggcaaaactaatccaggacagcaacggctgcacacggaggaatgtcatccctcactcacagaccctcagacggaaaatcaaagacatcctgggaggagcttcttcccaggaactctcccgaaactccccgaaactcctccgaaattatccagaaagtccgttagggagattctcattcaacaaatatgtgtttcctgtttgctaggcactcttgctgaggttgggaatacaatggtgaatgagccacagtccctgccctcagtagcacacccaggggagggtcagctccacccgcccagacagacaccgaactggaaatacacccctaacctctaccccagatacacctgacaagctgatcccctgcccacacacccagcaggtggctccaaggtcagagcctgcagaacacagacgcaatagagaaagactcagcgctgtggaaagacacccccacctacccacgacagtggccacagggccacccccagccaataacaccattacaaagacacgtgccttcagataatgcctgcagaaacgtgcatgctccaagcactctagaaatcccgtctcaagcagtgagtgccccgacagccacagccagaggagacacactcaaagctcctggggtcactctcagagggtctctgagccacgaacccacatccaggcacacacagagtcgtcacagagacacagtatggagtccacagcagcacgaacataggatacgaacgccgcaccacaggacagatctatctttagggagactcagagaactttttatttttaatagagacagggtctcgctatgttggccaggctggtcttgaactcctggcctcaaagcattcctccagctttggcctcccaaagtgctgggattacaggtatgagccagcacactaagcctgattcagagctttgaaccctagacatatgaacagactcagcttcgagttccaaaacaccaatgccacctccagaaacagagacaagcctcccaagataggctcaacctggtccagttagtgaccagcacaggagaaaaatctgtttcactcctcaacccagtgtatagttagagacatatataccaccctaccccctaccaaaaaagattttatcctcctttttttaatgctatttgtgagtcactaagctgatttgacagcccgctgggtcatgaccccctgtttgaaaacaacagaaacagatgtccttcctgggtctcagcccctcctgtgtgtcgaggtgtagaggtggggtcaggtgtgggtgaaccccccacccccgtctgtcccagttatgccttgcatgcagggatgggggaagtggatgtgggtaggttctggttacattgacttctgtccctggcttggggcccaggagccccatccctccctgctcacactgccctcctcagcacttcatggcttcctctctctctccgcctccccactacctcccatcccccatccccacctgctcagcccctgcagggagcactaaggaagtcccactgtcccggtctgtgagaaccccattttacacactggggataagtggcctagagatgaggcagccacggcacttggaataaatgctcccagccactcaagagggcagaattatcaggaatctgtggccctctgcagagagctttgggatcagacagcctcccactgaaacccagctgtcctcccccgagggggtgtggcccccaagctcatagctttgtgaggaccccacagcacattcagggagggctgcgaagtcagatggcaccagggtcctggccagtgaccgggcggccagatctattgcatccaaatagccagcttccactcggctacggcgatcgccagacatgggagtttggtgttgctagatctgatttgtccccctaagagaaacctggatttttaagtgaaatcgcctgatttttgaaaggttggctagcaatttaaattttgcaaaacactaacacctggggaccaccggttggcatccccctccttgtacaaagtggtgctcaggctgtagcgaagggcggaggggcttctgcttccccacccccctcctcctcctcctccattcttctgcccagagtcaccccctcattctggtcactcccgctccctccatccccgcctatcctgcatctcccccaccccctcactccccagagcgatcctcgtgatcttgtgtctccctttctctctctctcacccctccttctctctctcctcagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacatcaggggtgtcttgtaatacatcagaccccctccttgcatgttggggaaagagagggtgggacagggactcctaggtcccagggctgggaagagctgatccacgcccccggggaacgagagcctggcaggggttagactggggaaggctgtggggctcggaccacttggatccttgaaagacgcattggatggccgagaaccgcaaggctcgtgcaactaggattcaggtcactggattggggactcagaggcctggacatttggactcctgggtcccaggacagaggctgcctttctggatggtgtggccagacccatcagaggcaggagttctctggactcctgggccctcgggtggaggtgggggtggggacagcaggggctcagccaggttccctgcgtcctgagagaatgaggccagagggctgtgatccagtggagcctcagacctcaactcccccaggttgctgggggtctcgggaggggagggctgctccccactcccattcttaggggccctaagggcatggggcaggcggggggtgctggggaagtcccacctctggccaccccgactgtggctcccctccttctccatccttgcccccagggatcaccccaggggacttttcagtggctccctgggagtggcggcagctccctccagctcctctcaactggaaaagcaaagacggggggaggggcggcccttggtccttgaactcccaggctcagtaagggacaggtttttacccgcgtcacctctgctctcccaagcctccatgcctcctctgtaacacggggcaggtgtttccatcggcctcacaaggctgtcgtgggacccagtaaggacatgcccgtgatgccctcatgcagcctcattgacctccacagaccccaccaagccctgtgccaggcagtgctggggctgcagctgtggcctgcacagacccagtgccgtcctccggtgtgcacggccataatgaccacaagaatagcagcagtatgtttaggatgaaggtgtgtgtgtggaccgaggggcagtctctctctctcactcccccaccctctgaagccctccagaggatgccaggctgtggaacgggagcagtggagatccaacagtccagcgtcctctggaagcttcctcctcatctggagagtgaggccgatgcatgcgtgacccccacgggcccttccatacttgttacttcctctggttgtttgttgtctgtactcacccacccaccccacccggacaaccggagggcaggggcggggaattgggtccgcctggcacacagtggatccttcagtgccatgctgagtcctccttacacacccagcaaacacctactgtgtgccgaacctcaggcacacagtctagtatggaaattggcaagtaaacgggtaaccactccaaaaactcttccattaggaaagacttgagaaatggaaacgggaggtgctagcaaggaaggagaggcccaggagcaaacaggcttctcgcttctcgaccccttttcctgtcttgccttttttttttttttttttttttttttttgagacggtgtctagctctgttacccaggctggagtgcagtggtacgatctcggctcactgcaccctccacctcccaagttcaagcaattctcctgtctcagcctcttgagtaacgcacccagcctttttttttttaagaagtggggtggtctccctatattacccagattgggctcaaactcctgggctcaagcgatcgatcctcccacttcagcctccaaaagtgctgggatgacaggtgtgagtcactgtgcctggcccctggctaattttttttttttttttttaagacggagtttcactcttatccaggctggagtgcaatggcgcgatcttggctcatggcaacctccacttcccaggttcaagcaattctcctgcctcagcctcctgagtagctgggattacaggcgcgcgctagcatgcccagctaaca

SEQ ID NO: 13435 - DNA, 18989 bp, Human
acaagcatcagatccaagttagagagggcacccggggacagaaacctccaagccagccaaaagccaaaggaaggattttacagaaagatacaggaatgtggggccaggcacagtggctcatgcctgcaatcctagcactttgggaggccgaggtgggaggatcgcttgcggccaggaattcaaggccagcctgagcaacatagcgagatcctatctctacaacaaatttaaaaactagctgggtgtgatcacatatgcctgtggtcccaactacccaggaggctgaggcaggagttgagcccaggaggtggaggctgcaatgagcaatgatggcgccacttcactccagcctcagtgaaatagtgagaccctgtctaaaaataataataaaaataaaaaacatataaagatgtcagagcacagggaccagagctgttagtcggcctcatggagaccctggccaggacagccacctctggggaccaggaagtctctcagtttctgtctctgagggtttggctctctgagtctctctgtcacctctcatttctctctcatctccctctgtctatgctgtgtctctatctctttcaatctctctgtctctgtctcccagcccttatctctgagtgtgtctgtttctctctcatttctctctctctctctctctctttctctctctctctttctctctctctctttctctctcccccctccctcctcccctctccctactgcaggctggtccataacccttatcttccccagacctgatggagttctggtattaatctgtttatggtctgtttccctccactagaacacggtcttcattaaaggcagagatttttgtctgtcttattttctgctgtatacccagtgcctgggatactggctggatcaataaatatatgctgaatgaagaatgaatgaatgaccattctcatgaacattattatttgatgccaactgtaaagcaacaataataataattgtcactgccactgctgctattgttggtatatcagctttttatttagtacaaactatatccccgaaattgagctaggcagtttcttgtttaagttttacagaccacgctgtgaggtaagtactgttagtatgcccttttttctttctttttgagacagagtctcactctgtcgcccaggctggagtgcagaggcccgatcttggctcactgcaacctctgcctcccgggtacaagtgattttcctgtcttagcctccccagtagctgggattacaggcatgtgccaccatgccggctaatttttgtatttttagtaaagatgggtttttgccatgttggccaggctggtcttgaactcctggacctctggtgatcctcctgcctcggcctcccaaagtgctgggattacaggcgtcagccactgcgcttgctcccccagcccccaaacttttttttttttttttgagacaggtctggctctgccacccaagctgtagtgtagtggcgcaatggtagctcactgaagcctctaactcctgggttcacacagtcctcctgcctcagcctcccaaaatgctggaattcaggcctgagccaccgcgccctactatgcccatttttcagataaagaatctgagggccctcgaggagaaaccacttgcccaacatgagccctggtcttgtctgaccccaaagcccatgggaagtttaggctgcgtggaaggacagcctggtgggctcaggatctgtcccatcacgagttggaacctcagctctgccactcggcaaccgcgagccgttagtaagttgctgaatctctccgtgtgcctccgtttcctcacctggaatgtgggcgacctcacacaggaagccgcctcttctagtgggcaccgacggagcgagcgcgcgtctgcagcgggactgagcgccgggagagacctgcgcaggcgcaggcgcgcggggagggccagcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagctggcgccgggaagcgaggagacgcccgcgggaggcccagctgctcggagcaactggcatggcccgagccatggccgccgcgtggccgctgctgctggtggcgctactggtgctgtcctggccacccccaggaaccggtgagtgacccccgcgcagtccggtggcccctgtctggctcccagctccgcatccaggccgggtactcgcccccttgggttcccgaagatgacggccccgcccggcgccacccaccccccatctctgccccggggttggaaggaacacggtgcgagggtgcgagggcaggaccctcctcttggccacccggagagcggtcggagttgggtacagaaattcctcgaaattggcagcaacacgggtcgggcacaagaccctcctctgggcccctcggaaaggggatggagttgggtgaggaaatttcccaaaaaggcaagtgaatcccggaaaatcagcagatggtgacgcatgccggattaccttacccaggttcctgctcagcatacccaggccataacccagcagcgtgctggcaggctgggtctggacggaggggatggttgatgttggggaggaggacagtgggtgacacttgacaccattacccctctgacccccaatgtctgactccaggggcctggccattcattcattctttcattcttttttttttttttttgagacagtctcactccatcacccaggctggagtgcagtgtcctgctctcggctcactgcagcctcctcctcccgagttcaagcgattctcctgcttcagcctcccgagtagctcggattacagacatgtgccactatgcctggctaatatttttgtatttttagtagatacaggatttcaccatgttggccaggctggtctcaaactcctgataaatatatatattatatattattattatatattacatattatagtaatatataataaaaatatataatatatattatagtaatatataatatataataaaatatataatatatattatagtaatatataatatataataaaatatataatatatattatagtaatatataatatattataatatattatatatattattataatatataatatgtatattatatattatatatattattataatatataatatgtattatgtattatataattgataatatataataatatatttcttaataaatatatattaaatatattatatatttataacatatattatttatataataaataatatatattttattatacatttaaagagtaaatagataacatattttattatttatttatatattttgtgtatatatatatatatatatatatatatatatagtgcgtgtgtgcgtgtatgtgtgtgtgtgtatgagagagacaaggtcttgctttgttgcccaggctggagtgcagtggtacaatcccggctcattgcaaactcgacttcccaggctcaagcgatcctctcactgtggcttctggagtagctgggattataggtgctcacctggctaattttttttgtatttttggtagagacagggtttcgctatgctgcccaggctggttgcagccaagcacagtggctcatgcctgtaatcccaacactttgggaggctgtggtgggaggatcacttgagcttaggaattcaaaaccagcctgggcaatatggcaagaccccatctctacaaaaataattaactaaataaaaatttaaaaataaaaaagaatgcataggaccatgtttattagtgtcaataagcgctgtcacattttgaggacctactatgtgctagggcccttagcagaaagatttttatataggacctgggggattagaggtcagtctctgaccgcccaagttcaaatcccacctctgccactaaacctctgtatgacttggaggacactatactctgtgtcagtttccctgtctgtaaaatgatgttaacagtagtgcttgcctcaggggggctatttgaggattaaatgccaagatatatgtgaagcacccagaatagcccctgatctgtgtcagcaccctgtgagtgtccactgttctaagtctcattttacaaactaggaaaaagaatcagagaggttaagtaaccggcctgaagctccacagcagaaaactgaagggacccaaaactcctgggctataattgccttcctctcgtgcctcaatcccccacattcttccaaccaggacccacccagagtaataatgcagcgtttcatggatttgaagacccaagatttctccccgttttctacattggggttattctaacccctaatggcaagttgtgctataaatgacaacagtcatggtatgtgaaacctacgacactggtgcgatgaaaaagttctgggccaggtgcggtggctcatacctgtaatcccagcactttgggaggccgtagtgggaggatcacttgaggtcaggagttcaagaccagcctggccaacatggtgaaaccccatctctgctaaaaacaaaaatacaaaaaattagccaggtgtggtggtgggagcctgtcatcccagctacgcggaaagctgaggcaggagaaccgcttgaaccccagaggcagagcttgcagtgagcagagatcgcgccactgcactccccctgggcgacagagagagactccgtctcaaaaaaaaaagagaagaaaagaaaaagttctggcgctatatagtagtaacggttgcacaatatcgtgaaatgtacatagtgccactgaactgtatgctttaaatgacttaaatggtaaatttagttttttaaccacaatatttaccacaattttttaaatcagtgatgttgagattcagggaaatacggtaataatagaagaaatacggtaataaatagccaaagtgaaggagcacggccaagttgcagaccatcccagacgcccttaccctcctcgcctgccatggccccaactagtgccccagttccccctccccccacaccccacggtccaccggggatccagggccccagcgtgcaagtgcacgcccaggtgcccgggctcctggagcccctccctatctagtccaagaacgccccgggtctgacaccttctcttcggttctccgcaggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttggtgagcagggggttttggggaggctgaatgaaaggcagagacttggtgggaggatcagggaagttggcaaagagcggggaggcctgggagggagggagattccctccacagcagatcccctggggacaaaaggagggggcagcgcaatgatgtggggtggggtgggggggaggtgagtggggggaggggctgcagggcaggaagaaagcagagatctcagggagtaaggacccccaagcctgggatcagaaagccctgagggaggaggaggggtatattggaaagggagctgggaggggactgggaaggaagggaggaggcctgggtggcctcttctgggtccctcctttcctcatctgtaaaagggttggtgacaacagcatcacccttggaaagctgtcctgagtgtcatcactgcctaggaaagagtctgtctgcccccttggactgtgtacccatgagggcagaaccggggctattttgatcactgctgggccccagcactttccaccaaacaatatttattgagcacttattatgtgccattctaagagctttacctgcatattctaattgcctgtgattccatcattatcacctgttgacagacaaggaaactgaggcacagacttgcccaagaccaaagctgcagccttagggcagcggcgcttcaccgctggcccatgtgagccccttagagctgtcggttactgttactttatctggtgaagaaggagaaagttgaaacagacagacaggaaagcaaggatcctgatacccaaaagaggaggggatcatgctttcattttcatgagctccatgaagccttcctcttggaacttgagcaagaagtctctgtgcctcagtttcctcatctgtgggatagggatcaccatgaggattcaaaaaaactgaccctttttttttttttgagatagtttagttctgtcgcccaggctggagtgcagtggtgtgatcatagtaggtcctcactgcagcctggaactcctgggctcaagggatgttcctaccctccctgtagctggaattacaggaatgtgccaccatgcccaacttgttttctgttttgttttgttttgttttgttttgttttctttttaagcttatgtgccaagaactattccaagcctgtgcatgagaaactcatgaaatgtcaagggcttggaactgtgcctagcacacaacacccaaccaaaggcagctgttgtcactccagcaagcctgggattctgggtatcatggtttaggatgagggtaaaacagaaacagtgagtcaagttaaggagaaatcttcggtaaataatataggtaatgatggggaaggaagttccaggtttgggaatcaccaggatgatgattaagagatggtcaaggtggttttggagtcagacagactttatgtgaaagcccagctctgctgcttacagctgtgtgaccatgggcaagtcacttcccttctcaacttcagggctcaggcttcctctcctccactgagccccagaccaggataaccccctttgggtttcccctttccagccctgccctctccgagtcatcactgcctaggaaagagtccgtctgcccccttggactgtgtacccatgagggcagaaccagggctattttggtcactgctgggctccagcactttccaccaaacaatatttattgagcgcttattatataccattctaagagctttacctgcatattctcattgcctgtgatcccatcactatcccctgtcaacagacaaggaaactgaggcacagacttgcccaagaccacacagctgctcagggacacagctgggatttaaaccatgccattctgtatcttttttttttttttttttttgaggcagaatctcactctgtcgcccaggctggagagcagtgacacaatctcagctcactgcaacctccgcctcccgagttcaagcaattctctggtctcagcctcccaagtaactgggattactggcgtgtgccaccataccctggctaatttttaatagagacagtttctccatgttggccaggctggtctcgaactcctgaccccaagtgatccacccacctcagccccccaaagttctgggattataggcgtgagccaccccgcccagcaaccatgccatcctgtacccttaatgaatgcccccttctgccacggaggggttcattgaatgacttgttgcttttgttcctcttcccagccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactgtgagtgtgcccaagtcagcgatggcaagaacccctgccgggctgcccccaccactgtctacactgactccccaaggcactgtaggcattgcttccatcatctgcaccggctcccctgactcctgtctacacgacccacccccattgtctgcaccagctcccctgggccgtaaacaacactgtccctattgtctacaccagtttacttgggccatagtcaatgctggtacccagactgtctgccctggctcctctagcggctgtctgcacggatacctgacactctgttgactcccttgagcacagtctacactgcccctaaactgcctacacccatttccccaggcaagtatccacaatgaccctccccacattgctacactggttcttctggccacgatcaacactgcctcccttattgtctacacccactcccttgtccttttctttctttcctttttttttttttttttttgaaatagagtctcactctgttacccaggctgcagtacagtggcatgttctcggctcactgtaacctctgcctcccaaattcaggtggttctcctacctcagcctcccaaatagctgggattaaaggtgcacaccaccacacctggctaatttttgtatttttagtagagacagggtttcatcatgttggccaggctggtttcgaactcctgacctcaggtgatcggcctgcctcagcctcccaaagtatgctggaattataggcatgagccactgtgcccggctttttgttttgttttgtttttcctttggacagggtctcgctctgtcacccaggctggagtgtaggggcatgatcatggttcctacagcctcacccttccaggctcaagcaatccttctccctcagcctcccaagtaactgggactacaggtgcagccaccatgcccggctaattttacagtttttttctagagagagttttgctgtgttgcccaggctggtctcaaactcctaggcttaagtgatcctcccgcctcagtctcccgaagtgctgagattacaggcgtgagccactgcacctggccccttgtccattttctacactgccttaccattgtctacactggctctcctgggccacagacagcactaaccccattgtctacaccacctattttggccaccagctgtggggtgttttcactgtctcccatagtgtctacactggctcctatgaccactgtctatgtaaacaccccactttttctacactggttctcctaggcactctctaaagtgccccctgacactgtctacactgactccctggagaactgtctgcattcacctcccacattgtatcgaccagttcccctgagccacgatcaactgtctccgccgggtgctagttgcattgatcttctcacattgtttgtgctggctcccctaagcagtgtctgcagagtcccccagtgtagtctccatgttcctctgcccaatattgtctacactggctcatctacaggctatccagtctcaccccacatcaccacactggcctccttgtgttctgtctgcacagccccctgacagcatctgtcctgattctcctgcacagcgttacctccaccagctccctcatggcatcatcgacattgacacccacacatttatctccactgacagccccaggactctctaaccagtgctgtctaacagaaatagcatgcaagctgcatataggattttaaattctccagcggccaccccattaaaaaattaaaagaaagaggccaggcacggtggctcacgcctgtaatcccagcactttgggaggccgaggcaggtggatcacctgaggtcaggcattcaagaccagcctgatcaatgtggtgaaactctgtcttcactaaaaaatacaaaaattagccaggcacggtggcgggtgcctgtaatcccagctactcgggagactgaggcaggagaatcacttgaacctgggaggcggagattgcaatgagcgagattacgccattgcactccagcctgggcagcagagcaaaactccatctcaaaaacaagaaaagaaagagatgaaatttatttgtttatttatttatctatttatttatttgagacggggtcttactctgtcacccagactggagtgcagtggcacagctccctgcagcctcaacctcctgggcttaagtgatcctcccacctcagcctcagtctcctgagtagctgggactacaggcgtgtgacaccatgcctagctaatttttgtttttgtttttgtttttgtttttttgttttgtgatgaagtcttgctctgtcacccaggctagagtgcagtggcacgatctcaactcactgcagcctccgcctctcgggttcaagtgattctcctgcctcagcctcccgagtagctgggattacaagccctggccacagtgcccagctaatttttgtatttgtggtagagacgggatttcaccatgttggccaggctggtctcaaactcctgacctcgtgatccacccaccttggcctcccaaattgctgggattacagacgtgagccaccgcacccggcctatttttattttttctggagacaggatctccctatgttgcccaggctggtctcaaactcctgggctcaagtgatcctcctgcctcaacctcccaaggtactgggattacaggcatgagccactgtgcctggccaaaattaatttttaataattgcctttacttaacccaatatacctaaaatattatttcaacttgtaattgtttttttaaaattattcttgagatctttcccatttattttgtcctagtaaagcctttgaaatctggtgtgtatttcggcctggctatatttcgagtgctcagtagtcacatgtggccagtaggtgccatattggacagcacagatctagactaagctcccacatcatctacactggctcatccaaatactgtctacacacatacacagagcctgtcttaatttcgtcagctcccggggacacactgtatatgtgggggtgatctcacccccaccaccacattttcaacactggcccgacaatatagcatctgctgtaatattccaacaccctgtctacactgaacccatcagtaatatccacacaagctcttctagacatcattcatactgttcctcccaccattgtctatactgcttactccccgccaggcaattggtacacagattccctcaggtactgtctatactggagtccctcaacactgtcactgggtctgagcgaggaggagatctacactgactcctacccctcgcccccgaataaaaccctgtcccattggcctgcccccaaggacattgaaaggtcttcgctgtcaatcacgtatgggatggctgagcagcagcctagagcagggttatctgggactctttcctgcaggacttgtcagaaccttgaatacactgctgtgtgttgtgagtggtcattgcctatgagtgagaaaaggaggaggcattttcctgcaggacacccaagacatgcctggtccaggctacccaggaaagctagtggagaaaagcagctcctcagaagccttctccatgtccccactgaccaaggactcctaggcttctgctctctgtggcaccccatctacctagactcctcctaggcctctccagctcccgctgttttccaaatatccccgggccttttcctgcagtgtcgtgaatcccgcgtagccccaggccccccaaagcctcccagtctctgaacctctgtatccatttcctgcagaccccccagaggtatccatctctggctatgataacaactggtaccttggccagaatgaggccaccctgacctgcgatgctcgcagcaacccagagcccacaggctataattggagcacgtgagtcctgggtctcagggaggaggggctgggggtctggatttctagcactgagggaggaggggctgggggcctggactcctgggactgagggagaaggggctgggggcccggacccctgggtctgagggacgagaggctgggagcccggactcctgggtctgagggaagaggggctgggggtctggacccctgggactgagagaggaggggctgggcctggacccctgggtctgagggaggaggggctggggggtctggacccctgggtctgagggaggagaagctgggagcctggacccctgggtctgaggcaggacagactggggcctggactcctggtctaagagaggagggagattcagaaaagagaaaaagaggaggttgacttcgggcccccagtggggggcatctctgttttgacatctctgttttgcggttgaggcgtttagcaggtggttgaatcctggctggtggatgcacctgctttttggggtgtgcctgctctgtgcccggtacttcccccgaatcccatgtgaccccatgctgtgcacagtcagcagctgttgccctgcccaggttaaagaccagccacgagagggcagaagcggcccttgaatcagcgctcggctccaaagctggtcctccgcctcttggccaagcttgtctaacctgcaggccacatcatttgtaaactttcttaaaacattatgagactttttttttgcgaatttttttagctcattagctattgttagtgttagtgtattttatgtatggcccaggacagttcttcttcttccaatgtggcccggggaagccaaaagattggacacccccactctagactgtaaccacctcaccgtcaccttgtgtaacctacttggttatctctggatggagcaagtactatatatccccattgtctagatgagaaagttgaggctcacagcaataagatttccccagattcacactgaggctgagatcaagagcaaggtaagaaaaaggcaaagagataatacataattttataatacataattttacataaattacataattttactgaaccgccctttttttttaaagaaggggctctgttgccgaggctggagtgcagtggcgtgatcatagctcactgcagcctggacctccctgggctcaggtgatcctcccacctcagcctcctgagtagctgggactacaggcacacgccaccacactcagctaattttgttgtattttttttgcagagacagggttttgccacattgcccaggctggtctgcaactcctgggctcaagcaatcaacccacctcagcctcctaaagtgctgggattacaggcgtgagccacctcgcccagccttaggtctttttccttattacaaaaataacttgtgtccactgtagaaatatcaaacaatttagttatgagcaaaaagaagaaagtagtgcctatagttcaagtgtacccagccacctccagaaatacccagtgaccccttattatacatcctgtcttttttctctctgtttctaaacaaagactggaattatgctgtacatataattttgaaccttttcgtctgtcttgtgaatacctttccatgtcaaagcacatagatccacaactccattttcccccacgttgtattaggaagactgtcaaacatacagaaaaatcataggaattttccagtgaacacttaagattccaccacgtggattcccctgctaacattttactgtgcttgctttatcacgtttctgtgattccttcagtccctctattcatccatcaatcatattatgcatttcagagcacccccagctctcctgctttttttttttttttttttttttttgaggcagggcctcactctgttgctcaggctgtagtgccgtggcacaatcacagctcactgcagccttgaattcctgggctcaagcgatcctccagcttcagcctcccagatagctgggactacaggcacacaccaccacgcctggctaacctggccccttttttagtgttgctgggattccaccactttaaaaaaaaaattcaaagaatagagacaggatctcactatgttgcccaggctggtcttgaactcctgtactcaagcagtcatctcacctgggcctcccaaagggcagggaagggattccaacatatgtggatgtcatcagttatttaaccagtccctagtagaggacacagatgtcattttccattttcaactctgcaaatgccatggtggtgtccatccccactggtcacttgtcagcagttgtccgtggaaggaattgccggtcaaaggttttcaactggtgtgatggtgcctttactgtcctgcctcaaagcaccgcaattcaggctcttgagccagatagctgcgtttgcatcccagctctgcggagcacccaaagcctgatgcttccatctcctccacctctgttcattaaaccagtgttccttgactacttactgtgtgccgggtgcaattaaccaacatacgttggtcgataaaacagaccaaatttcctccccatatagagcttccattctagtggtgaaagaaacaagaagcaagataaagtgtgtagtgtgtgtgcaatggtgataaataccatggagaagacaaagcagagaagggaatgggactgggcgccatgactcatacctgtaatcccagcactttgggaggcagagatgggaggatcacttgaggctaggagttcaagaccagcctggccaacatggcgaaaccccatctctaccaaaaaagatacaaaaattggccgggtgtggtggcatgcacctgtagtcccagctactcaggaggctgaggtgggaagattccatgcacccaggaggtggaggttgcagtgagtcaagatggtgccactgcactccagcctgggtgacagagtgagacgctgtctcaaaaaaataataattaaataaattaaagagaaggggatgggaagggtgatcatcacagttgaaatagggtggccaagtgaggtgttactaaggtgacatcccagcagaggcctgaaggagatgagggtgagctctgcgggtgcctagggggaaagcattccagcagagggaacagcatgggcaaacccatttctatccatcagtccctgcataagcaaacaccctggacacctaactggagagtttgaggaccaacaaagaggccactgtggatgcagaggcgggagcaaaggggagagtaatggaaaacgtgggcagaggtagcaggggccagatcacgtggggcctgtgacaccagaagacttcggtttaactctgagccaggctaggcccccagagggtactgagctgaggtatgggaactgacttagggttcacaggcgacctctggtggccatgtggggaacagacgagggggcgagggcagaaacggagcccagcgtggaggcggctgctgggggccgggatgcacagcgccagagcagggaggtaccgtggaagccctgaggagaggtgggattctggatggatcttaaggcggggccgacatgattggctaatgggttgggtgtgggcatgagaggaagggaagagttggggggcctccagagttgctctccgcttatgctatagagggcgtgagggtttctgggcacgtagtgcgtgctcaatcactgtcactccggacctgcagcagaggccacctcctcacctttctgtctctcccaggaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaaggtgaggaactccctgggtgggaagaacagggaccaaaggaagaggtcgaggcagggttccctgtctaatgctctctggctcccatccttctcctaagccttctcacaaaaggaccagtggggccagctttactcccctgttaactccatacctatatcactggtaccgttgttcagctgcctggatacactccctccacacacacaggttgggatagatgtggaatccctctctctcagggactcaggcctttccaaatatattaggcagacctctatcaattgcaattgacagaaacacaaagtagtctaagcaaaaaaaaccaaacaaaacaggactttattgaaaattcaccttcaggtatggttagatccaggggctccaaccatgtaacccaggaacttttattttatacatctcttgtctctgcttttcgttatactggctttattctcaggcaggctctgaagcaagatggccctcggcagggacaggctcacattctaccagaatggcaacagcaggagaaaaaacataccactttcagtaactgtagccatagtcccagggctggctctcattggcccagcttaggccacagcccacctatgaaccaatcatagcagccagggagaatggaatattctgattggccaggcctgtgtcaaagtcccattctgggcaccagagggtgggatccattccacctgaattaaatagactgaggcagtggagtggtggctccctaaggaaattcaagatgccatttcaagaatgagggataaaccccaagagtttccttacctaaatacctgtttccttctctttcagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtgagcatcaccagagctgccgtaattgagcacctactacgggctctgtgctgagtccttccagtgtgcctctcactgaatcctcaccccactgccatgaggtttcccccatttgactgatgagggtgcagagccagggagccttgttcactggttcattgattacatttacaaatattatttacagagtgggagaagagcgtatagggtcttaatgccatggtagggactttggaatttaattcaggtgatgtgggagtccctgccagatggatggagggtgaaataatgcttaagccctcagccttactccatctgccttgttcaggagtgactcctaggaggaggtggcaggaactggcacctctgatcctcagctctaaaagggtctgatgctttcacacctcaagagatttgcacaggccgttcccctgcctggagcaccctcccatggctccttctggagaagtgtgccagctcattctgtaatcagaggaacgatgctttgctgagcactgtctacatgccactttgtatgtataaccccctcgattttaatttttaattttttttattatttatgtatttatttatttatttttgagacaggctctcactgtcgcccaggctggagtgcagtggtgcgatctcggctcactgtagccttcacctcccaggttcaagcgattctcatgcctcagcctcccaaggagcggggattacaggcacgcactactatgcccagcaatttttgtatttttaggagagacagcgtttcgccatgttggccaggctggtctcaaacccctggtctcctgtgatccacccgcctcagcctcccaaagtgctgggattacaggcatgagccaccacacctggcctgtacaatctccttgaatgcccacaaccacccagcaaagtggttctcccgtgagccccatgttacagaggaggaagtatttgctttgagagatgaagttacctgccaatggtcaaacagctggacatggttgttggggagaagaagccagatctttgactaccaagcttttccttcaaccactaaacaaagctgctcccttacaacccaggcggatactgcctcgtccaggaagccctccctgacccccaagcatgagccaagcatccactaggctctcccactccagccttgcccattctgggtcatcaccgtgggggacttgtttgtcatccccagtggactgtgagccccaagatagcagacctgaggctgtcactgtcatgactgtgtccccaggaccgcctaccactgggccgggcataaaagaggcactcgaggaagtgtttgctgagtgattcaatgtgtcagctccagagccagactgcctgtatctgggccctaaagctactgcttgattagtgatgtcaccataggcaaatagcttaagctgtatgactcagtttcctcatctgtaaaatggggtgatggtacctaataatacagtagagcacttaacacagtaggtggcacatggtaagccacatactgagtatgtatttgctatgattgttattgctattattactattattgttattattaacataaactgcacaagagcaggctttttgtttgtttgtttgtgttttgttttgagacaagatcttgctctgttgcccagactggagtagtgcagtgatgtgatcttggctcactgcagcctcaacctcccaggctcaggtgattctcccacctcagcctctcgagtagctgggattataggcgtgcactcccacgcctggctaattttttatatttttagtagagatggagtttcgttgtgttgcccaagctggtctcaaactcctagactccagcaatccgcccacctcagcctcccagagtgctggaattataggtgtgagccaccacgcctggccaagagcaggcatttttatctgttttgttcacagctgtgtccccagcacctagaatgtacctggcacaaagtagacattcaccatttgctgaa

SEQ ID NO: 13436 - DNA, 16365 bp, Human
cagggtccagcccaaacagaaggtgcacaggctggggacagaagagctagggtatgggtgtcggtgctcacagtgtgtgagcttgacagcacctgggactgtcttggagtgccgccgcattccccatgagtgagtttgtattgtatatcctgggatgctccagtctggatggaatctgcacgtgagtttgtgtgccttgcaaacaaaccttccctgagcacctgcactgtgtctggtcttgtgctgggcggggtgcccaggggaggagcccttagctcaccacagtgatcaagacatccctggccctgccctcacaggctcacagtccactgagggagacagacctatccccagccagggacccccagagtgtgccgggctcaggtgggggagcccagagggggaacctgacccagccagggaaggcagaggggacttcctggaggaggggatggtacagttaatcctaaaaggtctttcccaatgtaacagttgctctgtaggatggatgcagtggctcatgcctgtaatcccagcactttggaaggcaggaggatcacttgagcccaagagttggagaccagcctgggcaacatagtaataccctgtttctattaccaaaaaaatacaaaaattagctggacatggtaacacaagcctatagtcccagctacttgggaggctgaagtggaaggattgcttgagcccaggcggttgaggtttgaatgagctatgattgcgcccactgcattcccggctgggcaacagagcgagaccctgtcaaaaacaaaacaaacaaacaaaaaaaacgttggtctcctgtatgaccaatggataaagtaaccttgaccagtctaataactcccaggctgacctgtaatccaagccttctctgtatgtctgagcaggcaaagcccagctccagggctacctcaacccccaggctgatcagaagcttgggtaacctctcccagtgtggccagcgaccccccaccctcccacgttctgaccactgtcctgggcaactagtgacatctagtgggggattttgtcccagtctgacctggcctgtaggggccttgggcagtcggacctgtgacccacgcttcctagcagtggctggactcctcccccttcccgcaggtgccctggcctcttcccctgccctcctcacctgctctggccagtctgactcctcccttccccacaaggttgggagggaatgaaggagagagcgggaaggaggaagggagggtggcattcctgggattccctggatagggggaagagtgggagggccttccatgggtgagcaagcagagagggcaccccgtaccccacccccagccccatcatcgaagcggcctaggaggacctggatttgaagaccattgaaaataagagattaaaccggttgattccaggctactggtcagacgaggaaagcagcccagagcactgaccacaggggaaaacatctccgggcatactgggagcagctgctgggggccactggtcaggctgcgggggtcactggttggactgggagaggccagtgcaggccactcggacggcacgcttggggccattagttacactgggagaggccatcgcaggccacaggttgcagtggggtcctctggttaaaatcgacgatgccagcccaggctgctggtcacagtggggacgagtccccaaggcccctggtcagaataacgaggagaaggtccgcgattgcctggtgagatcccagctcgggtcactggctacgctggtcgatcaggccccccgctgcaggcgctggtcagtaagcccggacagctctaggcttgggggcggacgagccccgagcctggccccgtgcactgggaggtccgctccgggcagtgggaggtcctggccccgcgcccgggcatcgggggacgaggggggcctggagggcggggcggggcggggctgccgggggcgggcctctggctcccagccccgcagcggccgagctgcagcccgggctcagtctccgccgccgccgtgaacatggagcccccggacgcaccggcccaggcggccggggccccgcggctgctgttgctcgcagtcctgctggcggcgcacccaggtatggctcgggctgagggcaaggtgggactggggagaggcccctggggaccccgggaaagcgaggagaaagggctttaccctgaccccaggaagcaaaatgtggggaccccaaggaggagggatatgggagtgttggaaggtacgccttccagtgagagagatctggggacagccaggcaggagagctggggatacccaggcggtggatcagagacaaccagagaagtcagcccccttcccactcagcaccctggaatctgggtcccacctgcctcctccctcagaccctggaatctgggcccccagcccctctttcctcagacccaggagtccaggcctccagtggctagaatagcttcccccagggcacagaggatcaaaaccccagggctctctccctcaaaggtcctcaagttttgagaggtccagggaccccttagagaagcgaggaccatgtgtccccacaccagcgatccacatgtatttaggagtttccagagtccagtataaagaacccgcctccctcaggaaagggctggagcaccagccccgggcagtgacagtggaacaaagtgtttccaagtgacaggcccccttcctggggcctcagctacatttacacacctgcatgaggatagaaggagaggaggccgggggctggggggtgggggtgggggtgctggggacagagggacagagagatgagagagattggggaagagagaggaactctctgcctccacttgtctgcagatcagacccagccttaggcaccagcctggaccccgtcacccctccctggggacaggctggggccagaggtgagcgcttgggaatccaggcccctggcacactcatggtcaacagtgggtccccaggggtagggctgggccagattgagcagagaagggaagggagtttctaagaagcactgagagctgatgccaggatgccagcccagagggtgagggagggtggtggtttttctacaataactactccaccaggccccagcctcctcttccctctgatcccaggagtccaggtgcccagcttcccaagatcctgggcctcaaccttatccttttgcaagatgactcgacttatcccgtttgctgttgtatcaaactgaggggggccaagaggcggctgggggctctggctccaggccgggcaggtctcagccagcctgtccctcccacattcctgaaacctgcccagccctgtcccccctcaccgcccccacacatccatcccgcctaagctccgggcccagccgcagcccacaccccagcccctcactcatgggagagcggaagagacccagggactgagtggtgcaggtgcagagagaggcagagacagggacagagatggagacccaagaggagagacacacgcaaaggtggagaccaggatggagagaaacatttatccatcatcacagaggtggccctgcccagggtgctggaggcaaatggctgagccaggcctggccctgccctggggggtggcgtgtgctctgttgggataagcaaaggctggtgcagtattaccccaggagtgttcagcggaggccacagggccctgtgcagcccagaggaggagccctgagctctgcaagtgcagggagagatggatttgagacccagagatgcagggagaagggatggagggcgaaaggatctcagggaggaggggctggggcctagactcctgggtctgagggaggaggggctggggcctggactcctgggtctgagggaggaggggctggggcctggactcctgggtctgagggaggaggggctggggcctagactcctgggtctgagggaggaggggctggggcctagactcctgagtctgagggaggaggggacaggggcccagattcctgggtctgagggaggaggggctggcacctggactcctgggtctgagggaggaggggctgggacctggacgcttgtgtcctgggggagaggggaccctgtctggagggctcttcctgttggtgtggtggatgatagctcagttgctctcttgcagatgcccaggcggaggtgcgcttgtctgtacccccgctggtggaggtgatgcgaggaaagtctgtcattctggactgcacccctacgggaacccacgaccattatatgctggaatggttccttgtgagtgcttggggctggggggcctggagtcagggcacagcagggcagcaaaggttcattctctcatcagtgcctaaggcctgtagagatccaccaagccacactccttgttacagatggggtcactgagtcccactgaggggaagggatctgcaaggtgccccgtgtctaggcacagccaagtctagaatgacattgacctgctctggactgcgggctcttgagagagagaacagagacagacatcaagaaagcagaagccaggcacggtggctcacgcctgtaatcccagcactttgggaggccgaggcgggtggatcacgaggtcaagagatcaagactgtcctgaccaacatggtgaaaccccgtctctactaaaaatacaaaaattagctgggcgtgatggcatgtgcctgtaatcccagctactcaggaggctgaggcaggagaatcgcttgaacctgggaggtagaggttgcagtgagccgagatcgagccaatgctctccagccaggcgacagagcaagactctatctcaaaaaaaaagaggaaagaaaatgagagacaatcgggagagggagagaccaagaggagaagggatgggaccggaatgagatggagaaaaggagacaggaaaaatcaagaactgatagggaatgggggcaggagaaggtggggagggacagagggaccagggagacccataacaagaggaaaagaggcagagccaggagctgcagagagaaaggacccagagagagagagactgaggagcgctgggacacccggagctgagagcctgccccgcgcccacagaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttggtaagtgtcctcgggcatcccccgaagggaggcaggcagggaggggcgcagggcaggggctcctgacgtgaacgtctttttcacagcaaagccagaggccactgaggtctcccccaacaaagggacactgtctgtgatggaggactctgcccaggaggtacctctcgggtggaccttggccccagggtcctggaggaggaggggacagggccctggactcctgggtctgagggaggaggggctggggacccctgggtaataaaggaggaggggtaaggccaggcgaggtggctcatgcctgtaatcccagcattttgggaggcagaggcaggcggatcacctgaggtcaggagttccagaccagcctggccaacataatgaaaccccgtctctactaaagatacaaaaattagctgggtgtgttggtgtgcaactgtaatcccagctgctcgggaggctgagacaggagaatcactcgaacccagaaggcagaggctacagtgagctaagatcacaccactgcactccagcctgggccacagagcaatactccgtctcaaaaaaaaaaaaaaaaagaagaagaaaagaaaaaagaaaggaagggcagagggggaagactcctgtgtcctaggaaggagagagctgggggacccagaatccttggtccctggaggatggtgctggaggcctggactctttagtctgagtcggggactaggaattcggactcctgggtcctgggagagtcgggagttaggagcccggctcatgagtctgagtggggagaactcctgagagaggagccccgacttcagagtcccagctccaagcccaggccatgcccgtgtctgcctcagatcgccacctgcaacagccggaacgggaacccggcccccaagatcacgtggtatcgcaacgggcagcgcctggaggtgcccgtagagatgaacccaggtgagcagcgcaggagcgcggcgggacgtgggctggggtgggtggcggggctatggcctggctgactgccacctcccccgatctctcccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactgtgagtctgtgctggcctttgacctctgacctcaggctccacacctcatgaggcctgaccctccacccgggggcttcacactcccctctgaccctctgcctccctacttcatgctaaaaaaaaatgtgctagtgctggccactgacctctgacctcaattggtcgcacaagccccatcctgacctctgacctccgacctccacttagcaccctggaccccatgaagtttatgactaaatggtgctttccaccttctcacactgaattgggtccccccatgacatctggctccaagtctcacactgacccatcgcccatacggacctctgactcttgacctatactcttagtttatttcaacctctgaactctggcactcagaataattgtgaacctgaggcttgaaacctatgacccgtaacctttgacccgccatagccctcacctgggatgcagggctgacctctcgcctgtcctctagccttgacccttcccctgatcacaattcccatctccctgcccttcccttagatcccacggagcacgtgcagttctgggtgggcagcccgtccaccccagcaggctgggtacgcgagggtgacactgtccagctgctctgccggggggacggcagccccagcccggagtatacgcttttccgccttcaggtgacccacccaagggtccctctgggatccaccccccagcccctgacctctgtgacctgctaacctgcataacttctaatgtgggacctgggagtccccatggcttaggcagccacctgatctggtggcccacgaactaaaaggacctctgacccctgatttgagagagtcaggacttagcatgccacctgacttgatggcccctgacccctgattctggcttagcatgacactaacctggtggcttctgacctagcatgagcccgctgaaccggggtggcttctgagcctggttcctcgtcccccgtctcccaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctgtgagagccctgggtgaacgggcgggcaggaggggccctggcatcagtgcctctgcgccctcctccctacagccctgaagttgctctgtcatcccaaacactctgccttcaaccctttctctgcatttcttgggggtttttttggttgtttttttttttttttttttcccagagacaggacctggctacgttgcccaggctggtctcgaactcctcatgcgatcctcctgccttgctctcccaaagtgctgggattacaggagtgagccaccgcatcttgtcgagagctctttccatagcacagacctgaccctcctctgctcagaatctgccatggctccccagtacccttgggagaagcccaggtgtctcaccatggccttcaaggtccacctggccagttccaccattagctagctgatccttctccccagtcaaggctatctcctcatcaccccccaggctcctctggttcctaccttcactgcccatccttcctaccgtctatttctcaccaatcccttgaatcccaggcttctaagaatgattttcagttcattcgcatccaggccctggggaaaggctgtattctcccttggcacttcttacatatcccttcctggggtagaccctgcgccagatgctggggacacatctgtgaacaagacagaccacccctgttatttcagtaggggagacagatggtaaatgctaactaagccctttcgtaacagtagtgtatctacaggtgatatcaccagtgagagagagcaggagaggggattattttaggtggcaggtgttgcagtctgctttcctgagaagcagattctgacttggatgttttcaggcaagaagtttatgggaagtaccctgggttccgcacctcttgggtctagggaggtaaaggaagcaagatttggcaaggtgagaagttggactgaagtctaaggaaggtctcaggctgggtgcagtggttcatgcctataatcccagcactttgagaggctgaggcaggaggattgtatgagcctaggagtttgaggccagcctgggcaacagagggagaccccatttgcacacacacacacacaaattaaaaattagccaggcatagtggcacacacctgtagtcccagctactcggaggcccaggtgggaggatcccttgagtctggaaggttgaaactgcagtgagccaagattgtgccactgcactccagcctgagcgacagagaaagaccccgtctcaggaaaaataaaaataaaaaagtaggccgggccccgtggctcatgcctgtaatcccaacactttgggaggccgaggtgggtggatcacctgaggtcaggagttagagaccagcctggccaacatagtgaaaccccctctgtactaaaagttagccgggtgtggtggcatgcacctgtaatcccagccactcaggagcctgaggcaggagaatcgcttgaacccaggaagcggagattgcagtgaactgagatcgtgccattgcactccagcctgggcaacagagtgagactccatctcagaaacaaataaaagaaagaaagagggcctcagtcagccccacggggtacttggaatccaggatggcccttcacagttgtccccagttggggtgagggggctgggccttaataacctctacatcaaccagtcctcagaggtgtgctggccttaggcaaggggctctcagcagctgaggcagctcccagagaggggtgacagctgcaggctgacagctgtcatccttcttagcagctggtggaataagtccttccgtgctgtaggaaagatctgggtgtccacaataggggaggtcagggaagcctctgagaagagacatttaagtgagactcagaaaagcagacagcagccaggcacagtggctcacacctgtaatcccagcactttgggaggccgaggcaggtggatcacctgaggtcaggagttcgagaccagcctggccaacatggtgaaaccccatctctactaaaaatataaaaattagccaggcatgatggctggtgcctgtaatcccagctacccaggagactgaggcaggagaatcgcttgatcctgggaggcggaggttgcagtgagctgagatcgtgccactgaactccagcctgggtgacagagcaagagtctgtctcaaagaaaaaagaaattggccgggcacggtggctcacacctgtaatcccagcacttttgggaggcagaggcgggcagatcatgaggtcaggagtttgagaccatcctggctaacacggtgaaatcccgtctctactaaaaatacaaaaaattagctgggcgtggtggcaggtgcctgtagtcccaggtactcgggaggctgaggcaggagaatggcatgaacccaggaggcagagcttgcagtgagctgagatcccgccactgcactctagcctgggcgacagagccaaactctctcaaaaaaaaataataagaagaagaaatgcagagagctacaaaaagagcactgcaagtagagtgagcaagtgcaaaggccctgaggcaggccccaacttggtctactcaagaaaaacagcaagagaacggggtagctgggagcacaggaggaatggggaagagtgggagatggttcaagaggtgggtgagggccagaccaggcagcatcttttaggcaccctcaagaagtttggcctcgatgccaagggtactggggagccactgcagggttttatgcagaggggagggatgaccagtgggtggttggttttttttgtttttttttttttgagtcagagtctcactctgtcacccaggctggagcgcagtggcacaatctcggctcactgcaacctccacctcccaggttcaagcgattctcctgcctcagcctcccaagtagctgggactataggcatgcaccactatgcccagctagcttttggatttttagtagagatggggtttcaccatgtgaccagggtggtctcgaactcctgacatcaggtgatgcacccgcctcggcctcccaaagtgctggggttataggcatgagccaccgtgcccggcctgaccagtggatgttttaaagaggtccctctagctgctcagtggaggatggacaagagggaggagcaggctagtgaagaggtggttgggacagtcaaacctggggccagaggtggcaggaagccagaggatttgtcctgggagcagaccagataaagacttgctgaggccaggagcaggggctcacgcctgtgatcctagcacttttgggaggtcaagacaggaggatcacttgaggccaggagtttgagacccagcctggccaacatagcaacaccttgtctctattcaaaaacaaaactttgcagaaaagatgtttgggggtaacagggaggttaccccacaggttggggtttgagcaaaaggtttgtgtgctaaagtcacagaagggacaccttccacacctaaggttattcattaaccttgggctcagatgtcagctctgaagaaaagtaattgacttgggcatgtcaatgttggggttagactgctagatttttggttggagagcctggatgggagaatggagatttcatggagatggggtaaaccaggaggattacttgctgttctctgcttccaactgtccattcatgtttgcacccccgaccgcccctggagagcccctaattgagtgggtggcggtctgggacgagtgacagactgtcccccactgcagatctggaccccctggagctcagcgaggggaaggtgctttccttacctctaaacagcagtgcagtcgtgaactgctccgtgcacggcctgcccacccctgccctacgctggaccaaggtgagagggagaggagccccctcgggccctgcactcgcaccctcctctctcccctcactcctcgccctctcacagcgtcctcctcctcctctgcccttcccaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggttcagggggcagggagggggtgggcttggatggggacagtgtggggtgtgggacctggacaaacaggacgagttcctgagtccctggctggggactccatcttctgctcgatgcctctcttctctctctctctcctctcccttcactttcttcccatccccaccacccacaggctcgccagagctaaagacagcggaaatagagcccaaggcagatggcagctggagggaaggagacgaagtcacactcatctgctctgcccgcggccatccagaccccaaactcagctggagccaattggggggcagcgtaagggaccttcctctccaccctgagccccctctcactcatccaagtatcacaccctcctttccacttcctgggagactggacgtcgttcacctctgcccttgaccccaccccttgaccccaccagccggggcctgatcggagcctccatagcccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccggtgagtgactgaggtggtggcagaggagccgggtgtggggcagacagagcccactgcctgacccacgcctctctccatcctgtccctgcagtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgtgagtggcctgctatctgcaatgaccaccatagcttaaccccatccccaccctcaaccccaagctcaacccataacctcaaccacatcttatcctccaccccacatcccaccacatccacgctccatccccaacccatcctcatccccaactacagccccaaacccagccccagactaatccacagccatccccaactcatcctcatccccaactgcagccccaaacccaacccagggccatccccaaacccatccccaagccaaactcaacaccatccccttccctaatcacctctcctgcccctagctcagcctcatccccaactccatgcctgtctccaatcccaaccctgcccccaatctcccctcaactccaatccataacccccttcaaaccatcctcaactaagctcctctccagccctggccacatccccatcctcccccaacctccagccccaacacccatcatccccctgagctcacccttaactccaatttatcctccaagcctatctctcaccatccagccctcacctagccatttcccaaccctagtcctccaccgtcccgaagccaacttcacccatgtccccatccccaatcttgtccccattcctgactccaaatccaacccctaagcctccccaagctcctcctcatctaaccttgtctccagccccaaccacatggccgtcctcacctccaatccgtaaccatcccagaccgatcccaaagccaactccagctacattcccacctccaaccccaatagcatctgcatccccatgcccaaccctaaccccagtgccattaccagcccctaccccatccctatgccatccccacccagcacacccccatcctcacctccatccccagccgcatcctagtcccacccacccccatcctcagttcctccccctgccgtgtgcacctccaacacgacgcctccgcccgctgcctcctccccccaggccgccaggggagccagggctgagccactcggggtcggagcaaccagagcagaccggccttctcatgggaggtgcctccggaggagccaggggtggcagcgggggcttcggagacgaggtgggtgagggcctgggccccctggtgagagggacctgctgggcagtggagcacgcccgtgggcacaggctgacctctccatccgctccccagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggaggggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaccatcctgtggccagagcttcctctgggagtagggaggggaagggcgatgcaggtgattccctgctctcagctgcccccccatccgcccccttgcaagacctcagaagacgcctgatgtcatggagaaagaaatgagacagggctgggcgccgtggttcattcttgtaatcccagtggtggtggctcacgcccgtaatcccagcactttaagaggctgacactggagggtggcttcaggccaggagttcaagaccagcctgggcaacatatggagaccccatcgctacaaataataatactaataatacagaaattagccaggtgtgcctatagtcccagctattcaggaggctaaggtgggaggattccttgagcccaggaatacgaggttacagtgagctatgatcacgccattgcactccagcctgggtgacaaagcgagacttcatctctaaaaaaaaagaagaaaacaaaaagaggccaagctcagtggctcaaacctgtaatcccagcactttgggagaccaaggcagggggatcactttaggtcaggagtttgagaccagcctggccaacatggtgaaaccccatctctactaaaaatacaaaaaattagccaggcatggtggcgcgagcctgtaatcccagctacgtgggaaactgaggaggagaaaatcttgaacccaggaggcagaggttgcagtgagccgatatcgcaccactgcactccagcctgggcgacagagcgagacactccgtgaaaagaaaagaaaaagaaatgacagcatgagagcgagtgagcacgcagagggcgacttagctggccgggggtggacggaaagatgccaggtcccgagggtgctgggcttggcccccgaggaccagcgtctgcctggagatgggtgctgtccccttaagtaaaagttcccagtctgtcttgccagagccccagagggaattgaaactgggcgaggaaaagctccctcttagctgtagagtcaatagaattagggatggagccacctcctctggggaggagtccctggggaaagcggggagctgggaggaatccagagaaaagggggcctggggcagagaggacacacagacattacaaggccaagaaagagggacgtgagaaagggatggaaagatttagggggaggcaagagggatgggttgggaagctccgagagagccctggagtaagagacaaaaatagatctggggagacagacaaaaagagtagtgggccaggtccagtggctcatgcctataatcccagcactttgggaggctgaggcaggaggatctcttgaggccaggggtttgagaccagcctgatcaacataccaagaccccatctctacaaaaaataaaaaattagccgggcatggtggcacacgactgcagtcctcagcacaggcaagaggatcacttgaggccagcagttcaagaccagcctgggcaacatagtgagaccccatctctacaaaaaaataaaaaattagctgggcatggtggcaaacacctgtggtcctgcactttgtgtgaccaaggcaggtggttcacttgaggccagtagttcaagaccagcctgggcaacacagcaagaccacatctctacataattttttaaagagaaatacagagaaagaagaactggagttagagagatcattgcagttggaaagggagagaggaaatgcaagcagctgcctagaaggacggaggagggtagcgggaggtcagcacgggtgactggctggcgacctcacctctctgagcctttcttgtgcatcgaatggggatcaattgcactttggccacggcgggctgctgtgaggtgtcagtgtgatcttagagccatgtggggtgatgggggcattgcactcacacaccacccagggcctcctagcattgccttctcaaatctcaggcacgcagctccactctctgctctcagtcacctcagccacaaagtggacagagtggg

SEQ ID NO: 13437 - DNA, 17353 bp, Human
ggcgcagtggctcacacgcataatcccagcatcttgggaggccgatgctggaggatcacttgaggccaggagtcccagaccagcctgggcaacatagtgagaccccatctctgcaaaaaagtagtaataacaaataacaataatagcagccaccagggttccaggctccaactccatgccagggcctgtgctcagccaacctcatggccaagctcagaggatcctggcaatcctacggggcaggctcagttcacaggagacagaggtccagagaggcctagtgactggcctggggtcacacagcagggaaatggcataggtgggatttgaacctgcctctgacgacccagaggctgagcttttcttcccttctgagccctgtgggagaactgtcagcaggcagaggtgggggcagctacccagccctcccccgacccagccctttgtctttggattgataatccaagaacctgctcacatactcccagcagcaccctcacctccaccttctcaccagctcctcgcacgaacctttaaaataacaacaacaggccaggtgccgtgactcatgcctgtaatctcagcactttgggaggcagaggtgggcggatcacttgagttcaggagttcaagaccagcctggccaacatggcgaaaccccaactctactaaaaataccaaaaaaaaaaatagccaggtgtggcacacgcctgtagttgcagctactcaggaggctgaagcaggatagttgcttgaacctgggaggtggaggttgcagtgaactgagattatgccactgcactctagcctgggcgacagagcgagactctgtctcaaacataataataataataataataatagcagctaagtgaaataatgcttattgtgtaccaggcactgttccgagagctacacctgtattcacacatttaatcttttcaacactcccatgcggcaagtgctgttaggatcctcattttctagatgagtaaattgaggcacagaggttaagcaacttgcccctggccacacagctggttgtaggtagcagagctgggaatcaaaccctgggctgattccagaacctacactcttacccacacaaaatatttttccagcctccgggaggggcccgttttccacctggggaaattgagtttccagcaagaatgactagtccaggctcacccaactgggatacggcagagccaggcccttgatctaagactccggatgccttcctgctgagacacaggggctcagagagaggatttctcttgctccaagttacacagcctgcctgaccccaacgccttgcccagttctcttgctgctgtctgcaagatgcgagctaggcggggcacagtggctcacgcctgtaatcccagcactttgggaggccgaggcgggtggatcacttgaggccaggagttcgagaccagcctggccaaccagtagagatggtgaaaccccatctctaataaaaatacaaaaaaattagccaggcatggtggtgtgcgcctgtaatcccagctactcaggaggctgagacaggagaatctcttgaacctgggaggtggaggctgcagtgagccgaggtctcgccactgcactccaacctgggtaacagagtgagactccatctcaaaaaaaagaagaaaaggccgggtgcagtggctcacgcctgtaatcccagcactttgggaggccgaggcgggcggatcacaaggtcaggagatcaagactatcctggctaacatggtgaaaccccgtctctactaaaaatacaaaaaatgagccggcgtggtggcgggcgcctgtattcccagctacttgggaggctgaggcgggagaatggtgtgaacccaggaggtggagcttgcagtgagccgagatcgtgccactgcactccagcctgggtgacagagcgagactccgtctcaaaaaaaaaaaaagaagaagaagaagaaaaaagatgccagctaatcttcaatcttcccctcctgccctgcccatcaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtgagcctccccagtggagcactgaaggggctacatgggggctctggaggctgccggccatgccccaatcccaccacccttgaaggggggggggcctcagttttctcatctgtaaaatggggctgttgtgggaatcaatgcattaatatacataaaggcttgggacagtgcgaggtactcagcaaaccacgcaataaacatgcacgagaataatgtgagatccccaaggaggtcggttcacctcctgaacctcagtctcctcatctgaaaaatgggcgcccacgttgtgaaaacacaagtcaatggctgtgcagtgcttagagtggcacctggcaccaagtgagtgctcaagctctgacaggggggccaggtgcagtggctcatgcctgtaatcccagcactttgggaggcccaggtgggaggatcacttgaggccaggagtttgagaccagcctgagcaacatagcaagaccctgtctctacaaaaaatacaaaaaaattagccaagtgtggtgatgagggcttgtggtccaagctactcaggaggctgcggtgggaggatcgcttgagcctgggaggtgcaggttgcagtaagccgagatcgcgccactgtactccagccacagagtgagaccctgtctcaaaaaaaaaaaaaaagaatctgacaggggatgttattaatgttatggttgtttctcaaaggacattgcaaggcgaagagagctgggagtggaggggaggctctagtgcccctcacatccagctcactgtgtgatgccggggagaagcccctctctcctggcccctgtttttccactgggaaacaagagggtctttcaagtctcttaccctcctgaccctctgtggtacggtggtagcctgagatcctaacatttcaggctaagatgtcatgactttgggtgctaatgtttccgaggtgctgatgcttttagcaccatgtaccctctgaagctcccctttctcctttgaccccgcccccagcactctttcttctctcccaccttgacccctcccagccaccttgacctctcccagccttccctcccagttcccaccagtcctcagtgttctctctttttttttttttcctttggagacagagtcttgctctgtcacccaggctggagtgcagtggtgtgatcttggctcactgcaacctccactcccttggttcaagcaattctcatgcctcagcctcctgagtagctgggattacaggtgtgtgccccacacccagctaatttttgtatttttagcagagatggggtttcaccctgttggccaggctggtctcacactcctgacctcaagagattcacccgcctcaccctcccaaagtgctgggattgcaggcatgagccactgtgcccaacccttatgattctcaattcccacccagaggtattgaatgtacccgcccccatcccgacacacatgtccacacaggctccactgagcccacaagcccacgccctgtttgctggggacaagcagctctgacctcacccccacccctccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaaggtcggtgtctgcgcaggaggggagggccgaggggtgaggaggagagagatcacaggagaaatggggggagacagagaaatacagagacagagagagacacagaggtgtggagaagcagagagatggaaagagagagggacattgggaggctgaggtgagcgtatcacttgaggtcaggagttcaagaccagcctggccaacatggcaaaactctgtctttaaaaaaaaaaaaaagggctgggcacggcggtggctcacgcctgtaatcccagcactttgggaggccaaggcgggcagatcaccttagattgagagtttgagaccagcctgaccaacatggtgaaaccccgtctctactaaaaatacagaattagctgggtgtggtggcacatgcctgtaatcccagctacgtgggaggctgaggcaggagaatcgcttgaacctggaaggcagaggttgtggtgagcagagatcgtgccattgcactccagcctgggcaacaagggcgaaactcgtctcaaaaaataaataaataaataaattaaataaattagctgggcatggtggcgcgtgcctgtaatcccagctactcaggaggtggaggcaggaaaatctcttgaacccaggagatggaggctgcagtgagctgagatcatgccactgcactccagcctgggtgacagagcaagattctatctcagaaaaaaaaaaaaggaaagagagagggacagagagacacagagacagccaaggagacacagacaaccaaggagacagacagacaaaggagagggagagggagaagaaaggcacaaaagcatgtagaaaaggaagaggcatagccgggcacagtggctcacccttgtaatcccaacactttgggaggctgaggtgggcggatcataaggtcaggagttcgagaccagcctgaccaacacggtgaaacccagtctctactaaaaatacaaaaattagctaggcatgctagtgttcacctataatcctagctattcagcctgggtgacagagcgagactctgcctaaaaaaaaaagggtggggggagaggcagagacacagagggagacagaagggagcatcagagaaggcaggagagacagggagagagagacacacgcagttgcagtcagacacagacaaggagagtgggagaaagggagacaggaagagaaacagaaatgggcagaaaggctgggtgcagtggctatacctgtaatcccagcacttatggaggctgaggtgtgaggatcacgtgaggccaggagagttcacgaccagcttgggcaacatagcaagaacccgtctctgcccaaaaaaaagaaaaaaaaaagcctaaaaatttagctaggcatggtggctcatgcctgtaatcccatcacgttgggaggctgaggcaggaggactgtttgagcccaggagtttgagaccagcctgggcaacatagtgacaccctgtctctatttttttttttttttttgagacagaatctcactctgtcacccaggttggagtgcagtggctcgatctcagctcacggaaacccctgatccccaggttcaagtgattctcgtgcctcagcctcctgagtagctgggattacaggcgcgcaccaccacgcccagctaatttttgtatttttagtagaaatggggtttcaccatgttggccaagctggtttcgaactcctgacctcaggtgattggctcacctcggcttcccaaagtgttgggattacaggtgtgagccaccgcgcccagtccctgtctctatttataaaaaatttattttaagttagccgaacatggtggcatatacctacctgttagtcccagctacttgggaggctgaggcaggggaattgcttgagcccaggagtttgaggttgcagtgagctatgatggcaccactgcactccagcctgggcgacagagagagaccctgtctcaaagaaaaaaaaaaaaaaaaaaaaggaaaagaaatatacgaagatggggagagagaggtataaagaaaaacagagataggagaggggagagagacagagaagggagagacagagcccaggtatgggtggcggggagaggctccacacacccaatcagtgaggatgcagaaggcaaaggaagcaacagggagactgaggggagcatctgggggagacctgggcttgctggagagggcggaggatctgcctggtcctgatctcccacccgctctccagggtggagacgacctggaccccaactacgtgctcagcagccgcgtccgcactggccgcagcatcaagggctacacgttgcccccacactgctcccgtggcgagcgccgggcggtggagaagctctctgtggaaggtgagcgcccctaccccgtccactgctggggtcacccagccctggctctgttcctccatgggcaggtcctcgggtctctttgggcccccgctttccaaagtaggggaagagcttggtaaatcgtgggggcttggggaatggcgcgggctgtcagcattacctgctgtgttggagattcagggatgctgtccagactcgacggcccctgagaagacctacgcagacacctggctgcccccagcgtcctgccatccgttcatccagcacacatttccaggggttcttgccctgtgtggggagataggggtccctcactgttctcacagagtgttcagctggtggggagacaagaggaaatacagaaacccacagatgaacaagataattcaaaagtgccatgaagccaagacatgggtgtggtggagaatgaccgaggggagccacctcagataggaggagttgaggccgggcacagtggctcccacagcagtgcgggaggcctaggagggagggtcgcttgagcccaggagttcaagaccagactgggcaatacagcaagaccctgtctctacaaaaaagacaaaaatgagccaggagtggtggcacacacctgtcatcccagctactcaggagactgaggtgggaggatcacttgagcccgggaggttgaggctgcagtgaatcgtgattgtgccactgcactccagccagggtgacagagtgagaacctgcctcaaaaacaaataaaaagaggccaggcacagtggctcacaccgtaatcccagcattttgggaagctgaggcaggtggatcatttgaggtcaggagtttgagaccagcctggccaacatggtaaaaccccatctctactaaaaatacaaaaatcagctgggtctggtggcacacacctgtaatcccagcgacttgggagactgaggcaggagaatcgcttgaacctgggaggcagaggttgcagtgagctgagatcacgccactgcactccagcctgggggacagagtgtgactccatctcaaaaaaaaaagttatgtttatcctatactgtagtctgttaagtgcacaatagcattatgtctagaaaaaaaaaagtacataccttaattttaaaatcctgctaaaaatgttgtgatcatttgaggactcagcaagttggaacctttctgttgtgtagggccttgccttgatgttgatgggctgctgactgatcagggcggttgtcgttcaaggttgagatggctgcggcaattccttccttccttccttccttcctttcctttcttttcttcctcccttccttcccttccttccctccctcccttccttcccttcccttcccttttcttctccgtccttccttccttccttctttcctccctcccttcctcccttccttccttccttctctttctctctctcttttcaagacagggtcttgttctgttgcccagctggaatgcagtggtgcaatcatgacttaccataacctccaactcctgggcttaagtgatcctcccatgttggtctcccaaagtgctggcattacaggtgtgagccacagtgcctggccagcagtaatagtttgaaaagaatctcttttttgagatggagccacactcttgtcgcccaggctggagtgcagtggtgcaatcttggcttactgttacctccacctcgtggttcaagcaattctcgtgtctcagccacccaagtagctgagatcaccggcatgcgccaccacgcctggctaatttttgtatttttagtagaatcggggtttcgccatcttggccaggctggtctcaaactcctgatctcaggtgatctgcctgcctcagcctcccaaaccactaggattacaggcgtgagccaccgcacctggcctatgaagctttttatttaaagtgaaaaatgttgactcttcctttcacttgaacacctcgaggccattgtaaggttatgaactgaattggcctgatttcaaaatcatgtgtctcagggaatacggaggctcaaggagatggggagagatgagggaatggctggtcagtggggcagtccgagcacacacatttatccattaagttcacccttttatatgggcaaggtcggtggcaccccccaaaattaaaacagtaacatcagagatcactgatcacggatcgccatgacagatatagtaataatgagaaagtctgcagtactgtgagaattacccacatgtgacacagagacacgaagtggcacatgctgtaggaaaaatggctccaatagacctgctggacaaagagttgccacaaacctccaatttgtaaaaaacacagtatctgcaaaatgcaataaaacgaggtatgtctgtatattatatgaatatgtataagatatataaatattatagatttattgtacatatgcacaaacacaaattcattatacacatattttatacatgaatatacaaataaacacacaattttttttcttttttttttttttagacagaatctcactctgtcacccaggctggagtgcagtggcaaaatctcagctcactgcaacctccacctcttgggttcaagtgattctcgtgcctcagcctcttgagtagctgggattacaggcgtgtgccaccatggccgactaatttttgtatttttagtggagacggggtttcaccatgttggccaggctggtctcaaaatcctgacctcaagtgatctgcctgccttggcctcccaaagtgctgggattataggcatgagccactgcgcccagcctacaatttttttttttttaaagattggggtcttgggccaggcgcccaagtggagaaaccccgtctctactaaaaatacaaaattagccgggcatggtggcgcatgcctgtaatcccaggtacttgagaggctgaggcaagagattcgcttgaacccgggagacggaggtggcagtgagccaagatcgcgccattgcgctccagcctgggcaacaagagcaaaactccgtctcataaaaaaaaaaaaaaaagatgggggtcttgctatgttacccagactggactcgaactcctgggcttaagtgatcctcctgcctcagcctccccagtatctggactacaggctcgtgccagtgcacctggctaccattctactttataataatttttactaatggcctctcaaagtcctgagacttcagccatctgtgttgccagccattaggagcaggcaccagcacactgtggcctgcaggtggattggatgtgagggtccctcaggggaagaggtgggtctgttttccagattgagcacatggggtggccattcctgggggcctggacagatggcaggaacagattttggggagccgtcacaagtgtgggtttagacacagggttcaggtgcctttaggacatccagggggccaaggcccaggcccgttaggagcagcagcaggggaaaccctgggcctccacaccctggttgaggtgggacaggctgctgaccactccctcgtgtgtccccatagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggtgaggcccctccccgccccctggcttcctcttcccccagcctcctccagtcctgcaacggccctcctcactcctccaccaaaaccaaggccatatacgtaattatgatcttctaaatgccacggaaaatgatcttgccctccgcccctgcccatcctgtggtctgtgtgtcagattttgggatatctggaccggagaagtggtagttaaaaacttaagacttggcggggcacggtggctcatgcctgtaatccctgcactttgcgaggccaaggcggggggatcacttgaggtcaggagtttgagaccagcctggccaacacggtgtctactaaaaatgacaaaaatttagctgggcgtagtggcaggcgcctgtagtcccagctacttgggaagatgatgcaggagaatcgcttgaacccaggtggcggaggttgcagtgagccgagatcgtgccactgcactccagcctgggcgacagagccagactgtctcaaaaaaaaacaaacaaaaaagaaagaacttagacttggccgggcacagtggctcacacctgtaatcccagcactttgggaggctgcagcaggagggtcgcttgtgcccaggagttctagaccagcctgggcaacatagggagaccacgtcgctacaaaaattaaaaaaaaaaaaagccaggcgcggtggctcacgcctgtaatcccagcactttgggaggccaaggtgggcggatcacgaggtcaggagattgacaccatcctggctaacacggtgaaaccccgtctctactaaaactacaaaaaaaaaaaaaaaaattagcccggcgtcgtggcaggcgcctgtagtcccagctacttgggaggctgaggcaggagaatggcctgaacccaagaggcggagcttgcagtgagctgagatcgtgccactgcactccagcctgggcgacaggagactccgtctcaaaaaaaaaaaaaaaaaaaaaaaaaaaaaaagccaggcgtgatggcgtatacctgtggtcccagctactcgagaggctgaggatcagctgggcccagaggattgaggttactgtgaatcatgaccgaggtactgcactccagctacctgtctcaaaaataagaactcagacttgaaccgtactccctaggttcaaatcccagctctaccatttactaactttactagctttgtgaccttgggcaacttattttatttttctctaccccagtttcctagctataggatagggatcacaataatttgtagtttctggtgttcttgtgaggattaaatgagttaatttatgtaaagtattaaaagcagtgcctgggccaggcgcggtggctcacgcctgtaatcccagcactttgggaggccaaggcgggcggatcacgaggtcaggagatcgagaccatcctggctaacatggtgaaaccccgtctctactaaaaatacaaaaaattagctgggcttggtggcaggcgcctgtagtcctacttactcgtgaggctgaggcaggagaatggcgtgaacccgggaggcggagcttgaagtgagccaagatcgcatcactgcactccagcctgggcgacagaccaagactctgtctcaaaaaaaaaaaaaaaaaaaaaagcagtgcctggtatacactaagtgttcagtacatcttggttattcgtcttatctttattataaagtattattgctagacttgttttgactctttgaatccctgattcagatagtcaaagatttagagaacctaggtttcaatcgatgaagggagcctgggtgctaagatatacagatgggatgattctaagatttcaagattttaaatatttttaggttttaagattccactcatttatttatttatttattttgagatggactctcactctgaggcccaggctggagtgcagtgggttgatctcgactcactgaaacctccatctcccgggttcaaacgatcctctcaccctccgcctccttagtagctaggacgacaggcatgtgccactgtgcccagctagttttcgtatttttggtagagacagcgttctgccatgttgctcaggctggtctcgaactcttcaccttaagtgatccgcccacctcagcctcccaaagtgctgggattacaagcgtgagccaccatgcctgccctcaggtttttttttttttttttttgagacagggtcttgctctgttgcccaggctggagtgcagtggtgggatcatagctcgctgcagcctggaccttccaaggtcaagtgatcctcccgcctcagcctccccagtggcttggactacaggcatgtgtcccaccatgcctgctaattttttaaattttgtagatatgtgggtcttgccatgttgcccagggtagtcttgaactcctgggctcaagcaatcctccggccttggcctcccaaagtgctgggattacaggcatgagccaccacacccggccatttccggatcttaatattttatgttcttttttttttttttttttgagatggagtctcgctctgttgcccaggctggagtgcagtggcgcgatctcgactcactgcaagctccacctcccgggttctcgccattctcttgcctcagcctcctgagtagctgggactacagatgcccgccaccatgcccagatttttttttgtattttttagtagagacagggtttcgacgtgttagccaggatggtgtcgatctcctgaccttgtgatccgcccgcctcggcctcccaaagtgctgggattacaggcgtgagccaccgcacccagccttaatattttatgttctaagatcctgcttctgagatgctaggattgggagctaacacactacgatgggaagattttctggtcctgaaaccagatgtaggatttccaagtgttatcagttctgatcccaagcttctgtttgtcaaacatcctgagatcccaaggatctataataatactgttcaaagacttaagtccctaaaagtccttgatcccaggattcagcgttttgcagatcctgtgacattagagtctacaggtttaagcttctgcgttttgaggaggcagatgccacccacctcccacccctcaggccctcttcccccatcggtgggcagatgttttgggggagggctgggaatggggttcccacggggctgacaccttggcctcttgctgcggcaccttactctaggcacaatgacaacaagagcttcctggtgtgggtgaacgaggaggatcacctccgggtcatctccatggagaaggggggcaacatgaaggaggttttccgccgcttctgcgtagggctgcagaaggtgggtgtctgcccttagctgctgacttctgactccaccttgaacgccccacctgctttccgaggccccgccccttcccctatactaagccctgccccacccattttccagggccctgccccccggacctggctccaccccatgccaaaccccgccccccaaaactagccccacccgcttttcagggccccgcccctggacccagctccaccctatgcccaagccccgcccgtaaggatccgccttcaggccgggagcggtggctcacgcctgtaatcccagcactttgggaggctgaggagggtcaggagttcaagaccagcctggccaacatggtgaaaccccgtctctatactaaaaaattaataaataaataaattatccaggcgtagtggcgcgcgcctgtagtcccagctactcgggaggctgaggcaggagaatcgcttgaacctgggaggcagaggttgcagtgagacgagatcacgccattgcactccagcctgggtgacacagagagactctggaaaaaaaaaaaaaaaaaacccgccttcaaagcgttcttagtccccgcccctcaaaatcctgccttggtccccattgtctagccagcaccctcggaatctcctacctccctgttcccctcagaatcccacctccaccacgttcccacgccctgtccctccggaccctgtccatgttgcgggtgcatttgggggtgcctgccggcgctgacccctggtcctctctctgaacctcagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtacggctcccacatcctttgcaccacgacggagggggagcgagggccctttgcagggatgcaaggagaggtgcgacatccctgcgagttctggggatccggcaagggctgaccctctgtgagcttgcatttcttcctctgtaaaatgggtgtcaatatgcctatgtgataggagtcaatgtgggattttcatgattatataatatgcattgcacatgcccttggacctccctcggggcctcagtttccccatttataaagcgaggagtggtcaggattcgaccctaggccgcctggctccagaacccactctcttacccactatactatgtttgataactgagtggcgtggtaccccatctgaagtcagagactcgtgagctcacgaatgaacaggcattacctgtgtgcaggtaacctgttacacagtaggcactcactacatgcggctgttgcatttggcacgggggccacgtcccagcccctctgcaccttcgctgcctcttcacgcccctgtcccttgctcccacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccatcgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttagctttgtgcgatagttattgagggaggacgtgcaattggccactgtgtggtctcagagtggtttgtcctgtctaggcatgtactaaacatgtcttatcccgggtctaaaatgaggcaaagttaggtcacagaatctagtccaaaaattagaaggctctatggggaatctgagacccagagagacactgagcccagtgtcactcacccaaagcatgggccctttccaactatggctttgaattagtcatgctcagatctcaaacacgaggtccacgctggggaggaatgcagccaaacgaaatgtctgaaacttgaatttagcccaacggtctccagttttgagacctcccatgcagctcgtcacatctacctatattctgcttctcagtggcctccttctgtcccgtctgacttcatccctctgtagctgctgccagtcccttactttctcaagaacctgccatggctccccatttctcctagaaagcttttctgttattttgcaactcaaggccacactgaaatgcataccatttgctggaggctcacctttccagttctttccccattactcctctgattctttcacacctgacaccctccaattcccacctcaatgtctttgaccaagctgtttccctctccaatctgtgagtctgagcatccccatgaagtctttagggataggccttttggagaactcagtcccaggaaggaacaggaaagaggtgtggtagagcaattggtggagggagaagagttaatagaagtcaagcagtagctgaacatgcattgggtgttgggcacgtcaatcacctccacccagtcaaacaggccaatgtctacgttaacaaggacacagtcggtgggccccaaaagacaaacgttttagggaaaaaaaaaagtgaggtgggagtaaatggaagaaccgacaaagccctcaggaacctaaggtgctttttcaaacctcaagagtcacagagattaagggcccttgtagttcaatctgccctctgttttacagaggggaaattgaggcctagggatgtccccaaaagttcccagggagattactacaaggaaggttaggagagattctaaacattaaggtatgcagaacctgtgagatgctgtgatgttctttactgtactgtccccagttgaagatcccagctccacacccagaggctacatagaccacacacgccagtggggaccttctgagccagccaaagccacagtccagacacctgttaccaggtcctgcccactttgcctcacaggactctcttaaatctatctgcgctctccccatctgtccagccccgacctctttcctgatcttctgacctgtcaacttccctcccttccaccctgcacatagcacaaacccgcccatctctaccctacctacaaccttgccatggctcccccagtgcccttggaagaaagcccaggcccctgtccataaccttcaaggccctactgacgcccctagccccatacctcacagcaattctacacttaccaagtcacatgccatttgttgaggacctgtcctctctcttgctccctggcccttgtatgtgccatttgctgtgcctaaaacgcactcctatccatgtctagctggctccttctcctccaggaagccctccctggctgaggcaggcatcacctctggactcccctataccagccctgcccagtcgctgcctgaggacacatctgcctcctccattggactgtgagctctatgagggcagtgttggggctgtcttgattaccactgtgtccccagcacagaggatgctctcaggaattgaccaagcctcttccctgaagttccctgaacttccatggttccccagtgccatggggagaaagtccagcttattcattttggccccaaaggtgctgtgtgaataagctccgcccttctgtactgcacagacttcaaccactataatctgtccagctcccatgccttttctcctgc

SEQ ID NO: 13438 - DNA, 137048 bp, Human
  misc_feature (1)...(137048): n = A,T,C or G
cactatttagccatgagctcaagctagaaagtggccgaaattcatgtctctgtagtgaatccctcattggttacgaatagcctcatagagtttgatggagttttgaactgttgcattagatcacacaatttgaccactcaactcagcaccaagcctgttcattttggataggtgaggccactttagccattttatttctacaaatagtcactatgttataattatttggtttcacatttctcccctgtataaagagttgggtagggttgtcttgactaatccatcttatgtggtcctggcccagcaccaaacttaataaatgtttgtattaggttgaactgtataaaaatgctgtgtttgtaagtcaaaaaatagtcaaatatcagcaatggtcaagtgaataataagaaaaattcaagcagtgaatgactggttggactagatgattttaaagatctcttccggttctgggatttcatgaccttataattcaaacataaataacatcatcagtcagtttcaatacttagctaccaacttatgaaaccatggtgctcatattgtacacaaacctggcaccctgttcttgtctttcttggaacttatcacagtgatttagctatttttatactagatgactatgtgctcctcattttaatgtgtataatacatatctaatgtgtaagatatataatacatatatacataaatataaatgggtagatagatgatagatacagtgtatgtgtttccatcagctgttaaaaggtagatgatagattaatactgtgtcattttcatgtctcttctgttctactgctttaatgtggcaggtggagtccactgtgattcaaactatgaattttttcattgatcaattctgacatgctaacctcagcaactgagcacctgcataatatgttaggtcatcatattaataatgaagattacatagttgacttgcctttttattgggggaatatagaaaaaaaccctagaaatatgactgattttaaaacaaactaaaatgatgattgagaacagtaatactatctataatttcattgcatctagtagaaaattagctttggaaagccactcagtttataaaattgttttgattattctttatttaaaaaatgaagttctcagttttaatctcaacaggaaatctcttgattacagcagagcagatttttatctgtcaataagttaaaaaaattttgaggaggaaatcaggcatcagcttccaggggtctaataacttcctaacttaatgggacttgcctaacagtagatgaacttttcattttaagactttgcctttagtagtcaacactgtcctcagcacagctacagactatataatacagagtccatacaatacagggcatttctgtatgaataaagtattaaatattttttaaaaataacttttaaaaaatgaagttctagcctaagacctgaattaagggctttagggaaataaaaactttgttccttttctaaattttagatatttccgttatggtaagttaaactgatcggtttaagaaggtagtttaagatagtaatgtatatgtgttaacaggcttctatctctgcgtcagctgtaagatttacctggtttttatactctgaagagtttatatttaaattcaacataataaaacattcaaaataagaatctctgaacttagttttattttagactgcttttgaaaaaatcacttcttaaagtgcacagattcacacatccaccctcccatcctttgtgatagaaaaaatgaaatacttagcttggtaaatcacattgcttctcctgaagtagactgccttcacccagtgctgtgaaagaaagcccagtgagtgagtaaggaagggtggctattgtttagtgctctctagcaaaagaatgggattgggggcggggttggggcgaggattgagtttaactggcattggctctggcttttctgcattccaaactgtctgaggcacgaaatgagagcaaaaagggagagagcaggaaagcgagcacaggcgagtacagtatacaaagtgttttgagtttctgactggcgtgccggaaagatcatgttagcacacccagaaacttcacacgatgcagaccccaggtaagagtttgtagagtctgagaccgaaatgaaaagtcacgtatttaaggggaatgtggctttttaaaaattacacaaatgcagtgactatttacctttatgattattggctttaaaaaaataggttggtttttattgctgtgagttcacagaaatactgtgtggaagctgtctgttagcattccagtacaaaatccagcacaagaatagccatctaagaaactcagataaattaaaagaataatgaccatagcaaaatattaacactgcagcatgtacttgttctgttaataatatgaaatgggtccttattctggatctttcttaaaattctttatgaaatataaagatacctgggaacaggtaaagctcatttctctctgagtgagacagaatatattgaccatcaacaagatattaacagccttgcttgaatctcagtaacacataatctgtgtcattcaaaagtttaacaggtttgatccatagacagcagtaagagcattcaaatgagaactttgcttgttatttttgcccaaggtaggcttttaatatcctctgccaagatgacaggtaagaaagtttattgacttattgaaagttaaatctgaaagagacttggagattatctatagtctattctctccattttcaatgaaaattttgtggtctaaggtacttgcccaaggtcagaattaggaacagaattgaaatgaaaacccagatctccttattgtcagtttaacgtgtttttcatagaaccaattatatataggcttatattttctctatactacatctgctagccccaattacaatgaattattgcctaaatagaccaagtacatcataaacctagattgaaatcttatggagaggaggtattgagaaatggatgtcatcaaatcactattgatacatgctcttgaccaaaaccaaaaacatgtaacaaaatatttatcaagaggaaaaaatggctttcagtgaaggaaaattagtttgtacgctgcttttaattttttaaaagactttaggacatcaattttctgtataaatatgttagtaaacttttttctgtatgcaaatatctatttttgtaatgtatctgttttactgaaagcaaatcgtattcactgcctttgttatgtttattcaaaaatataagataatattttaaattatccagctattttgaccagttgcttccttatccaaggtccatttctgtttctccctgcttataaggatcgtctgttacttcacctcatgaattatgtgttagcagataatttaagtgaaggatcttgagagccgcaacagacagtgaacatctgtcttcatacattttcatttagtgcctaaaaaaggttgctgccctttccatttttctggagaccattgtggggatgagaggccacactattctagtgagctaaatagtaaagatagccactgtcaacagaatctgtcatggctctttacaactcctgggaacaagttagcttgatttggctataagcacagtaaagggatgttgtccttttgtattaaagcctgacctgctctttccagtttttggctgggtctgtgtaagtgtagtactgacttacaagtctgtgtggaatgggcagcaagttataaggaatagtttcattactcctctcggctatatcggaaaccaaattaccaagtgaattctccacccagtaggaaagaagagactgtctgtcttactggagaatccattatttaagcactgtttttaagaggactgatggctgtgagaatgaggacattaatgctctatccaacttaacagtattcatgttgtattacacaaagcttagattcttctctgagcttttatcctgcttttaatatgtgaaaggactgccatgatatatctatgtatattatgttgtgtgtgtatattatatgatagaatagagagtaaaatgggcctttggcctgagtatattttctgatgccagaaatgatcagaagtcattaatctattgctggtattttactgacctaagttaaaagaaactattttattaaccaagctaatcatgataaaactcactaccatgcactacaaagagaaaaatactcaaaggaaacacacttcttttttaattctgaaaacaaatgtcagattatgcaggttcataccttccgtgttagaaaaaaaaaacaataaaaaggtgcccactttgtggctaaagataaattttatttttaaacaagtttttattggtgtataatacatgtagatagttgtgggattcatttgataatttaatatgtttacacaatttggaaagatcaaatcagtatacttgggatacccatcacctgaaaaggagacaaattttaaatgggaatagaatgggtatagtgaaatgagtggcataaaaaagaaactctcatatgtatgtgaaataattttcttttgaccagtgttttcttgaaggcagacctattttcactattcatgattttctccttgatactgttttaaaattttttcccatgaacaatctatatataaatattgtttatatattaaattttcaaagaaggtaaagagctctgctatgtaatgacaacattttctgaaaaagatttggctatagttgatcaaaacttttgactcattgaaaggaactgctttctttgctgttgcaatttctttctacctcttgggcataattctatgttatgtgtcccagttaaatccccaagaatgaaatatcttcaaagaaaaatgaaggcaaaagataggggccaggagcagggacttgaagctggacatataaattgttctgagatgtcaaattaattctttactcatgaaagttacccagttatccacccaagactccaagagtccttttatgtagacaacacgattgtgtttgcccttctgctccagtcttgaccttcagcagtctctaaagaggaaaagtgtttgttacagactctttttgttctcttctgttgtttcacgctccctagtggttgttcatggtcattcttgttttcagttccctgtatatcagttgtagtgagaaggagaaggaggtgactattgtattgtgaaataaggttcaccggattcttatatttgagttgcataaactttcttaaaataactgattcttatatgcagaatcagaagcaaaaatttttgtcctgttgttcctagtggacaatgattcaagaaaatgagtcatgactcagcgatatgaattctcttttagccggggttatttttaactgctgatgggaattccatctatcaaaattccacatttaattgtgggtatgatctcagcttgtgtttggaagccttaagcaatgccactcagaatactttctttgtacatacttgacaagtaagagagacttactgagtcagtgattaaaattcagatgaaggcctttgtcctctctggtaccctccttgcccctactcaaaccgtgtcattaagctgaattggaaatactgttaactcaagcacatgaagagggaaccattgaggagatcctgttaataatacgactctatagaactccacatttctgtcattctcaggtttgcaatattttttgagtaaatgagttgctgaaaaacaccttgaaaaagtagtttaggtttgtgcagccctattctttgaagaagaaaagatacctggttctgcttgctctttctaatgtcagatcttggaaaataagcaacttgagctgctggaataaagcaggtgtcgttcaggatcaagtgttgcctaggatagctagcctgttagacaagttgctaactgatgtcctgaatccaattccaaagattacggagtacctttgaaaaatgttgtaacagcactgttgtgtaactattcgtaaatactacctttagtttatatgaagattagtaaaatgggtattctttccatttttaagattctggtttgtaacttttttgctaaaatacttcaagtgggttgtgtgtgcctctcgagtcagatcagagaaggtaagatgtctgggtccctacttcaatcactcttctttccaggaatacctggaatatgaagtttcaggtaaataagtgaagtgaaataacaaagagaagtgatttgtcaaaatgagtgcaagaagagccaccaaaaatctagcttgtgtgagtacatagaattgagtttgttcagtcaaaggacaagggaagatgtgataagtctattaacagggaaggataatcatctcctgtgtaccaagagctcatttcgaagagtgtgtccagtatgattatagaatatttcttatcagtattttctcaaagtatgggaaactaatccctcaaacaaagggaaatagattatttcaatgctttcaacatgtggtagaggaattgcatcacacagtatttggcctgctttatttatgaatctctattgtacagctgaaatttaaggagtttttttattaattgaaatattttatctttcatatagtttgccacatcagccaggttcagtggctcatacttgtaatctcaacactttgggaggctgaatcaggaggattgcttgaggccaggcctggcaacatagtgagacctcccctctacagaaaatttaaaaatcagccaggcatcgtggcatgcacctctagtcccagctactcagaaggctgaggtaagaggattgcttgagcccaggaatcaagactgcagtgagctatggtcacatcactgtactcccgcctgggtgacagagcaaaaccttgtatctttaaaaaaaaaaaagaaagaaagaaagaaaagaaaagaaatcgctatatacatcctgatattttccttgaagcatttttcctccacctgaagtccagtgaaatgtcactgtagtttcctgaaacaataaatacgctattatatgagtagcatcatttacttgctggggtataattgctgaaattttgaaatatgcttttagtatgttaagttttatttatttccttcccctataaaaaacagcacttggaaaatgattggtgatcaacttttaaagataattttttaaagtagctttttaaaatcaattaaacaccttaccattctcttctcatctctgagaaatggtatagaccatttttattaaccaaaaatatagtataaagaagaaaccctaggagttaactgctatcattacaaggaatgaaaactagtctcccttgtaaacattttttagcttatgcaagatcaaaatgtactaggcagaggaaatttattgtaatataaaaggtagaagtctagtggaagtatagctgtttgtccccagtgcctcagtagaactgtttaggtcaacacttgatgacactgctttattttggttttgtttggtttttttaatggaagggtatttaaaaccagaagccaggctttcatctggtcttttttaaaaggaatatccaaacaatgatttacctgtttttctcagaagctatcttactgtgaacaaattgcaaaatgtatttgacggtgaaattttaattatcaagaaatagtgagcttgaagggtgtgactattgccataaagtgctgtgatttatgacagcttcccagtagaaattctcccagtgtcagaaattataaacccattttcattttactttgttcttgaattaaatatttaaaggtagaatttttgtttctctttccccctatcagacctgtgtgacgggagaatagaaactgttttaaggctcttcagatttagttcagatgttgcttatgttacattttctctgatagtctgaaaaaataaatttttaaattttaacgtttgatcataatatataacaggctcctacacatcagtgagaaaaaagcaagactggaatgctcattttacaaaagaggtaatccagatgaccatttagtatataacaaggtgtgcagctattgttagtcatcagggaaatgcaaatttaaaccaaaataggattacatacccatcaaaacgtctaaaatgagaaaaaagaaaataccaaatgttgataagtatctggaacaaaaatagttttcataccatattgacgagagtgtaaacttgtacagttactttgaacagctatttgacaatatctcctaaagctgaacaatgctcagtgacccagcaattacactcctatttatgtacccaatagcaatgtatacctaggttcatcagaagacctgtacaaaaatgcttttaacagcactatttataacagctaaaaatttgaaactacccaaatgctcatcagcagtagaatgaataaattgtggtttgcttataaaatggaattctatacagcaatgaaaaagaacaaaccactgcttcatgtgacagaatgcatgaacctcacaaatgtatgttgagcatgaaaagtctcaaaagaatactcactgagtgattccatttatatagagttcagactgatctagggtgatggaaatcaggatagtgattatccttatgggggtaataactgccaaggatacataagagaggcctctggctgctggtgatgttctgtggtggtgttgttttctgattcagatgctggttactagcatgaattacatttgtgaaaacttattgacctgtacatatgttatttgtacactgctcttttttctttttctttttttcttgagacaaggtctttctctgtcaaccagggtggagtgcaatggcccaactaatcatagctcattgtaacctcaaaccccttggctcaagtgattctcccacctctcagccttctgagtagctgggactataggtgcacacgactacacctggctaatttttaaaattatttttttgtaaagatggggtcttgctatcttgcccaaactggtcttaaactcctggcctcaagcagccctcccatcttggcctcccaaagggctgggattacaggcatgagctaccacgcccagcctgtacacttttctacatgtatgttatacttcagtaaaaagttcaaggaaaatattcctattataagcgctccagtttgcaaacaaacaaaacaaaaacaaaaaactctaggcaacttccaagttgatggaagtgatgttctgtaaaagtccttttttgtttatggagaatgtgagcaggacaccaggtttctttcttttctttttggttttttttttttttgagatggagtctcgctctcgcccaggctggagtgcagtggcgcgatctcggctcactgcaagctccgcctcctgggttcatgccattctcctgcctcagcctcccaagtagctgggactacaggtgcctgccaccatgcctggctaattttttgtatttttagtggagacgggctttcaacgtgttagccaggatgatcttgatctcctgacctcgtgatccacctgcctcggcctcccaaagtgctgggattacaggcctgagccaccgcgcccggcccgacaccaggtttattttcatgttgaaagttctccagtctggccggacgccgtggctcacgcctgtaattccagcattttgggaggctgaggcgggcagatcaccaggtcaggagatcgagaccgtcctggccaacatggtgaaaccctgtctctactttaaaaaaaaaaaaaaaaaaaagccaggcatggtggcgcgcgcctgtagtcccagctactcgggaggctgaggcaggggaatcacttgaacccggaggcagaggttgaagtgagctgagattgtgccactgcactccagcctggcgacagagtgagacttggtctccaaataaaataaagaaagttcaccagtctatgtgtgccatcaaggactttacatttggggtcattgaataggttagatgaggaaagcatttgggaaactaggcttgtggatgtatcctcaaaacaaaatttcatcatgtaaataatagaatttctaggctttctaaagctctgagcttactgtataaaaacactaatctagtcataccttaattgaaaatattttataatagtaatatatataaaaagatatatatgtactcgtacttaacacattaacttttacatatagttactaaagagttgatgatacaaatttaataagaattttccatactttggctttaatataattttgctttaaaaatatgtatttggacttttaaaggatgtgtaattccttgttatattggacgaaaaataacagctttttcatcattgtgaaatgtgaaaatatccaatacaacaaatggaagacgcctaataaatgttaatatccttctttgtctttacaaaactacaaacatgacatactcttgaacatgcccgtcttatcttctcagattaagctctgccacctgtgctgttcttcctgttctgaaccattaaaacacatgtgtttagttttatttctggattcttctagagcaatcttcttcactagttctttcatatcacttgttttactcaaacttgatgttttaatgttagcatattatttatttgttgctgtgtaaaaagttaccacaaacttggcaagtgaaaacagcattcatttaccctgtcccccagccttctctctctctttctctgttgagacagggtctcactttgtcacccaggctggagtgtgcagtggcatgatcatggctcactgcagcctcaacctcctgggttcaagcgatcctctcgcctcagccccccgagtagctggaactacaactgcgtgtcaccacacctggctaattttttgttttgttttgttttgtttttgtagagacagggtttcgccatgatgctcatcttggtctcaaactcctgagttcaggcagtccgcctgccttgacctcccaaagtgctgggattacaggtgtgagccaccactcccagcctatttcaatttctatacatcagaagtctagggagagtgcagctggttctctgctcagggccaaaacaaacatatcagccagaccacactcgtatctggagctcagagtcctctttcaaacttgttcaggttgtcagcaggattcagtttcttgcagtggtaggactgagatccctgttttttggcttgctgttggcaaggagtcactcctagcttctagaggccactgttatgtcccatttccatggcccccttactacttggcgcttactttttcaaagccagtgagagaatcttactctggttggatgtattagttcattcttgcattgctacaaagaaatacctgagactgggtaatttataaagaaaagaggtttaattggctcatagttctgcaggctgtacaggaagcatggcatcatctgcttctggggaagtctcagagagcttttattcatgacagaaggcaaaacgagatcaggcttcttacatgcaggcaggagcaggacttgggtgggggagatgctacacacttttaaacaaccagatctcatgagaactcactatcctgatgacaggaccaaggttgcatggtgttaaaccatgagaaactgcccccatgatccagtcacctcccaccaggctccatttcccgcattagggattataatttgacatgagatttgggcagggatacagatccaaaccatatcattccacccttggccccttccaaatctcatgttcttctcacatttcaaaatacagtcatgccttcccaacagtccttgaagtcttgactcattccagtattaactcaaaagtccaaaacccaaagtatcatcttagagaaggctagtcccttttgcctatgagcctgtaaagtcaaacacaagttagttacttccaagatacaatgaaagtataggcattgggctgtaatcccagcactttgggaggccaaggtgggcggatcacgaggtcaggagatcaagaccatcctggctaacacagtgaaaccccgtctctactaaaaatacaaaaaattagccaggtgtggtggcgcggctgtagtcccagctacttgggaggctgaggcagaagagtggcgtgaacccgtgaggcagagcttgcagtgagccaagattgtgccactgcactccagcctggatgacagagcgagactctatctcaaggaaaaaaaaaaaaaaaaagtgtaggcattgggtaaatactcccattccaaaagggagaaattggccaaaagaaagcggctacaggccccatacaagtctgaaacccagcagagcagccattagcccttttcccatttagaaaacaaaaagtgcagctcgctgccagtgctcatttaattttacataaacatactctttgaggctgaagcaaatctgactgattttcagtgtgaaaacaaaatataaaaactgttcttggagttatttctaaatagaactaacatcagaatcatctgaatcatcagaattgtctatttcagaaaaattgaattcatcaaaggaatctttggccaacaactgttccagaatgatgttaacatcacacataggaatgctatgttttctaggatttgacatttttagcaatcgagaattactatattttgtaagtggaaataccactactaaaaacagaatgctataaatagaatgatgtcttttgttttcaaagttgatatactagagcagtgtgaaaataataataaaaatgagatgttttgtggcaaagttatcttggggtaaatgctgaaactgcaagctttgccagcaagtattcttggggcaaacaggagaagaattaaatcttaaggctccaaaataatctcctttgactccatttcctacatccaggacacactgatgtgagaggtgggctcccaaggccttgggcaatccattcctgtgggcctttcagaggtcagcccatgtgctgttctcttgggctgttattgagtgctggcagtttttccaggtgcagggtgcaagctcttggtggctctaccattctagagtctgtaggatggtggccctcttcttacagctccactaggtagtgccccagtggggattatttgtggtggctccaaccccacatttgtcctctgcattgccctagtagaggttctccatgagggctctggccctgcattaggcttctgtctggacatccaggcttttccgtacattctctgaaatctaggcagaggctcccaagcctcagctcttgcactctgtgtacccacaggcttaacaccatgtatttaaggctttcagcttgtactgtctgaagcagcagcctaagctgtacctgggtccctttgagccatggctggagttagacagctgggacacagagagcagtgtcctgaggctgcatggggcagcagaccctgggcctggcccacagaaccattttgttttcttgggcttacaggcctgtgatgggaggggctgctgccaaggtctcagaaatgcctgcaaggccttttccctagtgtcttggctatcagtacttggcacctttttacttatgcaaatttctgcaacctgcttgaattcctcccctgaaaatgggctcttctcttctaccacatggccaggctgcaaatttttcaagcttttactgtccatttcccctttaaatataagttccagttttacgtcatgtctttgctcatgcgtatgagcataggttgttagaagcagccaggctacatcttgattactttgatgcttagagatttcttctgccagatatactaaatcatcacgctcaagttcaaaattccgtagatccctaggacaggggcagaaggccaccaggttctttgctaatgcataacaaaagtgacctttgctccagtacccaataagttcctcatctccatctgagacctcttcagcctggacttcactgtttatatcactatcagtattttggtcacaaccatttaaccagtctctagggagttccaaattttccctcatcttcctgtcttcttctcaaccctccacactcttccagcttctaccagttaccaaattccaaagcttcttacatattttaaggtatctttatagcagtgcccaactcttcagtactaattttttggctatgatgtaatccagtataacacaactgtaatcatgatagtgactatacgtcaccttggccatgtaatgtaacctaatcagtggagtggctatcccatcatattacagattccaggcccctgagggtagagaattatacaagggtgtggtggctcatgcctgtagtcccagctgctcaggaggctgaggtgggtggatcactggagcccaggaggtcaaggctacagggtgagccaagattgtgccactgcactccagcttgggtgacaaaaatgaaaccctgtccaaaaaaaaaagaagaaggaagatacattttcaaattacaaatttttttcagtaaaagagactacacacatcagctacttttataccacctagcaatgacacatcatgaaaggacaattacagggagttttactcattattatagttccagaaatcctaaaaaaaatattagcaaatggaataatacattatgactaaagttgggtttataacacaaaatgcaaagtagatttaatattagaaagttagaatagtttaccattaatgaactaaaggagaaaaatcttaaaatcatctcgattgagcaaaaatgacatttaataaaatttaacaactattcataagaactcttagcaaaacaacaatagaaaagaatttctttactctgattagtgatatctacaaaaacccatcgacaaatatatgtaatggtgaaaagctttcccttttagatgaggaccaaggctgggatgtccattattatccttgctattccacattgtattggaggtctcaatcaatacagtaatcaatacagtaaggtctcaatcaatacaagaaaatatgtaaggattagaaaattaaaacttcacaagtgatgtgatcatttagaaaatccagtaaaaactttacaggcattgagtttagcaagttgctagataacaagatccataaacaaaacctaattgcatttccatagatcaacaataaactgaaagcaaattttttgagatactgtttacaataacaaaatgtaataacctaggagtaaatcttttaaaagatgtgtaaaacatctaaaaagtaaactataaagctttattaggagaaatttaagaataatctaaagtagatatatactacgtttctggagttggaaaactggtttgtatggtgttaacttttaccctaaattcctttatagattcaatgtaattccagttttaaaaatcttgtgaagcctgggcaacatgataagccccatctctacaaaaaatttgaaaattagctgggcgtggtggcacatgcctgtggtcccagctacttgggagactgaagcagggaggatcacttgagccaggaattctagattgcagcgagctgtgatcacacccctgcactccagcctgggtgacagagcaagaccctgtctgtctgtctttctctctttctttctaggtatctatatatttgtatatattaggatagccaaaaactcttttagaaacctaatttaggaggacttgctctgtcagctattaaggctctttataaaactatattaattgagacaaagtggtattagtgttagaaatagaccaatggaacagaataaagagtccaaaaacagacctgtgcatatatgtacattttacttatgataaaattgacactgcagagtggtggggaaattaagatcttttcaataaatgatcctggctcatctggagatccatatggaaaaataaagtggaagtggattatttcttaacaatttacataaaaatgaattccatctaaattgtagacctacgtgtaaaacaccaaatagtaataataccacttttagaatatattatagcatcttcatgacctgaggataaagaagtaattattaaatcaaatagaaaaagcaccaattataaagaagaaaaaggtgataatgtttattaatattaataacttctgtttgtcaaaagacactactgaaagtgcaaaaagtcaagctatataaaccaacaaagaaattataccagaatatttcaagcatcccgacaaattgagaaagacaaagcccaatagaaaaatgggcagagacttaataggcacttcacaaaagaatataaccaaatggctgtatacatttaaagaggtgctcagccttatcaaggaatcccaagttaaaaccacaacaatggggccaggcgcggtggctcacgcctgtaatcccagcactttgggaggccgaggcaggtggattacgaggtcaggagttcaagatcagcctggccaggatggcgaaaccccatctctactgaaaatacaaaaaattagccgggatggtggcgggcacctgtaatcccagctacctgggaggctgaggcagagaatcgcttgaacccgggaggcagaggctgcagtgagccgagattgtgccactgcactcctccagcctgggtaacagagcaagactctgtctcaaaaaaaaaaaaaaaaaaacccacaagatacccccacataatctccagattggctaagatttaaaatcagatgatactaaagttgtcaagcatatagagcaatgggaactcctacattgctagtgggagtaaaaacttgtacagtttcattggagaacactttagcattatctaataaaattgaaagtaatgctaacccaacataaatacatgcttatgtacatgaggatgcatgtacaagaataaacaagcatccataatggccccaaaatggatacaacctggaaaaaaatcagtaaaatgagttttaaaaaagtgacatcatcatgtagtaaaatgaacaaactacagtgacacacagcaacattaataaatctttaaaatataatatttagtaaatcaaactaaaaagtatatcttcttatactatttatataaaattcaagaaaaggaaaaagaaaacatgttgagatatgcacatttcagtgctaaaactaaataaaagcaaggaatgtttaccccggaaataggtatagtggttatctatagggtgaaaggaattgggatcaggatggagtatttggggaatcatttgttgcagacaatgttctaattcttgctatggcggtattataattcattaaactctacatttatgttttatgctattctctgtggggcatcatatttcacaataaaataaaggcatatattgaagacatttttatttcatcatatctatacttgttatccttaaaggctgcatcttattccattgtagatttatctgttcccctccttttgaatagttggagtgtttttgttttttgcagttgccaactttgagttaagcatctttgtacatatatctgtgttcatttgcttgtgctggtatttctgtaggattggtttccagaaatagaatcaaaagataatttgcatttcatattttgatagatgctgttaaatagccttgcaaatttgttcagcctgtcttttgctatttgaagcttttaattttttattgttcaatctgtctctcttttccattgtaatttctcgcttttgtgtcatgcttagaaagcctttttcaacttcagtttatgtctttatccggaatttatttttggttatgtgaaatgagattttttttcagccatatagctagttgtttcagtgcttttttttttttcgaatggtcagttctttgcacagtgatgtaaaagctaccctttatcatcagctaaatgtctatatgtctttttctactctactgatctatttctatatcaatgtcacagtattttaatgattatagattttaatgtttttctcttactgatatagggaattctaattagtttttcctttcaaaaggtatttggccttttattcatgtacttacttttccaaatgaatggtagtatcaagtccctctgtactctcagccaaaaacaaaaaacaaaaaacatgtgttgacatttcagttggaattacaatgaatgtatagattatttgggagataatttactttcatacacatttttaaattttagtcatttttaactttatataaagagcatgttttatatattcttttgaactttttccatgtaaatattatattactcatatctctccatatttttgctatagtttatttgactactgtataatttttacattgtttgaatataacaacaaatttagattaagagttgtggttggggttggtattcaagttcagtctcttattgaagtatattttttaaacaaaaaacaaggccaggtgtggtgcctcacacctgtaatcccagcactttgggaagctaaggaaggcggatcactggaggtcaggagttcaagaccagcctggccaatgtggcaaaacccagtctctactaaaaataagaaaattagccaggcgtggtggcatgtgcctgtaattccagctactcaggagaccaaggcacaagaattgcttgaacctgggaggcggaggttgcagtaagccgagaaggcgccactgttctccagcctccgtgacagagtgagactctgtctcctaaaaaaaaaaaaaaaaaaaaaaaaaaaaggaaaggaaacaaacaagaagtattgactataaaagactggtggggttggccattatattaaaattataaacttctgtccatctatagactttaagtaaagaaggtaaaaagaccagttagaaactgagaaatgatattcacaagacccacaatttttcacaggattactatcaaggacatacaaagaactgctatctattaataggctgagcatgaccaactcaatagaaaagtgggcaagagatataaagaagactttcacaaaagcataacatatatacccatagacttatgaaaaatgttcggtattactggtagtcaggatatgcaaaatcaaccatcttatcttcattccatgagaaacactaaaaattctgacaataccaagtattaatattgagcagaatgtagatgactcaggatttcatatatcctgctggtgggaaaaagtttggcattgctgaagttgaacatttatataccctaagcccagagattctattcctatgtatataccaaagaggaattcctacaaaggataaaagaagacatttgcaaggatgttcacagcagcactgacaccaatagcaaaactcttaacaaaggaaatacaatatacttcaataagagactgaacctgaataccaaccccaaccgcaactcttaatctaaatttgttgttatattcaaacaatgtaaaaattatacagtagtcaaataaactacagcaaaaatatggagagatatgagtaatataatatttaaatggaaaaagttcaaaagaatatataaaacatgctctttatgtaaagttaaaaatgactaaaatttaaaaatgtgtatgaaagtaaattgtctcccaaataatctatacattcgttgtaattccaactgaaatgtcaacacgttttttgttttttgtttttggctgggagtacagagggacttgatactaccattcatttggaaaagtaaatacattaataaaaggccaaatacaggattttgtcagttgccttttcagcatgtactgatataatcattttgtttttaccttttaatctcttaatacagtgtcataatgatgttgtattaaaatatttattcatttctcccaagtcacaaaagtaaagccaggaaacttaaatatagcaggtcattgaaaatacaaatttgttctttgcagtattcttaaagccttagaattttttgtgttttgtcatccagcataccgaccttgtgctcatctttttactctgcttatctactttcattttacaaaacatcattttggaatttcccaagatacttaaatttttattatttattaactatgtgcagaaaaacttggggtctctcttcatgccagctaattacactactgctgtaaaatgaagatgcaattagggaaagcaaggcagcaacttactaccatttattctatgctgtagtcagatgatgatggtgaactctgattttgttataaatgactgtagatctttgataaacctttgatgttactgttgttgaattaatttctcctgtcttacagcggcctctgttgaccccaaaccttaagatctttttagcgtatgagaccttaataaatgatagaagaagaaaaaaaattgtgtttgcaattttgtgatttttttaacatatggactcacagattatataagcttcaggtcccacaacacatgagtctgcctctgggtgtaaggggtgaagagtgggggttttatttaccccagttcttgcccacaattgtgctatcactgctagaaagctgatctctatgatggggagccaatcgttgtttactttactttcagtaattaaagttaatttaatctacttgattaaaattttatctcatatcctatttaactccacccccaaccccaccatggagtaggagatagccagccagttctttcactcctccacccctgctctaccctcttcaacttctaacccttctggcattggagtagggagacaggattggagaaaaggtgttctggtctgatgccacagtttttacttagccagacatgaaattacaagcccctgttggttattgttgcttctctagctaacattggccgtgaatttgaatgccttctgcgtgtgttccagtgctggttctgttacaggtagaagggtgcaaactcttcagaggggcccataggaagcttccctactgaatagttctttggtgttggagatccagcatccacgatatagacctggttctcttttttggtgtctacttagctcatagtaatcaactatatctttcctttgcattcttgttcttccagtcagcaaggttacaggctgctccactgcagcaccttgttcagggttttattttaccagggctgctataacaaagaaccactgactgggtggcttagacaacagaaatgtattgtttcacagttctggaagttagaaggtgtcaacggggttgtttccttctgagggctgtgagaacgaatctgttgcatgccttttcacctcgcttccagtgggttgctggcaatgtttggtgttccttggtttgtaggtatgggtgggaagaaaataatagagttttatccctttggtttttatctgaaataaggaaaagtgtacttcactaatatttgctttatagatttggagcccatgtatgtcatttatgaataaatatactagagatatgaagttaaattttctattgatataatatttaagaagtatagaccatgagcttcttgagaacaaatctttttctaatttgtctctatattccacaaatgtgatgtattttattgtaatgttaatgaatttctgaggtagataataatgtagttctgtaaaatagttctgccatttaaactcatttaagatcaaatagggcatgctttacatatctgttgatgcaactgttttgtccaactacagccgaatttacaacagattcaaatactaaccagaaggaaattaatgagttgattgtggtatttttttttcaatcagaagtgttttctggatacatctagatacagtgttgtaacaatccaggtgataaatgtattgaacattttttataattgtggtttttaatgtaaaaaaagaaaggtatgaaaacccttgacttttttttgagttgccaaaacatttctgtaataatgtatacattctccatagctattagtacccgttagctttttttaattgaacagttggcccttcatatctctgggttctgcatatgtgtggattcaaccaaccatggatcaaaaatattcttaaaaaaattgcatctgtactgaacatgtacagacttttgttctcatcactattccctaaactagtgctccccagcctttttggcaccagggtctggtttcatggaagatttttccatggacaggagggagtcgggggtgggggttggttttggcatgattcaagcacattacacttactgtgcattttatttctattattattacattgtaatatataatgaaataattatacaactcaccataatgtagaatcagtgggagcctgagctcgtttccctgcaactagatggtctcatctgggggtgatgggagacagtgacagatcatcaggcattagattctcataaggaacacgcaacctagatcccttgcatgtacggtttacaatagggtatgtgcttctgtgagaatctgatgccaccactgatctaacaggaggtggcgctctggcggtaatgcttgttcatctgccactcacctcctgctgtgcggcctacttcctaccaggccataaaccagtactgctccgtggcctgggggttggggacccctgccctaagtaatatagtgtaataactatttacataggatttacattgtattaggtattacaagtaatctagagatgatttaaagtacatggaaggttatgcataggttatatacaaatactgtgccctcttttatcagggatttaagcatccatggattttgatgtctgtaggaggtcctggaaccaatcccccatggataccgagagattactgtgtatgacttaaggtctataacatgatgttttgatatacatagtgaaatgattactacagtccagcaaattaacatatctgttatctcatatacttctctccctccctccttccttctctccctccctccctccctctcttcccttctcttttccttcatagtaagagtatctaaaatctactcccttggaaatttccagtataaaatattattaaccatagtcctcatgttgtacactagatctctagatttagcctacatagctgcaaactttataccctttgacctaattcttcccattttctctgccccaggtaaccagtattctgctctttgttgctatctgtgtatttgttgttgcattttttggtttttcattatgttttttttttaattccacatataagtgagatcatgcagtgtttttctctgtgtgtctggcgtatttcacttagcataatgtcctctaagttcattaatgttttgcaaatggcaggatctctctctttttcaaggatgaatatttcattacatacacacacacccacatcatagtttctttattcgtcaacaggcacttcagttgcttccataacttgtattgtgaataatgttgcaatgaatatgggaatgcagatttttttaataagattgtgatttcatttcctttgagtagatactcagaagaggcgggattgcagggtcatattactagttctatttttaattccttaagaaacctccatactgttttccacacgggctgcacaaatctgcatttccaccaacagtgtacaagggttcccttttcctcccactcttactaacacttgttatctcttgtttttttgataatagccatcctaaaaggggtgaggtgatatcttattgtggttttgattttcattttcctgatgattagtgatgttgagcatcttttcatatacctgttggccatttttatgtcttttgagaaatgtttattcaggttctttgcccattttttaattaggttattcaattttttggcattgcatcgttatatatttttgatattaaccccttatcagatacatggtttgcagatattttctcctaatgcgtaggcctccttttcattttgttgattgtttcctttgctgtgcaaaaaaaggctattaacttttatccggtaccacacgtccaaagttagatttaaattaacatagttttcattgtaaaattagcaatggtaaatttgtcgaagcattaaacagcctcattaaatgttcataggagcaaataaccatgtcaaataccctgttcagatatggaaaaattttgctcatttaacaaatattaagcacttactatgtgcccagcattgactaatgttcagtgaaatccttttgttaagagattcttttgaaaaacaatcagactataaatattatttattggtggaaaagagtaaaacatctatatgctataaaaaggccgggtgcggtggctcacgcctgtaatcccagcactttgggaggctgaggcgggcggatcacgaggtcaggagattgagaccatcctggctaacacggtgaaaccccatctctactaaaaatacaaaaaattagcggggccaggtggcaggcacctgtagtcccagctactcgggaggctgaggcaggagaatggtgtgaacctgggaggtggagcttgcagtgagccgagatcgcgccactgcactccagcctgggtgacagagcgagactccatctcaaaaaaaaaaaaaaagaagaaactatggggtctggcctttttatttggccactaactctctggattcctacacaatttacttaactctgttgtagtgtctcagatcactgatcaaggaaaagagttttacttctcattaaataactgttcaccttcacccttcatacctcacccaaaatatctaaaaatgttatggaagaaattccaatatggaatgtagttctgagtgtcggctctggaataagaatatctaagtcttcacccaacctccaatactggctatatgacttcatcacttctctaaacctttgttttctctgaaccttagtttacttaactataaaatgggaaaaatgttactacaaccttgtagggttgatatgaggagaaaatgagaggttaatagcacctcacgtactacctagtacattgtaaatgcagaatacatttgatctattattattgttgctacaagtattcaaattattgctaggcctagtgacaaattgcaggagatgttaccctaatgattttcagtttacttacagagcagtgctaatcataggtatattgggtttatatatccatctatgcatctactcaataaatattaggtagctactatttgcttgatattttgttaggtgctaaaagtgataggctccaagaattgtatatactatgagtaaaatgtaaaatataactttatattaaagaaaaaatatttcaagaatagttatgcattagctactttctgggtctttttgagaaggagttatctgttcattaacaacagctgtcactgtatttactttttttttcttagaagaatagctttagtatttaaagaatctgattatctttaattctagataatcattaacgtctttaaacagaacctgcctttagctttgaatggaatatttctgttgagcacatgttttataatactgttgactaccttgcttttttttttattactttacatcttgatagcctttttcactgaaatcaaagcaacttctatgtatatattaaatattcatatgatgggaatacttctgatgctaacatccttgttacattgtggctttgcatgtctaagtattgcttcctaaatctagataaatgaaaattcatcttagtttcattagtttcatcagctctaatcttataataccttatatgatcatataatactatatctcctcactaaaatacaaggaaagttatagtttgatatttactttaagcttctttgaggaaaagtattgtacatgtacaaaggagtatcaagatagagatgcaatcatggtatctatcctctagttgcctgttatgttatgttatgttatgttatgttatgttatgttatgttatgttatgttattttgatggagtctcactgtcgctcaggctggagtgcagtgacatgatctaggctcactgcaacctctgcctcccggcatcaagtgattctcctgcctcagcctcccaagtagctgggattacaggcacgcaccactatgcccaggtaattttttgtgtttttagcagagatgggttttcaccatgttggccaggctggtctcgatctcctgacctcaggtgatccacccacctcagcctcccacagtgctgggattataggcatgagccaccatgccaacctagttgccttttagaaaactagttattcttgctttcagtcctttatcacaatagtgtattgaatgtccgtaagttcaatagtaatcctccaaatatttgagacatattttaatattatatagattattactttgaattatacttgcaatcagtacccatgatttctcagtcaccattgcttgaagacactttgtttttcaaataaatgcctttttatgatattgaaatataatttgtatagtagattattcatggagtagcatgcctaattttatccttaaaatgtcaaccaacatcaatgttaaatttcctgattttaatttttgttcttggtttagtaagagaatgtcctttgttttagaaaatgcacactgaaacagttgctggtaaagggcataatgtctccagcttcctcaaatgagtcaggaaaaatgcatatatataataaaaatatacatagagtgattcagcaaagttggcaaaatgtaaactgttgataaatctggaaaaaagatattcaggagttgcttatactatttatataaagttactaaaaaatctacaccaactttagttatcagtttaggaaaagatcatgtattacttgcctttgttcattcttgagtatctagcattaatcttttcctatgtgcaagaatactaaagcaggaggaaagagactgagttagtggttttggtttcttcaagaaggatggaaatcccagaggaattagggagaaaatgtggtgattgtaaaattagaagataacgctcatccgctgtcacattttaaaattacttggtacctcccacccccccccccaaaaaaaaacacagattatagaaaacatcttatttggacatccttttgaagtataaggcttccacacaaaaacttgtacacaaattgttcatggcagcattcttcataatattaaaaagtagaaacaacccaaatgtccattagtggaatattttcggccataaaaaggaatgaagtactcgctaaaacatggatgaacctaagtaaaagaaaccaggcataaaagaccacatattatatgatttcagttgtataaaatgtccagaataggcaaatgcatagagtcaaaacttagatgagtatttgttaggggattaggggctggggagtatacagagtgactgctaatggacacagagtttcttttacaggccatgaaaatgttctgtaattaaatagtagtaatggctacaaaaatgtgaatgtattaaaaatcactttaaaaggatgaattttatagtatgtgaattatatttcaataaagctcttattttaaaaaagtaaaaccttgcccatcactcttgcctcggagtcttcctgtctaattaaaggtaagtcaaagacccctaacattacatgatctggcttcctattactccacagtctgatctccttttactttttccctctcattccagtctagctgcagtgcctcctggctgttcttgcctctagtctttttattggtagttccttcttcctaaaacttaccacctttaacagtttagtcaaatgtcaacctctcagcaaggctttccctggctaccctctctgaaattgtaaacctcccccagattacctatttcccctttttgctttactcttctccttggtattatttaccatctaacacaatatatattttacttttttatcttactatttctcttccccataaaatataagctccctgaggacagagattttgttgcttttgttcacaactgtatgtgggggtctaaaatatgcttggcacatattagcactgatattgttgaatgaatgaatctgaaagtatgagtacaagcagctataatgaaaatcaggaatactaagtaattgaagaaagggctacatattttatgccctttattaaaataaaaattaagtatctcatgggaccatgaaactaaaggagtagaaggaaagcagtaatttctgtcttgaaagcaaaataataagacaattattcagttattaaaatggaaataaaacgttatttgacccaggcagataatagttactttacttttcaatgataaggacttggtagatatccggacatacattaagtactgaaaatatgttgcctgaatggacagtgttgacataaatcagggatcatttaagtatggcccatgcctttttttgtaaaaaaatttgtattggaacacagccatgcccattagtctacgtattttctatggttgtttttgtgctataacagtggagttaaagtagttgcagcagattatatgacccacaaaacttaaaatatttactatctggccctccacagaaaaagtgcatttgctgacccctgcctaaattggtctctgtggaatatggattagtataatagagaatcatgaccaagccttcagaagtttacgtttcatttcctggactggctgtgttgatttggaaaagttaagttctatgattttcggtttctcatctgaaaatgaatagaatacttatctcacgtggttgttgtttaagaattttaactgagctaatgtgtataaagcacttagtgaagtgcctagtaaacagtaaatgtcagcccagtaagtagcacatgcatatgtgtatatgcatatatacagacatgcacatacacacaggaaatgcatatgccctcaaataggaactctgtaagtcaccaagcattctccagacactttctatatttttaagtaaataatgaataaagttaattagtaagtacttactacacataagacgacatggtaaactgccaaaatgtatgggattttgttttttatgtagaaaattatagtcaaacattctttctttcttttttttttttctccttagaaacagggtctcactccgtcacctagactgcagcacagtggcacagtcatagctcactgcagcctcaaactcctgggctcaagcgatccccctgcctcagcctcccaagtagctgagactacaggcacatgtcaccacatccggctaatttttgcatttttcgtagaagtggggtctcactatgttgcccatggtgttatcaaactcctgggttcctcagcctcccaaaatggtgggattataggcatgaaccaccatgcctaaccttcaagcattatttctgacagccctatttacagtattttgatgctcttgactcacattttagcaaaatgtacagcccactatagagttttacattttcaggtaagtttcaatgttttatttttaaggaaggactagttcatgctttgttcggattataaaaagaggaaaacagtgtaatgccttatacatcatattatgacaaaatttcaatctagaactttttcttgggtgcctcattttcttttttctttttttgatatggggtctcgcttgtaccccatacaaagagtgcagtggggtctgcactcttactagggtgcagatatggggtctctgcacccaggctggagtgcagtggcgcgatctcggcttactgcaacctctgcctcccgggttcaagcaattctcctgcctcagtctcccgagtagctgggattacaggcgtgcaccaccacgcctggctagtttttttgtatttttattagaaacagggtttcaccatgttggccaggctcgtcttgaactcctgacctcaagtgatctgcctgcctcagcctccgaaatgctgggattacaggcatgagccacagcacctggtctgggtgcctcattttctaactgtcagtatacagaaggcaaattcatagggctggattattttgatgacctttctaactatacagtgttttctttgttaaaataaataagagatttaatttttccttaaccaagttattttggttgttaaataagaagaccaatggtatgaatccttaaatcaggatatctttagtattaagatatctgcaatacatgaaattataatctcactttcaataataatctagtaaacagttataaatctactatatgctaggcattaaaattttttaaaaacttagtagaacagaaattttgttttctaaaggtatgagatattgttgagaaaaacattatgtaaacaagtaattttaataacataatagtaataacaatgaaagtacggacgtgagagccattagttctactttaagatgtcagggaagacctggagaggtgacatttgagctgagtctcaagggaacagttcaatattgtcagatgtatatggtagagtgataccacacaagaggtaccaaagtcattcggcaaaaatctttgagcttctactgtgtgtcagataatgttttaggcagttgaacaaaacaaaacagttgtctagttgttctatacaaatgaacaaaacaaatgacttttttctgccactttcagtggaacatgtaaaggcgtggaagtgaggtaaataatacagaatggctgagtcgagaggagtctgggggtccctgacaagaaaaaagcagaagccgtgtcacaccaggaagtttgagtgtaatcctgtaggctactgatgtccaatcccagagctccagggatactggtgtgtcatgaagttattacaaaggaattagcaatccatgcttagatattaagcatgcatagcctgtggattttaataaaatgtcttttacacctatttttgtactacttctcaattttttgtagttattttgagtaatagaaactcatttaaacatatgaattcataatacctttttcgacaatttttattttctcaatcgtgtggtactgtcactttaactacttttaagtaatcgtcaaaatggttaatttttaaatgaggtcctaaaatattcagcctggcatctcctgccagtgttgaacctgttaaaacttctagagctaccatctaaaacttcagttaatatttgatgagctccatctaagtgccaagcactgctctagccactaggattacaaagattaatataaaacaaggtccatgtcctcagggaacttacagtcataatgaaatagagtctagattaaaaataaataagactgaagtaagcatggagaaaagggtatagattcaggatatgttaaggaggtagtaactcttaatcaatgagaatctctcactgaaagcagactactagaatagaagcaaagaccagattcttaggaaaagagctagtgttttgctaatacaggggaaaaaaagctctatcttttattaagaatattgttttatcctagtaacaagcctaatcaatctccagagaacaaggatattaataatttatggttctgtgaacatacctcttctgcttgatttttctctgcctggtaataaggtataaacctgtgaaataatcttaagtcaaaccatgaaaatatgtaatgtaaacgatgtaaaaaattcatctggatctgacaccttcatgatgatgttgcagaacagtcattctctatgttgatctctgtaccttcagcccaacaagcttacttctcttctttcagatttcagccttctttcccacacacacacacacacacacacacacacaaatacacacacacacacacacacacttcctttctttcctcgcaaagaaagacagctattgactagaagcccagaattgcccccaagttccgaccaccagctcgaattcttatgaagtggacttgtaatatccttaatgttgctgttggcagtcagttacagattccattattgtcgatcagtgcagtcgccatgcgaggtggggggaggaatggaggaggaggagaagaaaggagggatgagagcttcctattcacagatttatcaacctgccttttcttgcaggaaatcttcgtaaagggggctgttgaaatagctaaagcaggaaggggaagggggctgcagttcttgcggaggactgaaaggaaatttgaaaacctttctcctcaaaacaaaacaaaatgctgaatttgttcttttgtctttgtttttgtttgatattttttacttaactgattagctattgtgctgtctggttatctaagctgcttccagtgtaggaacctgtttctttttctttgagtgtctttattctttattttcgtatgatttttcctgtcattaaacacacttcattattcagtgttatcctggctttttctttcagactaaagcataacaccaagagacagaaggacaaatctcccttctcttctcttataccaccctcttttaaccctatttctttccccctccccctggttgtattagattgatgtcacagagacagaattcagagtggagggaggatcacattttctctttcatcattactgcctagccagcaatttaagtgttggacccccaagaatttagtctctgtatcctttttttctcacttcatcattcagtaattgtgctctgtatggaaaagttttctggctggagaatgagtctcctttcccccggtgatgtggcggagtggttggatagtagcaccgaagaagagaagagccttctgtcatttctgggtacggtagggcttgcttgttcttttaaccctttattgtctgaacttttcttacttttgggaataggaccccaaattctctaaatccacttttgtatttttaaaaggagaagaggaattaagggaatatgtttaagtcgtttgcttttcaaattttgtttgtctgtagaaataatgccaccaacactagctatgagaaataagagagagattgctttgccttaacaaagagtgctagctccattcaaggcttaccatgtcatctggccagctgttcatggtatttagacaacttctgccaaccaaaataatattattgttttactttactctcaatacagtgatggtgaggtgtgctgtgtgagagtgggagtaggctttgtgtgcatgaaaagccaatgtacaaatcgagaagtagcttttatgcaaggtgtgaaatatttgtaatgcttatatatgatttctactgactacataaaataggacacatggacctcccattgctttaattttgcatttttgaatgctttctaataaatttctaagtaaagcaattgtttatcttgtggttattgatataataaacaaattattaggaaagttaggttgtaaatccagtcatatcttaaatgtgatagaagagcttgatactcatttaaaaacctatttgtgaatactttccctagattaattatagccttcaaatttatctttcttataaatttgatttatcttctattttcctagatataagtatgcctttattataaatggacaaaattcagttgatcttctaattttctaatttattcctcatgaatattatgtatgacctatggatagtcttctgccagtccaaaagttatctctactattatttgaaaatctttcttatagttagcataagtttatctttcaattctgttgtcaatcttagcattctgtttctttcctttttttttttttttttttttttttttgcagtttagatgtaaagggtcatcctaatcaggtcttcctaggtacatatatttagatactaacccgactcttaatttaccatggccttatttatcttcggcatttggatgactttaagaaatatgtatacctcttaagccttcgtttctctgaagcctatctcattctacttgcttcccattcccctcccctgacacatgcatacatacacatagagaaacatcagtgaagaaacaaatacagatatccctaagtaaaaccaatcacttagactctactacatcatgggaaaggaaggcagagttatcattaaacatattttctgtgctctggcatacctttatgaattctaattatctagcctaaagataaatttatttatctcctgtttttgtggggaaggcattatcctactatacctgaaatgaatttggttaacaaagatgagtaaataaaaagtgctatagtagtgcccccacccatccctgctcctgtcctctgattaagggagttagtaaattcctatttatccacagatggataaatggaggtaataaagacaaagaatgttagaacttgcttagaagaaaaaaacgcaaatttccataaattatgatgttgacttctgggtagtcaattcccgattatccacccaatggaagcttcagattatagataaaaacaggtaagttagagtcctgattctgctcaagggctacaataagtttagttgctgagtgaatagacagcaatgtatcccatgctctgctgtggcagtgctaagctgtgaaagtcagcaaatcttatttttaggattgaagctctctcctgaccataggcagcaaacacctccatctgtggataaacaggaattttactgagctcctccacaggaatgaggaacaaaactatctgagatgtagcttgtgatagttcgaggattaagtaaaacccttgtgttgagtcatttgctaatgtaattaccattagtgacaacatgcttttcccaatgaagatgccaagagaaaaacaagaaaactaaatctactttatggtgaatctaggatgagtagaaccaagaaacactgtgtcttttggtagctatcaaattatgctttctttgcctaaggaattttaaggcagatttccctccagaaggggggatgcaagaaaagtactttgtgctggttaggatctactacttacttctgtacagtaaccacctaactgatgttcaggccttcccaataacgtagctcactgctagtttgatgaaacttcatacaactgtgcactgttattaatctgttaaaaaaccttccatggtttcttcatcacctaccagataaatttaaaacaccttactgtgaaacttaatttggcctttcacacctgacattctattattcattttagaggagaaaatccccaagcctcccttccaaccaaattgatttacttcctgtcttggaacaaatattgccctttcctaccttgtttcttctgtcagcagtgttcaaactcagctttctaaattcagctttttaaaactctgcccttgtttcaaaactttcttataaataaatgcaatgttctagacactgctagatgctgtggctggatacagagaagtataagaaaaagctgcttgtgagaggcatagtgtttggctagggagaaaacatgaactacgcacaagttaaatgagaaaaattaaatggtaattcagacgacagtggagaaaatgaaaataaggcagttcctaattgtaaaattatccaggtaaaaattgctttgggagtttgaagaagagacatttaaaaacattgaaaattatcttacagagatagggtttaatctgaatcctaaaagattttttatggaaatggtagggttttctgtatgaaagcagtgtcctgaggaacattaaataatttcacatccggtgagcaaactgtcttgaaaagaacgcagaattcatgtaaagaagtaatgagagataacatttgaagggtatttggaagctcactatgtaggactagtgacaattttatcctgaaagccatagagaagaatgaaagacccttgagcaagaagaagatatgatcaaaatagttttttagaaagacatctgaaagtgatactaaaggggaagaggctagaagcagttaaatcagtttgaaagctattgcagtagtacaggtatgcaataagtgcctctactttttttatccctgtgtattataattgttggtttgtgtattaaaaccagactgtgaatgcctccacaaggagggcttaatcctctgtcttttcagcacgtggaatactccttgtgcagatgaatgtttgtgtagctcaggtgaataacagattaaaatagatggagagattacaaagaatgtatcagcagaattggtgacatattagaggaatggggaacaaaatgaatcaaagataatttttgaacttggaagaatggtggtactattaacagaaataaattgagaaagggagccaattttttaggaagatgggagttctgtttaggtattttcacttttagaagactaatccacatccagacagaaaaaacagttttggtaattggaaatgaagtcacaggtgggagctgttcatctagagaagaaagattgttgatattctaagcatctgtaggtcatctgctatcaagagcttgtcaagaaaaaagagagggcagcagctgaaacttgaagaatatcaacatttgggggtgggtggagacaaagaggagacacagagcgaatgaccgtaaatgtgggaggaaagccaggatggtgtggtattacaggtgctaaggtagaaaaggttaacaatgtggtcagtagtgtcagtggctacaaaagccaaagagaagtcagaaaaaaaccactaggcttgacaatgtaagagactgttgataacctgtgaaagtgttaatgctatttgagtaaagttgaagagggagaagtcagattttataatactgagaatgacagtaggaggtgagatagtggaaaccacaggttaagccttttgcctgaagaaatctgtgactgacagaaacatgtaccctgttaaaaactagattgagaagacttgtacatatttttaagtggaggagagagcaagatcttgaacctacaagaataaagactaagaaaacaaaacattttatgggtttggaggtgagagtagaattaaaagcataggattaaccttttgaagggagaaagaaaaaactcatacaggaaccaaatatacatgccgagatttagcaatggaatgtagggaagatggggagataacagctactgtattaatcttatgccatttatcacacccagtcttgcagagttagctatttgtgtacccatttatgttgttatttgtgtgcccatcaaatacttccctgctactgccagataaggatcttctcttaatattttggcatcttccagaatagcaccgaataggtacttagtagatactttttgaatgaatgaatgatatccagatacccaaaaatttgagactcgggacttttcaaaattattgaaattattctgtcagatccagctttttttccctcttattctactactattctgtagtcccataaccttttcaggtactttgatagcatttgaaattattattcagtagataatgattgcgttttccaaattctagaataagaaggaaaatactcagcgtatacttttttccactttgccttttctaaatggaatttaaatgatttcattttacttcatagagtgaagtaatttatgtgatggaatagttctatgaaagaataatgtaattttgacaaatcctaaacattttaagtttctaaatgactctgttgactatagttaattatttggcattggcaactattatctgattcccaaaatttacaccaaacatcaagggagaaacatattcaaaaattgaaactctaatttctggtaatatgccagactagataacctcaaaaataatatagagacaattagaaatttcacattagtgtaacaaacacttttaactaaatggctgaactctcaggaaggaaaggaagtccccaggaagaggaaaaagaaaacaaaacaaaactcgaaatctagacagtaaactctcctgggggcatttaccaattttagaatattagagttaagttttaatggctataatataggagatgggccaagggtctaacaaagtaaagaattagaactgaaaggcctatgtcattcttccccataggactgggcctctgaatgagttacaccttcagtgagagttgaagttagaaaaatctctcattgacaaatatagacaaatcttaattatcttaacctggactggtaggtgaggtgggagggggaaaaacatcctgagaattcataatcacagtcgtgataaggtaaaactgaaatagtggacaacattaatatgtcagagataggaagtgggtaattggaattgaagtattttaagattgttgaattattcgagaaaaggatagaaatcgtgattaactttaggctttaagtatacgtgttaaaatgttaaggacaactactagaagagtaaaaatagagtatttttattgaaatatttgaaaatattaaaaaatattttcaaaagcaatacagaagaaaatggaattttttaaacctgattaacctgattttaaaaaaaagaaaatcagaaaaaaatggggaaaaaaatagaaaatacagtaagatggtaaaaataaaatccaattatatcataaattatatatgaaaatgttaaaagataaatattgtcagactggattttttttaatgctatgaatgagagatctaaaacacagggacctaggaaagttaaaagtaaaggcttggaaaaagaaagctggtgtagccagtgaaatagaataagactatcaaaaaagttactggaataaaggaggtccctaaataatgataaaatataaaaatcactaggaagacataacaatcttacatgtacccaataacaaaacctcaaattttatttggcaaaaatggacagaaatggataattctacagtcctatctataaaaattagtaaggatatagagaatattcaaaaatgcagtaagcttgatttaatggacatatatagaatcctgactccaacaattagtcttctcaagcacatacagaatctttataaaaactggcaatagaccaggtcataaaacaaatctcaacaaatttcaaagttatacggattgcattctctaataacagttgaactaagttagaaattagtaacaaaaatttactgtaaaaacctttatttttgcagtcttttaaagttacttgcaaataacttgttagtcaaaaaggaaaacataatggaaattataaaatactaagcaatactgaaaatagtgtatatcaaaacttgtggaatatcactaaaatagttcttaaatgaaatgtgtagtcttttacattgaaaagggcaaaagctacaaatcaatgagctaagcatttaactcaacaagttagataataacaaacccaaagaaagtttagggaaagaaagaatgaaaataagagtagataatgatgaaatggaaaatagaaataaacagaatcaataaagccaagagttgttcctttaaaaagcctaatgaaaatagatgaaaccgacaagatttgctaaaaagagaaaatataaacaatgttgacatgaaaaaagggtataattatagaaaattagagaattgaaaaatagactattataaaaaagacctttttgataatatatttggaaatttagacaagtggacattttaagaaaaatgtaacttaaaattgtagaagcaataaaaaactgtaattaggcctgtgacctgtaaccattaaagaaacagaggctagacacagtggagcacacctgtagtctcagctactggggaggctgagttgggaggatcacttgagaccagaagtttgaggcagtgagctgtgattctgccactttactgggagtgacagagcaagaccctgtcttgaaagagagagagagacagagagaaaggaaggggaggggaggggagggaaggaagggaagaaaggaagagagaagagagagagaaatggaatcagtagtttaaaatctaccactgattatggtttaatttctcatacagcttgacttcagaaaaataattaatgtcaaagcacacttgcgttaatatttccaatcagtgataattcagtttttcatagcaagtgaataaattagcattctggcatctaaatttaaaagcaaaaagtacctcagtatggctattgaatccatattgagtctcacaggtggacatggttcccttagagtttttaagtcttacatcctttgtttagggatttccttagaacagaaaaagtgtagaacagaagatgttcttgcaaaaattttccttttggggatgtataatttaaaaactaaaggaaattaagctgaacagatatctaaagaaaatgaataagatatcaagacttaaatgtaattatgtttaagtgtgcttctcaataaaatttggaaatttgtgacttaatttgagacagggtctcactcttgtcagtcaagccctgcctcttccacctcagcgccttgcctcccagcctcagcgccccctacccgtagtagctgggacgacaggtgcagtcgcacgccgccacgcccagctaatttttgtattttttgtagagatggggtttctcaccaggttgcccaggctggtctcgaactcctgaactcaagtgatacacccgcctcgggcccccaaagtgctgggattacaggcgtgagtcaccgtgccccgccaatttgtgacctttttaaatagaatgatgcatagaaggaaaatcctcaaaacttttaaacctaatttcccatgaggcttatttatcataatctcaatttttctgtgatagccatgtcactaatagagagatcaaaagaaaaagaaaaaaattagaagaaaaaataacaatttaatatacataaaggagagtggtcctaaactcaaccagttggttgaatttaattccatgtgtgagttagaggtaactagaaaatttattaatttattttgtattaaattgaactatatgaaattgctggtattttaccattttaatctaccaaaaaaaggcagttctatagggctgtacctaatagagtcatgattataagcacatgtgtctattgagtgggggtaggggcaggtgtccagacaaagtatgcttaactattttttagttgttaaaatatatttgccattatttattatcttttattctatcttaataatccctgcagacaagcaagaatgggtgcaaatggtttataaaaacattgtgagagaaatacttaaaacagagagaattctaccggttaaaatttgtttaaaaatttagacacaatcacaagatgattccaatcttgcagtgacttaagacctccattatggaacactagtatcagtattagtcaggaatatagtttagtttggtacccaaaactaaaacgcatataatcaaagaatatgaacttatataaatgtattaattggaaatcaaagaaatgtgagtaattaggcctggttttatggaagtagatgaattgaagttgatattgaaggtcatctaagagttggcagatatgtaggtgaaaaaagcaggcatgtgagaatgaatgtggccagtttgagattagagatcatctgactgaggcaaattgtagaaaactgttggcagaaaggactaaatatgcaaagtagggccaggtgatttttttcctaatgtctgactatctaaagatctctaggaaggaaatttcatccagaaagtaatgttttagggagattaatctggtaatgatgagtaggatagctttaagcagggagagactggagtcagtaagagcagttaggtgcttcctgccataatctgcatgagaagataaaaagccctagattaggatggtggatggtagtggaaataagacaaaatgaagccaacagccatttcgaagagatacttagcagtgtgtgttggctaaaggggggcaaatcaacatcataggctcctttcttttttattaccttcactaatgggtgatgttgagtgtaaatgattttgtttttgtacagtgtcatgtgcatatttagttcttggtaaatgattaaattttcatctttatattacaggtttacatatttgtatgttttctttttttaatgtcctctattaatatttgtttgggaaataaaacccaaacagaggctctggcataatcaagactaaatcttttttttaatgttcactgactaccaaaatgatggtatgaataaatctaccattatacccccaattgtacatgaagcatattaacaatgagaatatattactaaatcagttacagaaaaagttatatatgaagcatattaataatgagtatatattattaaatcagttacagaaaaggtttaaataaaggtgttaggccctatctgtagattagaagagatagttgatgacaaaataaaactcaccaaactgaagttgataccttataaataccaaactgaagttaatacattataaataattggactgacatgttcaaaatagtcattttatgctgaacaatgctttgttgtttagtaattgttctttgcaaaacctaaaatattaatgctttttatctctgttcatctcatacaacttatctaagtacttatctccccacataggtatactgaagattagtggcattgaaagacatggtttattttggagggctcttgtcacttttttgttcaagggatcagtattagatattctttataagttgtttcctgttttgttcacattttttcaccattaacttttgtcattaagttagtaaacttttgtcccttgttattgttttgcctcacctctctgtgtttcttgactagaatgtttttatcagcatcagcattcaaggattgagttgttctttacaggttttgtgtgcagaaaacacctcaagagtatgacttaattctctttaaaatatgaagaaaactagagtctctgtgatcattcatcttattttttttctccattgcagcccattatacaaaacacatggagaacaggatagaatgcatggcaattaaagctgtctctaaagccaaactgcatggattctaatcctgcccccaccctttttaccagctgtgcaaacatgggcagagtaatacatgggtgatagttccacctccaaagagttgttttgaggattaaagatgtaacttatgtaaaacatgtagcaaataataaggcataatacaaggttggcgcaaaagtaattgtggtttcacattttttaagttgcaaaagccacaattacttttgcaccaaacatgacagtttgatgtttgtacttgtcgttgttatgttttcatcatcatcattaagatacccacttgtcatcactaagaactagatacgtgttttctatctgaaacttaagataacacataaatatccctgagctattttcttggccttttcagttgagagtgttgtttgcactaaaagtattctctaccatctcatccaacattgtcatgtgaagccctaagttgaagaaatggaatacttgtgggtggtattcagattccttggctggggaaaaaaattgtttttctattatgttaacaagaagaaatattaaatattaaaaataataataaatttactgaagcaaggaagtggtggggagactggatggctttactttatgagaatttaccacatttatgtacttagcaccaatttgtacatattggagtgtgtggggcatgcaaacttgaaaggactacttgtttgagtgaagtactgcagtctgagtgatacaaattgggtgaattaaagtggctctggggatttgtatttcagagcagctggatgcttgtggctgacagtgcataggctttaaggcagtaaaagtgggatacagcagaaagtatcctactgaaaatggtggatgaagtttataaaaacacccaggtgctatagtgttagcagccgtataaatgcagtatgtgatttttcttctctttgctcttgtcactttttctttataatatttttctaactctgtcttttaagttcctattacctttaggagtcctccagcaaaaaaatatgaaaccttattttcatgaaagccttttttgtttcacaatttgccatttgttattaaagcccctctactgaagagctacaaacccatttcctcctactatttcatccttcctattctgtttcttaaatgtcttctgtgccttaaatgtcttctgtgcatcctatggaagaagaaccctcctaattcagaattcacagcatggagagagaagttatttgcttatttcattcattaataactagagccaccaacataccacatcctatttaatgttgtcattatttacaaaatgcaagggaaaatagattatagtgaagtggactcattcatagcaacactatatatgccaaaatttcagtgacttgaatgggtacacaaacagtttggtttgtattcaatgttttatcatgttttgttgaaatgttgatttttaaaaaggcttttgaagtaaactgaagaattcactttatgagaaaaacattagaaacttgtttcctacctacaaatatcaaaattattaaagaggcatgtgaataattataattgaaagagtatttacatttattcatgttttataattctgtgcaaaaaattactaagaattggttcaggttgccattaatatgaagtgcttagaatcctgtatatgccaaagaaactgcatctgtgacatgtaatatttttctgttctattgtaacttgagaattttactatgatattttagtttcttatataattgttcaccaaattaaagctataaatatctttctacattttatttacctttcctgctgaatttcctcctctgaacttactttattcccttttaaattttgccaccatcctcagagagagtaataattgttactatctcaggggctacagcaaagattaagtaagttagatactaggcccagtacttagcacataaattctcaacatgagctaaaattcgctgggtgtggtggcacgcacctgtggtcccagctaatcaggaggctgaggtgggaggatcgtttgaacatgggaggtataggctgcaaggagctgagattgtgccactgcactccagcttgggagactgagtccatgtctcaaaaaaaaaaaaacacacacacacacacaaaaaaaaaactcaatatgagctaaaattataataaaactattttccctagacaaattattcacaaagaggtgcttaaatagcttttataatgtaactcttttaaaagaaaaaaaatttaaattattatctttacttgttttttacgctatggtaactaattctaaaaatgatagacattataagaaatttatgttatttataatagttaagtatatgcaaatattatatggcatatgaccttcggttaaacgagattgaacaaaaagtaaatgtaattgatgcctatagatatttgaccgtatagtaatgacattgtgtagcagatacctttctcatttaagatattttcggagtcttttggaacctaaccctcagttaatatgatagacatttcactttactctctttccaaacataataacattccagatttattctgtatcacattcattattcaaaatcctgaaaagaaaattgacctggtggagttggctcaagcctgtaaccctagcactttgggaggccaaggcgagtggatcatttgagcccaggagttagagactagcctgggtaagatggtgaaataccctttctagaaacaggcatggtggcacacacttatagtcccagctactcaggaggctgaggtgggaggatcacttgaaccccggaggtggagtttgtagtgagcccagatcataccactgcactccagcctgggcgactgtcttaaaaaaaagaaagaaaaagaaaagcattaagaaataccagtaagtgtatatctatggactttcaatacgatttgtaccttttggtgacgcatgtctgaccaggtggtttttcattttagagttaaaaaaaaaaagtccttacaagagaagattaatgagtttatatgttttggtgcaaaattagctttttggaagaaaggggttctttaaaatatagtagtattgtagtgtcatttccttagcatatacattttcttctgtcactgtccttatattggccagtattatctgaacatgtctgccccagttcctctcagactttacctcctactatttgttcccactcactggcaccaatcccactggcctctttgttgcggtttaccttagaagctttgtactagcttccctctacctgtagtcttcttccctgttaaacctgcaaggctgacttccttacctcctaaagtattgactcacacctcacctttgcagtgcaactacctattgaaaattactgtacctattcatctccctgactactttttatttcccctaaaacacttgtcaccttctaacttactccttagggtcctctcaaatacatgataggaatttttggcatttactccctggtaagtgaaccaaaggcagtgtatacactattaggttctaaggcagaaattgacttctgtttgttgaacaggaacatcctccaccaaaagtatatttgcccctataattatccaattttcaatttctttgccacactttccaaagaaagtgcgttgacatagaggaatatgtgtatgttgaggaaatgatagtactctattttggattttaaaagattcttccttccagaaagctaattttgcctcaaagcatataaactcattaatcttgtctttatctctgtttggtctggataacccagtttattaaatggcgaagaccaggacagaaaaggtgaaatggcttacacagaatcgtacatatcattggtagagctgctaagaaaaacatccagatgttctctttgttcaatacatcattctatatggagctgtattggaggttatctctcatcattttaagtcatcacatcatctgaggtcatatccaatggcaaaggaaatgaagagatacatttaaaacttaaccaggctttttataactctttttgcctttcaatctgaagatgaaaaatattatgtttagagatgagaaagtgaggcagtttcaggcctttatctgaaacaatactgtatctctcttgtctcatcagtctcagagaatgagcatattttaaaatgactgtaattaaatattgtaactatgaaaagaacattaattttacagcaggtgaaaataatgcaatagtatgtagcatgagtgggggtagaggatacagctgtctaattttggtctactggaactagtgtagattttccttcaaactgagcagaaatgtagctcttagagcatagtagcagctttcctttctgcttacagatttaaagttaaaggcacaagtttaatatgctgttcgttctgtgactaatccagcaggttgctcattccgctcttgctaatgctgctaccttgcttctaagtggacattggtacttggggtatttatttttctgtatgctttgaagtagttatgaatcttctgagaactaaagaactgggattctccaaaggcctattctacactagcaggtgagtggtattattgtgggggttgagaaagcaacaaagtgtaaacttcttttcattaggtgatttagctttaccttatttcttccccttctttcccctttttagtggaaattgttcaaacttcaggaatgatttaatatcttctttctggacccgataatacatcatataagctacatcagcattgtattttttcccataatacagaaagagaattttttttttaattttattattattatactttaagttttagggtacatgtgcaccatgtgcaggtttgttacatatgtatacatgtgccatgttggtgtgctgcacccattaattcatcatttagcattaggtatatctcctaatgttatccttcccccctccccctaccccacaacagtccccggagtgtgatgttccccttcctgtgtccatgtgttctcattgttcagttcccacctatgagtgagaacatgcagtgtttggttttttgtccttgcgatagtttgctgagaatgatggtttccagtttcatccgtgtccctacaaaggacatgaactcatcattttttatggctgcatagtatcccatggtgtatatgtgccacattttcttaatccagtctatcattgttggaaaaaagagaaaagaaaacagaagtataacaataccatatttattggagtttgaaatgtggccactaattttagtcaatatagtttcaaatagttaaaagcattgaaacatattcatttaatgagtttgtatgcctgaaaactaaaattggatgtatggaagaaagtgaggaaattaatttcagttttttttccttagccagaacattgcaaattaaggaaatggtttactagatcattttatcccagctaatgaaatttatttttcccccaatttagtttctctgtcaattattcagaaattaaaacatactatattgtaatattaaatctccagtgtcttctaatttgatatgaggttacctttataggtaattattagaggaaaggtgagattttttttctaccttcaccagccccattccctgcctgccttgcccctagccacatagagtcatctaacttggataattactctgtaaagtcatattcctgaagtctggaagtctttctgttcaatgtgctccaacaagctgatttacttaaattcagtgctttgtgccattcccatgaatctgagctaattatgctgccatttttcagcgatgtgcattagaagtcatgtgtgcctaattctgagaacagctttgcacattaaggctcatttgactagtgatggttagagagaagttaagggacttacagttactggtcataattttaaaatacagtagtagtatggaactctcttgtactgcaagcatacaagatgctatgttgtcagcctctcagtctttaggaatgttccaatttggcttgtgccttaccagtcaagatgtcacagagaagatatgtttagtcatggaaaagaaaatcagtgtccagcatgcaaagatagtaaaagggtaagcacttccagttggattttcataggaggaattgatttgtgtgcattactggatctgtgtaaaatggtgtccttttggcactaggtggatatacatttcagtaaatgttttttcttgctgcagattagtgtaagacagtgaaattttcagtaactgagggaaggcagtggttgggcatctgttaatagcctgaaagtaactaatgaggatgtgcagtcagaacgattgattgaatagctgcagtcctgtgtatttctttcttgcttgctctctgcaagctgtggagagggagggggaagagcaagacacagagagggagcgagagaaaaaacgctctctcttaagtggaagtagcacggatcccaggggccaggaggccagaaatggaagtttaaactgcatctgtcttttaaagggagaacagcaggaatcaaaatgtcagtctccggagttacgatttactccttgttttctaagatctggaagataacacagaatactttttttaggatgtggcttttttttccttgtccatgttgagattatctaatgttatctgagaagctggattcctttatgtctgtcagttgaagtggcgatgggaagcagttgtgataaaggtataatacgtatatatctatcatctgtgtgtgcgtgtgtatgcatatatatatacacatgtatatatatatcactctatgaaaaaatcttaaaaatgtagccttaatacagtatatagtaattaaatgggagaagatcacattatctgcaaaatcctaagcttgttaggttagtttgaacagatttaggattccagagtaagatcttagtaaggtcatattgccagaacaaggagaagctgatctatttttatatctgcataggcatatatgttattttatcttggcagcagctttcagtcttctcatggcccttttgttgcagtctggtgaatcatcttatctgcacagaactaactttgacctttgtgcaaacaccatcaaatcatatgcaacattagactatattttgttcagaagaatattagaaattccattttattctattaactcctacattgctgacatgtagagaagtagatttatatactgtgagatgcaactattaagtgaacttaaagatattaaacatagctcagaggaaattatttttatatgtgcacagatgaaaatataaactgtcacactaaagcagattcttaactgtgaccaagtctctctagtgtcttgatagtttaagcacctcaaagatagataaattatgtgagatagaatgtaatatacctttaaagcatgctggtttattgtgaaaaaccagtaactttacagttcagtggaagatcctaaatttggggttcttaatgatgtttcaactttcctccttttttccagaggtaccagcagaaaggtcccctcgtagacggagtatctcagggaccagtacatcagagaaacccaactccatggacactgcaaatacctcacccttcaaagtaccagtaagtgtttatcttctttataagaatattttacttttccttttctcctttcttcttagagttaggggcagctactaaggaatccaaacattcttctcttcaagaatttctttataattctgtgattaaaggatagactcatcaacttgtgtaaattaactgtggttaattgtcaactactttctttttttgagactgagtctcactctgtcatccaggctggagtgcagtggcgcgataacactcactgcaacctccccctcccgagtttaggcgattctcctgcctcagcctccggagtagctggaattacaggcgcataccatcatgcctggctaatttttgtatttttagtagaggcggggttttaccacattggccaggctggtctcaaactcctaacctcaagtgatccccctgcctcagcctcccaaagtgttgggattacaggcttaagccaccatgcccagccgtccactactttcagtataatatttattaggttttagggaatattatttttactcacagggtacttaacaaaatatgtaactacattaagttcaaattcctctcaactgtagagttcaaatccttgcagacatctttttatcaagttgctagcaaaaacctatcacaattctgtaaagaatctggtggcaggttttttttttaggaacgggatgtggttttttttatttttcagagctggaacataagcagagagtgacgagactcagaaagttgcagactaaattcacagagaattagacaattgtgaattctaatcctaagacttggtctgcactttgcttaagctatcttttggatgaccatggaagtgcttaagaaaaaccttgaaagaaactaactccttaaattgaccaggcagtattgagaatcagcattaaatacaaaagaggctgggcctagtggttcacacctgtaatcctagcatttttgggaggctgaggtgggaggattaattagaccttaaggatattattgtgttccaggatggtctatagtgcagaaattgacattgataataatgatcctgaatcatcaagaaaaagtgagattatatttatttcactatttttttaaaaagtggaactatgtttgtgacatgcatccattgagaacatttaaaatgttgaagatatgtgatgtttataaaacttgttatccagaaaagtggtttgtgaagtacctcattccttggtcatgctagataaataatttattttttcaagagaaatcaaaatatgctggctaaatgagtacttggatatctgtagaaattcattgtattttcttaaattttcatgtaataccaatagtagtgtgatttacatcacttaaatatattgctgattagaagaatgtctaattttcaggtcaacacacaatacatttataattaatatcacagtggactctttgaatttgggaaagcagtacaaaaaggagtcagactttgagatatttaacttagagttgtttatgcaatatctgaatttaggatagcagtacaaaaaggagtcagactttgagatatttaacttagagttgtttatacaatatctcagatcgtttctatgttaactttgtggagagacagaaccaatattttaccacaagtaccagtggttccaggattcagatgtcattgctatggtgagcagtaggtttaccactcatcaattggaccccaaaattatagtagtggactctcacaaaggaccttattcttccgagctccattttcagactaactgagagcagataaaatagattttaacaagtcctaaatgaaattatttacaatgacacacttattgaatgcttactttgggcaaagtattggtgattcatcaattgataccttcttggcatactgtgcgtggtataaaaaagttttccattctgagaccctatatatagcctagtagcaagagatagaaaaatgaccagattcataaagagataagtgagcatggtaacacaagttattaacaacacaatgtgtaagttaaggctttgacaaggagcagcatttgagcagagtttcaaagtctgaaagaaaataattgacaggggaagaaagtactccaggctgtgggaatggcattttggaaagacacacagtcatgggatgactgatgcttccagggattatagaaagaactgagtgagacaggaattgaaaagtatgtgggcaaaaatcgcaggtgagaaggccggaaaggtaggtgggggcaagactgtgattgagtttgttcatcaaacttaactaaattatacttgctgctgaagcattaaagatgtgtttattagaatatttgtctttgactctaaaactgaacaaagtggcatgaatactgtgaaatatgggtaaattacttgactcttctcctaagtgagtcttttttcctcttgctgtcactattccaactcagggtgataggtaaggggctatcattcaatagaaggccagcccagcactcacccctggcctttcagctgatactactgatttttctagaataatatttagccttaaggagatcaaggagaagccagtgggtaaggatcactcatatcctgctggttgatgccaagttaggcagaaagaagaataactgtaacagtgagctcaaagcagggaaccctaaaaaacctttgtatgccttcctcattcacaaaaatttatacttttaaaaacttaaaataggcaactggtacagcagggtattcatgtataataacattcaaaatgtgggaagaagaggaaatttatatggctactgaacctgtaggttaaggcaatgtcttggttttcagcaatatttaaatgtatttgtactcttatctaatcatagccataagaaaaagtagtggtccccaacctttctggcaccagggaccagttttgtggaagacaatttttccacggaccagggttgggttgtgggggatggtttggggatgattgaagtgcattacatttattgtgcactttatttctgttattattaggttgtaatatataatgaaataattatgcaactcaccataatgtagaatcactgggaaccctgagtttgtttttctgcaactagacggtcccatctgggggtgatggtagacagtgacagatcctcacgcagtagattctcatcaggaacacacaacctagatccctcgcatgcgcagttcacaatagggtatgtgctcctatgagaatctaatgccaccgctgatctgacaggaggcagagctcaggctgcaagtcgatggggagcagctgtaaacacagatgatgttttactcgctcacctgctgctcacctcctgctgtgccgcccagttcctaacaggccacagaccagtactggtccatggccctggggttgaggacccctgatctataggagagtttcttccttctttcgctctcattccatatttcttcacacataccgtaattccaattgcaattatttgtttgtaggttctgtccctcattagacaacagataatctgttccgatcatctttataacaaccccagtgcctaacacagtacctcccacagagcaaacattcaacaaataattgttgaatagataaaatatgcatgaattatcaaagaccagaatcgaacgagtttatctcacacatattctcttggtattactgataatgtccctagtcaaatggaatattaaatatgtaattacatttaataaacatttaataagagatcatgtgggataagagcagaatggatggatttttttccttaaagagagattttaattaatatttgaaattcagaactatggtgttttagttatatagtgtatactttgtctacttatgttggtaactgaaactagatagaattctttattatttaatgatttgtttctgtggctatttcttggaaccttttaggtgttatacatatgtataaattcacaatgtttttgcacatctgagttttgactgttcttcaaaaacaactttagtcatttgacattttctcctcttttaaagatcatttttcattttttctttaacatcgtgctagactttcatttaaatgaaattactgggatgatgaggaacaattgaataaataatgaaaagttatccaggtacatacttaagtttaattcagaaagagaaaatgattatgtcttgtaattgtgtatatttgtttcacagtgcctgatattttggaacaggcttttttctttatactctatttataaagtgactattgatatttatgatttgtttaatcacttctacttacatgataccatcaatttggcttcggtcaagagggaactgcttgtgttctgggccaggtgctaggcttagtgttctgattttcataacacaatggtctaacttggcctttcatgtaagtataacacaatacagttgcagctgcttcatttgtgtttgctttgagcttggctctgaaagaattcaggcaccaaaaattatgccaagacatccagaaagcataattgaactaaggcagtagctgaatattcctatgtaactctccctgtgctcttgtcactgtgacacctaagcattcccaatcaaataaatacactagaaagaaaacattgtcaaaaaaacaaatctttacatagtttttagaagaatctaaagccctgggaaataagatataggctaagttaaagtcctgtgtaaaaagaaatgtgtcttaagtatcgagattatcagactcagttgctattggtttctgttttgaatcctctataagatcctatgtaagtgtttttccaagttaaacaaagagatagaaagcttcacgtccactatttaataaagactagtaagtgtccattgtccaaactaggggttttcaactctggccatacatgaaaatcacctaaggaacttcaaaaaatatactgatgcttagactccacctcagaccagttaaatcaaaatctctagactagagcccagtcttctgtatttttttaaaggtcccagatgattctaatatgcagctagggttgtaagccatttgtctaaatgattgataaaatattaggaactcattttagtcagtgtgttacctgtgaatatgagtgctttctttcctaccttcaagtctgacataagaaactaagaagcagtattttctcagtggcctttgttactcacatactaattgctgagttgcctgttagttgcccttctgtgtttgccacaatcagttcagatgaccaatgtaaatttacaaaatacttgctttacctttgaccagcctaagaatctcagatttcagggtgaaatattgaaattcaattcatagcatccaagctacaatacagttccaactttcatattctcagcattactgtattccaagaggatacttaaaacttatttcccatgatgcttaaagactctctatccgtgtttcttccctcttttcactaaccatctgcatggagttaaaatccataataggatcgccctccagtgagacctcttttaatgaacagtatatatatatatatatatatatttatttattcatatgtgtatgaatgtatagatatgagtatattcatatgtctatgaaaatgttattaccaaaggtagaaatcatatagcaatcatgggtatgtcagaaaactatagcctgtagatattaactatatctttaagtcattttgtaatcagaaagggcataattttaaaatcttctaatgataaatatcttagaaaatatataatttagaaccaaaggtctcagagcagagaaaaaaaaagaataaggttagatacaactccttaagggaacagggtgagaactggcaaatacctggaggaaaagggagcaggcttggttaggaaatactaccaagactctaaacttgaaagaattaaagaatgagggaagccctcctcaatctgtggtaattcctagaaatgggcttgcagcagcactaactactggagattccaacttaccctaaccaggagaagagggctgtttgagagagaggatgagatacactcacagctcattcttatagatgatgtaccataaacccttttcctctcaaagcaaagatatttctcctcagttttaatgggcaaggggaaacacaagacctctcatttcacaatgagagataaacactttgaaggcctaatgcccacttaagggagcatgtaattagctactaagtataacctcttttacagaagttctgaagccagagatgtagaaaagaaaatttgccaccttcatgattaagctagagttagctatgcaaaaaaatatatatatatattttggtcttctcagctgtacttatactcagcaaggtatgagaattgctggtaaacaataatacccttggtgtgcctttctaccataaggccctttaatttcataaccaatgccagtagcattccactggatttttaaaatgctttgtttcttttatattaaacatctactaatttcaatttaaagaaacttcattccaacagtattatttgattataatatcaatacaaaattttttgtcagattgttgagtggctggtaaaaaaaaaaaaaaggctctagaagaatttgaatagatgtttctccaaagaaaatatacaaatggccaatacacacatgaaaagatgctcaatatcattattcattaagaaaaaaatcaaaaccacaatgaaataccacttgatgcccactaggatgaccacaatcaaaaagagagacaataataagtattggtgagaatgtggagaaattggaatgtaaaatggtgtggccacttttgacagctcctcaaaacattaaatgtagagtttctatatgacctagcaattctacttttaggaatatacacaagaaaattgaaaatatatgtccacataaaatgtacacagatgtttatagcagcattatttatgacagccacaaagtagtcataacccaaatgtctatcaactgaagaatagatatgcaaactatgatttatccatacaatggcttattatttagccatgaaaaaggaatgagatactgacacatgccacaacatgaatgaactttgaaaatattatgctaagtgaaagaagccgtaccaaaggccacatgttgtatgattccatttatatgagatgttcagaataggcaaatctatacagaccaaaaaagagattagtgtttctcatgagttgggtgagggagaaatgggaagtgactgctaatgggcatggggtttctttttacataatgaaaatgttcaggaattagactgtggtgatggttgcacagctttggggatatataaaaatcactgagttgcatcttttattttttacttacttttttttttttagatagggtctcgctgtgtcacccatgctggactgcaatggcacaatcgtggctcactgcagcctcaacaacccaggctcaaacgaacctcccacctcagctgtgaagctggaaccacaagcgcatggcactgtacctggctaattttttttttttttttaacttttggagagatgggatcttgcttatgttgcccaggcttgtctcaaactcctgggctcaagcagtcatcctgctttggtcttctaaagtgctgggattacaggcatgagtcaccatgcccagcagagttgcacactttaaaagggtgaatttatggtatatgaattgtatctcagtaaaactttttaaaaagtaaaacaccaggcttaggagacttaggataaaaaatttgaaaatattaatactttaatattgattataaattgaaataatgttttagatatattttagatatgtaatatattacatattggctgcttattttctacagttttttttagttaatcgtttctgatactttgcatatttgcatttttatacaaactaccataatttggcctactataagggagatagtactaactacttttactcaaggatgtagaaatagaagcataatatttagtttaaagagaaaaaagctaatttacagtagtgtcctatatgtggaatattttttaatttttgcaaattatcaacaaatttttatatcttgttcatgtttgcatagcatatgttatagtttcttctataaattcatacctgttaaattgtttgaccttttgtatttttaatacagtccacctctgcctctccattcttgtaagatgtcctatatgtgggtttgtttagtgggataatgctgagatttcatattagaggagtgtttttattatatttgtatatcaatgcaattaatatcaacaaatcaggaaatagaaaaggatgctgttttggcaaacattctttcattcagtcctctgtattgtactatggcttggttctgatgtctcatagtaatttaaactcagcttcccccaaactgtattcactttatgtttttcttaaaaaattttcccttgaatttctctttgtagtgctgcacatttcttcagttcccagggccaaaaccctaagagtcataatatactcttccccttctctcaaattctgtcaccagatcttgtctacctctcttcaaattcattcatccccttttccagccccactgccatttactgacttcgcttatcagtacttgtggttccttccctgaactagtaccagggtcagcttcatgagcatgagaccagtgcagtacacagggcctacacttacaaaggctcaatgcatgaagttcaatgctgtattgttgccatctcaaagttcttagtgattgatctttggatttgtattttctaagtgaagtttaatgggacaatggagaattcgtggggaccttgggcatggtaccacctcctgctgcctccctggaatgaattatctgttgcccacttccccactccctgatctcattcagcctccctctctcttcacccagccacagctgtcactctctgaccctggcaggggcctttgcacaagtgtgagaaagatagggattagacagcacaacccatggtgtcttggagcagggcttggtaagggtagtccttgcccctgcctgtcatctccagggatgtcttacaggtagatagaaaccacaactgtgtttgggtgggcgggggaggggcaggggagtgaagggacaagcctcttgcctatctccaagccaggtacctagtgagttgtaggggcagccacaggaagggaagaagcatcagcctcccagcatggcatgacacgcaggtttggtggctggcatggtggaacctggtagccagtggacgcccactgctgagtcatagtctggggcccctggcacctctgaaggtttatacttacctgtaatttttcctggtactggaggaagtgtgacattaaatagtaaataaaaggcagcatggcaagtggagacaaaaactactgaagaaagggaaaagtttcctaatttataatagtacgtttaatgacattgtcttcctgctttttgaacagtactactcccagcttttcattttgcactgagcccctctaattatgctgcaggtcctgtctagtgcagtagagattcttaactcactcccggcctccaattcctcctcatcaactttagccttcgctctgctgccagagtggtctctaaaatctaaactccatcattacttgggcctcccttgcttaatgtcttttagctctctacgattccatgcccatgaacaagactagtttcatacattttatttggcctgctcagtggtttcttcctcctctctcttcctttcccctcttctttcccttcatttgaatgtcttcagacagaactaccttttacttcaaaaactgtcagtcgcccgctgaaggcttttgagttgaacttgtgttacaggatgataaaaccaaagttaaattggcactgagagctttcattgtctaattttgtactgcctttccagactcatttcctaatgctcagtatcctcattttcacccccaactctcttcagtcctgagttccatctttaacaaatctgagagttccccaaacaagttttctcaggtctccttacacatttctgcccaggaagtctaccttccatccttgctaaaagtattctcatccattaagactcaattccagtgtttcgttacctcttctaggcagcattaaccttggccgtctctgtccttccacgggagtgtacattatccattatagcaccgacactattatattgtagggttgccttccctagtctgtgatattctagttggtgatctccagaataggttgtgtatacttcagaggatacacagacaattcatttggggtgcagaaagaaaatattaaatgtttgatattttaaaaaaatttttgctctttaaaagttttatgttattgaatattttacagtcatatatcagaaaatcatattttataagtatattttattaggaaggcacactcaacaatattttattcatttcatagtcaaaattaattaattaattaattattttgagacggtgtctcagtcactcaggttggaatgcagtggtgtaatctcagctcactgcaacctctgcctcccatgttcaagtgattctcctgcctcagcttcccgagtaggtgggattacaagcacatgccaccacgcctggctaatttttctatttttagtagagacggagttttgccatgttggccaggctggtcttgaactcctgccctcaggtgatccacctaccttggcctcccaaggtgctggaattacaggcgtgagccaccccacccagccaatagtcaaaataatttagaaaccactcttctagaagacaagaactatatcttattcatctcataacttcagcactgaccttttatttttcctaatctgtttatgaaaactgatttaatatatgggtgatattcttgattacccaaagtatgcacgttgcaaagacattgacctcttatgccatagtttcttcatcattagttggtagtttttaattaatcaacattgtgtactggtttttataaagggtctacaataaatctattaagtgaaatagaattaagaagggtggaatttagtgagtaggaagaatttctgtggaagtcctgtgagaataatgatagagaaactcatggggagtatcttagtttgcttctcatttaaggtataattgaatgtgtaagaatgtgttctgcctgtcaactctttaaaagttccatggggctgggcctggtggtacatgccagtagttccaagctatttgggagcctgaggcaagaggttcacttgagcccaggagtttcaggccgtagtgcggatgattgttctgtgaatagccactgaactccagcttgggcaacgtagtgagaccccatctctaaaaaatactaatactaataataaataaattaaaggtaaatggggagaaaagacaatacagtcaacagaagtgaaggtgaaaacctgatgatctgtcctagctacctgggcttatatgttatgcagtcagtgagactgttactcggaaactttttcattaaaataaggtggttacagtttaaaaaggccctgagcttttctgatcataagatttagggcccgcgtcaccctgtctttttaactctgtgagagtaccagaacaaagatttcatattattaactttgaaggatttgtacctagaataggcaaaggaatgataagagaactgtattttttaccgttcttcaactagcatctcacttgtatgatcaagagcaaattgtttgacttcctctaacacctatgatttcttttctgtagtaatgaaatattacacaaatattttaagatctttggaagtttgcagataaaaagatactataggctgggtgtgttggctcacgcctgtaatcccagcactttgggaggccaaggtgggcagatcacttgaggtcagaagttcgagaccagcctagccaacatgttgaaagcccgtctctactaaaaatacaaaaaattagccaggtgtggtggcaggcacctgtagtcccagctactcgggaggatcacttgaacctgggaggtggaggttgcagtgagctgagataacgccactgcactccagcctgggcgacagagcgagacttcatctaaaaaaaaaaaaggaccaacatatatattatatatagtaaggaccaatttgttaatattttggtgccaaatttacaatggaaaaactgtttgcagtattacaaacagtatagttaggaaatagcctctagaagtaataaaataagtctaatacaatcttttcagtaatgtatttccccacttctttcccccttcattttatccttaggaaaaaacaaatccatcctgatagacgttagtaaagagtaattacattgtttcacattataccttttgctcatgaccatccataatgtggatttttggtacattttgtttcaacagaggcagtaagaattttatctttttcaataactaataggctcaaaagcccccctccatctctgatgctgttattcttagagtcctagaaatgagagatggaaaacttcaattaaattcatctagtccgtctcccctgacaatgaaaaaaaatagtatttcacattatattatctaatgctttttcaggccttccatgataacctctgagagactgtccaataggctaatagacctcactttgaggtcttcattttgacccatcatttctcattattatattccttaaagccatcatcctcaatattcatactttgtgaacttgaatgagattagcacagtctctgttagtcataagaaaatcaacatactatatagagtatgtatgacattcaatttacaataaaatttaaaaaaaatcagtatacgcctcattaacaggaactgaagtgttctacagaagtgaattttccagatactaaacttttcttccttaaccaccagatttagtttggttttaataattttgagggggttttccctcctatgtgttatttccgtactttcttgagtgaattcaacttttcttaataattcacattaatcattatcagcattctgcaaatacgtattaagtagcccactgtatgctaagcattacagaaatatgaagatgagctcaatgtgtttgttttctgtttgccttcaggagttaagattcatagggaatataaaataggaacagaattaattataggtcaaggtaggggaaaacagtagtataaataaaaagtttagataatcagaagtgggagagactaagtcctattagagtaatcaggaatggtttcctcaagaattggtacttgaaataaatgatataaggacaactgagtaaccatgtggaaaaagataatattagatgtgtatctcataccttacacaagagtaaactccaaatggattagggatctaaaatgtgaaaaaaaagcatacctagtcggaaacatggatgaattctctaaccttaatgcagggaaaaactttctatgatggttactgaaaagccagaggcaattttttaaaaatagattgataaatttgattgtacaaaagaaagttttttaataattgcgtgacaaaaaaataaaaaaattaaagttaaaagacaaccaatgaatcaattgagagaaaatatttacaacatgtaggaaactattaaggtcgggcacggtggctcacgcctctaaccccatcattttgggaggctgaagcaggcagatcaccaggtcaggagttcgagaccagcctgtccaacatgccgaaaccccatctctactaaaaatacaaaaaattagccgggcatggtggtgggcgcctgtaatcccagctactcgggaggctgaggcaggagaattgcttgaacccgggaggcagaggttgcagtgagccgagatcacgccattgcactccagctgaggctacagtgcgagaccccgtctcaaaaaaaaaaaaaaaaaaattaagggacaagtgactaagacccaataggaaaactgaagaaaagaaagacgtgaagaggtaataggtaaaaatgtttctgaacatatgaaaacaatgttcaaattcacttataatcagagaaatgcaattttttgtttatgtgtttgttttttgagacagagtctcgctctgtcgccaggctagagcgtagtggtgccatctctgctcactgcaacttctgcctcctggattcaagccattctcctgcctcagcctctggagtagctgggactacaagcccgtaccaccacgcccagataatttttgtatttttagtagagacagggtttcaccatgttggccaggctggtctcaatctcttgacctcgtgatccgcccacctcggcctcccaaagtactgggattacaggcgtgagcaaccgcacctggccccccaattttttttttttttttttgagtctcgctctgtcgcccaggctggagtacagtggcgcaacctcagctcactgtaacctccacctcccgggttcaaaggatcttcccacctcagcctcctgagtagccgggtctgcaggtacatgccaccacacccagctaatttctgtattgtttgtagagacgaggtctcaccatgttggccaggctggtttcatactcctaggatcaatcaatcctcctgcctcggcctctcgaagcgctgggattacagggatgagccacagcacctagccgagaaatgcacattttaaaacaacatagaaatattatttcacctttcagtctgacagactataaaggatgacaacgaattcagttggcaaggttgtgggaaacagacactctcatacattgttgaagggaaggcaaactggtacaacccttctacaggggatttggcaagattacatatacacttaccttttgacccagcatcccatttctaggaatccaacctgaagatacatttccaccattatgaaaacacatatgcacaaagttatttatgcagcattgttttttaattgcaaaatattgtaaacagcctatatgcacattcataagagggtgactaaactatatgtagagagtagaatagtggttcctcccccatctcccaagatgtccacatcctaatacatggaaattgtgaatatgctatcttatgtggcaaaagggacttttgtagataggattaaggctaaggaccttgagataggaagattatcctaaattatccagatggatccagtcagatcacgagactttaaaagctgaaaagctttcatagagatgcaacattgctggctttgaagatggaggaaaggccatgagccaaggaatgtgggtggcctttagaagcttgaaaaggcataagacagattctcccctagagccttcagaaaggaatgcagacctgctgacactttgattttagccagatgagacctgtgttggacttctgatcgatagaactgtaagataataaatttgtactgtttaaaccacatttgttttaatttgttataatggcagttgaaaactaatacagtggaaaactggtgaatttagaattagggctgtgtttaggtgagtatagtacctatgttaatttcttagttttcataatcatactatggttatataagataataacattaggggaagctgggcaaaggaaaactctgtactatttttccaaattttttgtacatctaaaattacttcatatctagaggaaaaataactaaggattccttccctcctcagtgtcctttccccactctacctcattaacatccccttaaaaagttgccatgtcgtcttgttatttgtgaatttccaaccaagcttttaactcagtggtttccaaaccatatgtccacataaagacttgttcataaatgtttatggcaactttattcttaatatcccaaaactggaaataactcgaacgtccatgagttgacaaatggttaaacaattgttggtgtacccatacagtggaataaaaaggagcaaactgtacatgcaacagcatgcataaatttcaaaaacattatgctaagtgaagaaagactacatactgcataaatccatttatgtgacattgtggaaaagataaaactataggaacaagtcatattagtggtttccaggggctgagggtgagaggaagggattgactgactacagaaaggcatgaagacatttttggggtgatagaaatgttccatatctcacttgtattggtacagcatacatttatcaaaacttgtcaagctgtacattgaaaaatattgacttgttttttgtaaattacacctcaaacctgttttaaaagaaatgttttaaaacaaaatacataaaaagttggacataaaaggtttgaaataatataacaagaaggtaataaaaatctgacatgacagattcatgaaaatgaatctctaagaatgtaattagttaataaagtatgctagatatcttccattggtccctctagcagatcttaacatgtcaatatgtgttttaacatgttataatgtaatacctgtaatataatatgtattttatattttaatataataattatacataatgtagcataatgacattaatgtgtcaacatcaattagatctgattaatggatatgtgtttattaatttctgtgctttgtatgtttaaaagtttcataatgaaagttttagtttgcttaataaaaaaatcacattgaattgaatgcttgttaaaaatgtagatcactgtgccccaatcccaaagattccgatatatcagatctgtgctagaagaacaattgtgatttatgacagaaccttttctctttccttttgatgcttaaatttgaaaaacaaaaacaaaaaacctactagaggataaactacccatactacaactaaactataatgcactttgcaactatttcttgttttgttattcttgtcatctacagtctcccttcctgtttggacttccaaataactggaagataaacttaagtaaaatataaagactagaaagtaaacttgaacgttttcagttagtcttctcctttttccttgttaattttttagaattacgttttagtcaacatttagtgaatatctacaagttcctaagttatattgagagcaaggaagggaattatttatagatgacacagctttttttctcaggtatttacaatccatgataaaacaaatatgtaaaatacatagagattttaatttactaataaactaaaacttgaaaagcaagaatgaaaacaattctcacctgggtcctttctagttgacagggtggcattttcttactgtgaatcaggtaacattttgagaaattgccatttaaaaatagttaatcacttagaattgctgtaacattgtccttaatcccttgtgtggtcactgatgtgaaaaagtctcaagcagaattaaagcagggttttgttgcacatccctacatttttcatgtgaaaggtgatgacatgtttccctgtctccgcttctccctgtcttaagggaacgcagcagtgctaggatgctggcaaggcattgtcccttattacccccacggaggcttctgagagcagttgcatagcagcagttttatttcagttaccactcattcacagctagccgagttcagtcttcagggaatactccaatttgcaggtggccaacaactttagttatcattgtcttaacatttaccaagctccagagaaaggcaatagttggctttttctttcattgactgttgctaattttaagccttattttgaaagaaaataatgaataccaactaattaaattattttagttgtatcaattgctatgacaatgtaccttttttaaaaaaataatgagctttttactatttttaagacttgtaaatggtagcaacagcatttgaaaaaattggatagagtaggatttgttttgagtgtttgattagtatgctttcagattaggttggtgtcagaaggatgaaatcagtttatttacattctttctttcctttgtttccatttagactggaacatcattcacactcttcacatttttataaggcatggatatcataactgtgaaagagaaaaaagcattttcctcttggtatccatctatttttaaattttatatttggatttttttattttatactcagtgaccacagaatcagttacatataaaagccatttcaataaggttttgattttactttagtttaattatatagctaggaatcctaggggcaaattcttgtaagtcaaatgccacaatagtagtttttttgttttttaggttttttgttgttgttgtttggttggtttttttttgttttttgttttttgttttgcttctcttttttttcctcatattttgaattgtcatattacatttctggctgtttatgatacataattctataataaggtatgtgtagaagttacatataatacatatggggaaaataagttatgttatagtacttaaagtatttgatgtggaattagaatgtcaagaattcatatagcacagtggttaaaaaggaagggttccggtgtgaggctacctaggctcaaagttctcctctgccatttagcatctatgtgaccttgggaaagtcatatatcttctgtattagtctgttttcacactactgtaaagaactacctgagactgggtaatttatgaagagagaggtttgactcacagttccacagccttaacaggaagcatgactaggaggcctcaggaaatttacagttatagcggaaggagaagaaggaccttcttcacatggaggcaagagagagcaagcggggaactgccatacttttaggccatgggaggtggttggagaagattgcatcatgggagaggatttcccctatgctgttctcatgatagtgagtgagtgagttctcagatgatctgaggacacactgcatatgatttttcagttctgaaagcaatttttgagcccctactaaataccagatatcagacctgccctgggaacacaaagcttgcagggtttagtgaggatgacacataagtgggcatacactgtgctagatgtaaggctagctctctataaagcacagtggaggggcacgtaatctagggcagggtcaggtcatgtcaaaaaagacaccctagaagagatcattcctaagcggtatcaaaaaggatgattcagccagggagaaggaagagaatatgagcagtggtaaacatgcatggtgaatatagagaattacaggtatttcaagttagtggaggataaagtatgaagtggaatgaccagggatcagctggaatggtaagtcgttaccagatgatactatatcttataggcagaactcttaccagggccatgcctagctgcttttaggtacctttgggttaattatccatcccttgaccagtcatatggatccagggcagaaagattgcatggcacaaagcatagtgacctgaatatgtaagcagttgctcagaagcaggcaatgggcaactgggcatgacatgtactttgttgtttctcagaagaggataatgtgggaagactcagtacatggttggtccaggatggagggatagtagaagccaagccaagcttgaaaacagtgaatttgttgtggtttcatccggtacagctatgtggtcttcctaaagagcttcgtcatggcaccaggaagattgacttaaatattgttttaattgttattttggatagctaatcattaagaaaatggagggtgttggtaattgaatagcatcagatgattagctgtggaatctagggagaaggaaaagagagcaggaaaaaacaagggacagggagaaaatgaggtggtccagaaagtgaaggtttctgttaggttgaagagtagattaatgtggagaaagagatatatgaaagacatgtgattagggaggaaatcagagaaaaaaatattactgtttaagatgtctgagatggaggatctctgaatgatgataagatctagtgtgtagatataagagtgggtggctgaaatgttgaagaatgaagctgggtcctcatctctcaccttatacaaaaatcaactcaagatggatcaaagacttacatctaagacctgaaaccataagaattctagaagataacatcggaaaaactcttctagacattgacttaggcaaagacttcgtgatcaagaacccaaaagcaaatgcaacaaaagtaaagataaatagatggaacctaataaaactaaaaagcttctgcacagcaaaagagatcagaatcaataaacagacaacccacagggtgggagaaaaatgttcacaaactgcatctgccaaaggactaatatccagaatctaccaggaactcaaacaaatcaagaaaaaaaaaacagataatcccgtcaaaaagtgagcaaaggaaatgaatacacagttctcaaaagaagatatacaaatggccaagaaacgtcaaaaaaatgctcagcatcactaattatcagggaaatgcaaatcaaaaccacaatgagataaccaccttactcctgcaagaatggccataattaaaaataaaaaaataacagatggtgacatggatgtggtgaaaagggaacacttttacactgctgatgagaatgtaaactagtacaaccactatggaaaacagtatagagattccttaaagaactaaaagtagaactgccatttgatccagcaatcccactactggatatctacccagaggaaaagaagtcatatgaaaaagacacttgcacacgtatatagtagcacaattcgcaattgcaaaagtgtggaaccagtctaaatgcctatcaactaatgagtgattgagagaaaatgtggtgnnnnnnnnnnnnnnnnnnnnacacaccccatggaatactactcagtcacaaacaaaaaggaacgaaataatggcattcgcagaaacctggatggagttggagaccattattcttagtaaaataactcaggaatggaaaaccaaatattgtatgttctcacttataagtgggagctaagctgtgaggacacaaaggcataagaatgatataatggactctggggacttgggaggaagggtgggagatgggtgagggataaaagactacacattgggtacagtctacactgctcaggtgatgggtgccccaaaatctcacaaatcaccactaaagaacttttccatgcaatcagacatgacctattcccctaaaactattgaataaaaataaaaatttgatttaaaaaaatgagtggatggagagacgacatgcagaaatggcacacttcaggtggctgaaggagagaaatgtatttggtgtctgccatatctttgcaaccttcagtgacacttttgtccatgtcactgatctttctggcaaagaaaccatctgccgtgtgactggtgggatgaaggtgaaggcagaccgagatgaatcctcgccatgtgctgcttttttggctgcccaggatgtggcccagaggtgcaaggagccaggtatcactgccctacacgtcaaactctgggccacaggaggaaataggaccaagacccctggacctggggccagtcggccttcagagcccttgcccgcttgagtatgaagatcaggcagattgaggacatcaccccccatcccctcttgacggcacccacaggaagtggggtcgctgtggtcaccgtctgtgaacaagactcctcaaaatactttctgaaaataaattgccatcatgtgaaaaaaaaaaaaagagtaggtggctgaaggggaggatactgagtaatggagtcaaggaattatgaagctagggtactagacatcactatttggttattttctagcatggtgttaagagtcagaaaaatattacaagctaggggctaaagttcttaatgaataaaggaaagtgaaagagagattgaaacatgagagcagcaaagagagatgaagaatgctaaatcaagatggtatgtaccttaaaaaatatgcatttactccaaaccatgattttatggactattgatttggaaacagtcatggtaagctaggtaaagtccagctacctcttcctgggtaccactgaatattgggtaatggagaatgaaaaaacttcaactaaatagagctgtgagagaaaccatttctcaggttaaaactatgcttcatttacatcaaggaggtgaccacaaaattttgaaaggtttcactacctccctgaagtattactgcccactctgtgcaatcttaaccttttccttatctgtgttcctaaatcagccatgatttcatgtatgtatttatcaaggacttactaaagtttaaacattgtggttgatgttaaggtaaatataacattatgccatcccctcgaaagtttaaatgcaagacttcttgttttcagataggaaaacctcaactgtaatttatgaaatgctggaggcttagtgtggccaagtttgagagataaaaactgtaggggtattcattaatggggaggccacaatttttaaaaattttacctcctagagtcctaccaggttctcacagtgaatatctgagaaaattcccctcatttttccagcagggagaagggaaaggaggcattttgaaatgcatcagagctttctttctctttctttttctttctttctttctttctttttctttctttctctttctttctttcttttctctttctttccttccttccttccttccgtctgtccatccgtctgtctgtcttttcttcagagtcttgctctgtctcccaggctggagggcagtggcacgatctccggctaatttttgtatgttttgtagagatggggttttgccatgttggccaggctggtctcaaactcctgacctcaggtgatccgcctgcctcagcctcccaaagtgctgggattacaggcatgagccaccacacctggcccgttctgtttttcttaacaaggtctgctctcagaagaaactaatcagagcctaactgatcagaaggaagggaaatacccaattccagcactctctagccatccccttccacctaagtggggtgggtggggtgaggggcactgagcagcacttatgaagttcacagtccagaaacacagactcattaaaagactgagatctaataggacttcagaatgttttcccccaccttactactacatgactaaaggctggtttactgcagttcctctcacctggtacctagttttagcatatcctctcacctagtatttagcatatccagctagcaagaaaataattacagaacatactaaaaggcagaaaacacagtttaaagagacagggcaagcatcagaaccatcctcagagcaagcatcagaaccagcctcagaaaatattgaaattatcagatcggaaacttaaaacaattatgataaatgtactaagggctctaatggataaagcagatagcatgcaagaacagatggacaatgtaagaagagagatagaaattataaaaaagaaccaaaagggaatgctggaaatcaaaaacactgtagcagaaatgaagaatgccttttatgggcatattagtagacaggacacaattgaggaaagaatttctgagcttgaggacacctcagtagaaagtggcaagactgaaaagcaaagaaaaaaaagactgcagaaaaaacaaaaacagaacagacccagaggaaccttaggtacatattactaagtgaaacaagccagtctaaaaaggctgcagtatgattccaaccacagatgctccttgacttacaatagggttatgtccaaataaacccatcataagtcaaaaatatcctaaattgaaaagtatttaacgtcctgataaacctatcataaatcaaaaaattgttcaaaccatcttaaatgggggactatcaatgtatgacattctagaaaaggtaaaactatggaatcagtgaaaagatcactgtttgccaggggttggagtgtgggaggtactgagggatgaataggcagagcacagaggattttgagtagtaaatatactctgcataatactataattgtggatacatatcaccatgcatttgtccaaacccatagaatgcacaacaccaataacaaaccctaaagtaaactatggaatatgggtgatgatgatgtcaatgtagattcgtcagttgtgacaaatattccagtttggtagggcatgttggtgggagtggctatgcatgtgtagagggaaggggaggaacattggaaatctttatatcttctactcagttttgctgtgaatctagaactaagttaagaagtattgtctctgcttctatcttctatcttctgaaagacattgtagagaattggtatcatttcttcctttaatgtttcatggaattcaccagaggaacccatctgggcctggtgcttctgttttgtaaggttattaattattgactcaatttctttaatagatatagccctattcatattgtctatttcttcctgtataagtttggcagatcgtgtctttcaaggaattgatctgtttcacctagattatcaaatccctttttaccattttaaggtccatagaacctgttgtgatgacccctcttttatttctaatataagtcatttgggtcatctctatttttttcttagtctggctacagacttacaaattttattgatcttcataaggaaccagcttttgattttattgcttttatctattgatttattgttttcaatttaatcgattctgcactaatttttatttcttgtgtttgctttggatttaatttgctcttttttttctagttttctaagatagacacttagtattgggtttagatctttcttcttttctagtatatgcattcaatgctataaattttcctctaagcactgtttttactgcataccacaaaatttagatgctatgttttcatttttatttcattcagttcaaagtgttttttaatttctcttgagatttcttctttgatccatgtgttgttcagaagtatgttgtttaatccccacatattttgggattttctagtcatctttctattactgatttctagtttaattccattatgatctaaaagaagacattgtatgatctctattcttttaaatttattaatatgtgttttatgcccagaatttgatctgtcttggtgaatgttccatatgagcttgaggaatctctattctgctgttgttggataaagtagtctatagatgtcaattatatccagttgattaaatggtgttttggagttcaactatgtcctcactgattttctgcctgctagatctgtccatttctgatagataggtgtgtagtcttcaactatatagatttatctgtttctcctagcaactcttaccagttttgcctcatgtctcttgacactctgttattaagcacatacacattaaggctgtattcttggaaaattgacccatttatcattatataatgccattctttatccttgttaagttttcttgctgtaatatctgctctgtctgaaattaatatagctatgcctgctttcttttgattagtgttggcatagtatattgtttccatccatttactattaatctttatgtgcctttatatttaaagtgagtttctggtagatgatatatagttgggttttgttttctgatctacactgacaatctcttttaattggggtatttagactattgacgttcgaagtgattattgacatagttgggtttctaaccatatttgttaactgttttctatttgttgcctttgttctgtgtccttatttttgtcttccactgtttataacctttcgtgattgtaattgaatgacttatatgattccattttctctcctttcttagcatatcagttatacttattttttaaaaaatttagtggtttccctagaatttgcagttttttaaatgtataactaatgtaagtccactttcacataacactatacaacttcgtagatagtatgagtaccttataataaaataatcttaattcttccaccttgtcatttgtatcattattattcatttcccttatatataagtatacataagcatatatatcatatagacataagcatatatacataagcatacataattaaatacattgttgttattacttcaatattaaatcaattaagaagaaaaataaaaggtggttttattttcacttattccttttatactctttgttttcttaagaaggtccaatttgtgacctatattgttttcttttctctctaaggaacttctttaaacattttttgcaatgctggtctactggcaacatttttcctcaattttttcatgtatgtgagaaagctttatttcaccttcacttttgaatgatagttttgcaggttatagaattctaggttggtagtttgggttctttttttttcctctcaacactttaatatttcactccattctcttgcttgtatggtttctgaggagaagccagatgtaatgcttatttttgttcctctgtacataaggtgttttttccttctggcttctttaggattttttctttttctttgtttttctgcagtttgaaaattatatgcctcagtgtagttttgggggttgggattttttttcttttagggtttttttttttggcatttatgctgcttggtattctcagtattctctgagcttcctggatctttggtttggtatattaatttggggaaattctcagtcattattgtttctgattttctatttctttctcttttctccttttggtattcccattacacgttacgcctttcgtagttgtcctgtagtctttggatattcttttctgggttatttttgtttgttctgcttgcttttcagttttggatgtttctattgatatatcctcatgcttagagattctttcctcagccatgtccagtctactaataagcctgtgcataaatttatatttagtatctaaagtctgtattaaatggcaagttccttgagggcagagtttgtgtttatctttgatttccttacaactcctagtagagttctctacaacaaataagcataagttttattaaatacaatgtatcatattatgtcatatgaggtatgatatgatatgtgccacaaggctggacgcagtggctcatgcctgtaatcccagcactttgggaggccgaggtgggcggatcacctgaggtcggaagttcaagaccagcctgaccaacatggaaaaacaccatctctaccaaaaatacaaaattagccaggtgtgtaattccaactgtaatcccagctactcgggaggttgaggcaggagaagagcttgaacctgggaggcggaggttgcggtgagccgagattgcaccattgcactccagcctgggcaacaagagtgaaactccgtctaaaaaaaaaaaaaaaaaaaaaagtgccacaaaaaggtagaattaaattactagatttaattagtagacagtctactaatactgtctcagtcaaatgcttaactgtattttcattagaaatatatgtatgatttttggtcgactcctcggcctggatctcaacctaggcctagcaatcctattacaattctataaacttaagcctggtttgctagctacatttattagcaaatgtggtgactcattctgattgagtcatagaaaatagtacataaagcctttgcctttatgtactaatgactgtgactaatgacagtgactctccctaatgacaccaaaattgtacagttgacccttgaacaacatgggggttagagacaccaccctgctatgcagttgaaaaatttcatataacttttgactcacccaaaacttaactactattagcctactgttgactggaagccttgccaataacatatacagtcaattaacacatcttttgtgtgatatatgtattatatgttgcattcttaaaattgtaaactagagaaaagaaagtgttattgagaaaatcataaggaaaagaaaatatactatttactattcattaggtggaagtgaatcataaagaccttcatcctcatcatcttcacattgagcctttttcccttgcctttagtcaatctctacatacctataataagctggagtgaaaaacagcctagggtattatgtctatgtgatatatactaggagtttttacacttaactccttggatggccaaaacaataagatatagcattataagtattttctttcagtaatctaaatagttccactttgatttgagtaagtttgttttcatttttctctaataaaaggagcaatgcctgcatgtttaaaaatcacttggcttggtaaaacactgtggcagtctatactgttgttcaccaaatattttcagttccctttctgagtacctggtagtactatatatcccttcctccattgaagttagatatggtcacgtgattgttttgtcagtgaaatgagaccagaagtgatatgaagctttaagagctagtacatgtacataatttgctattttacctttatcctgctgcaaaaactgtagaagcccagatagcctcccttagcctaagttcctgagtaaggacagcatagacaggatcccaccccctcagttgacctgcttatggacatgtaacatattttatgccacgaagattaggggggtgattagataatcataacctagcttatcctgataaatatagccttcaccccaaaacagtgggctttggtagttactaaaggaatataaaagatttgatgtgctaatattggcctagtatttctttttcttcattatagaaatgtttattgtacacagcttatataaaatgatattcatctcaagaaagagtcattctccatgtgtcaaaatatttttctttgaattagaatctttgcttgaaaaattttgttttattttatttatttgtttttgggttagggtttcattctattgccccggctggagtgctgtggtacagtcatcacttactgcagcctcgaactcctgagttcaagcaatcctcccacatcatcctcctgagtagctgggactacaggcatgtgctaccatggctggctaaattttttattttattttattttatttttgtagagatggggtctcgccattttgcccaggctggtcttaaattcctggcctcaagctatcctgtcacctcagccttttcaaaatgctgggactacaggcatgagctaccgtgtctgactgagaaattttaatatgcttctataagattcctttcacctgccaatgacagaattgtaaatttcttgaaagtagtgaccgtcattcatttttgcatttattcttttattcaacaaacttttgttaagtgctcactatttgccaggtgcagagtcgaggaggatgttcagggaactctagatagtttggtaaaactggcaggaggcaggcaggggccatagactgtaaagcactttgttccagtctggaagctttaatgatttcataaatgatctatacttcattttaaaatagtttatccacattcaatacttaattttacaatgccatatccaaggtgacatagactgagttttaacacttctgagaccaccaatacattatattttacaacttagttaactcctttttacatatcttagaacaaagctttttctcttctgtcagttatcttttaattcctccaatgcgccaagtaccttctcacctgggggcctttgcacatgccattttctttgcctgttttcccttagtttgggaaatcagtagatgtcatttgtattgaaattgctggtaccatcttcatagaaaggaatatatttgtgtatgttatattgttgtgctttttagaaatctaccagtaaaattagaagtttttcttccataactaatataaacattaataaataataaattaggtgctactagaaagtttagttatcccaattctcacagaagaaaattttctcatcacattgccaggtggtttcaagtgactattatttacaaaattaaaaagcttaaaagctagtttctatttctggtctttattgtaaaagtctaaataccttttgcagagatagtgtggacgagtaacattcccttttggttctctctcccatcaccttctgcctttccttctagggattcttcagcaagcgcctgaaaggctccatcaagaggaccaaaagccagtcaaagcttgacagaaacacgagctttcggcttccatcccttcgcagtacagatgacaggtaggaagttaactttcttaaaacaaaaaaagcagtttgagagtgaattttgttaaggcattttggtctattctgaatttgaatcaatgacaaatagaaaaatacaataaaaaattgacttttatgtcgtgttcatattaaggcaagatacaaaatattgactcaaatacccaaccagtttaagaatgttataatattggagagtttgtggatacataaaaactaatttcagagtcagttaagctatttctgtagaatcaagttacagtggtcagaggtgtatcttttgtttggtttttggtagaatgactataaagaataatgattatgatagctaaacaattttagcactgtcgcaggatgcttcatacatgttatcttgtttcatctttataataaccgtatatgataaatactattattatcaccattttatagatgaggaatctgaagtacagagaggttaaataatcttgcccagggtcatacagctagtaaatagcaaaaatggtatttgaacttgggcagtttggctccagagtccatgctttttactgctatgttctgtatgtatagcatatgaaattggccttgttggtttgcaattacatctagaagacgtgctgaaaaggaagcctgggtggatttccataattaggactactagcttgagtacagctccctaaggataatatgcttcaaaaatcattgaatgtgtgctaacacatttttgacacatcatgtctcgataatgttcaaaattttggaaacagtgcttgtggtatcagcatcagcacatcatcaccaccacctatatttattaagtacctactgtgtgccatacgtgttaaatgtagtctctcatgtaatacaacaaccctagatactattattatcctcattttatagatgaggaactgaggcataaaaagtttgagaaacttgcccagggtcacacagctaataagtagtagagctaagatttgaactcaggtctgcctctcatatttgatactcttatttatgttttactttttttttccagtaagtgactttttttcacttatctacctagaaaacagaaataaaattatagatttgccaagcagatgattactgtctttattttgtaaatgaagggacttgatgagggactactgctttattagcccttcttgaaccacattaaaggtgctctgtgaaatttgcaagtcagcccaatttgcattatatttatattattatctcttttatacctctttgttttaaggtaatcataaaaaaagatttttaaaatatttttcttagtttcctgttattctataattttcatcattccaggaattcaaagcattttattaatgtctcaaaaaatagaataacaattttttttcagattatcgattcttaagaacaaaaatgttgtgcagcaaataaaacactcccaattcaataggcaatttcttaaactctgcagcatcatatagaaacttgggagacaagattttttttttaaagtttacattattttttaaccttgcactaaatgttaccttctttatttcaaacaaagggctctctcctattccattttgttttaggttgcccatgggaattgtttgattgaattaccaagagattatattctcccagagtctcttgtatttctattatatagttactgtatttttagcctttccagtgattgaaatgtattatttgtgacttttataatgttaatgctttaatcaatagcaaagtctttctttcttaagtacagcacaataaaaaagtgctagtaaatctcaaatattaagtaacccttttaatttatcaactccatttgaattgtagagatttcctatacagaaatttttcaaaaaactttttcttgtatagaggtgtactcaatatagtttgaatgtgttaccatttttaaaaaagactctcttgccttcagatcatatgaacagtcagataaatagagctaaggtacaagatattgatcagctgagttctttgaattagtgcccttataggtgtgaccaagtattttctgaagacctgattttcttgggtcagatacatcaactgctgaagtcagccacttctttcaaaatgttatacagtgtctaaatctaagtagcaaaacatttctgttcttttatccaatctgtggaacttccagttaaatgtagtaagcagctccttttttttccatttttaaattataaagtaaaatactcatttgtctttgttttggagggggaaaagtttcagtatataagtaaagagaaaaagaactaaagaccctctttatctttcctatctccccacataaataaccttattaaccatttgtatattttcaaacctctttaaaactccatacataaagggaacccaagtatatgttttcatgttttcatataaatgggatcacatattactttgtgacttgctttttagtataaatattttgtactctccctgtgtcagtaaatgtcagtccacatcattctttttaacaactgaatctttgtatgctacagtgtttttataataatgtacctcacttctctattgatggatatttacattgtttcccttttttggtacaaaatagagatgtcatgaacatttttgaacatgtgcctttttgtactggtggctgggttggatttcagaagtagaactgcttggtatagagtatgtatgttatcaaattttccttcaaaaaaggacctttcccaccaacaaattgagattacttttatccttcagacaaccttttccattttatcaatatgttgaaagaatagaaatagtaaaatgtagtatttattatgtgacagatatatcctaggtactttatataaactaactcatttaatcattacaaccaccctaagagatagtcactgtcattactcctattttgaagatgagaaaactgagacgcagagaaattcgtaagttgcctgaggttatacagcttggaaaatgagagaactgaggttcaaacccaggaagattggctttagagtctgtatttgtaatctttactgtgtattgcctctctaaaagatgggatggggggggatttctttgttttaatttgtattttgctaatgcttagtatactgaatatcctgtcgtatgttttcttcttctgtgacttacctatttcctttgcccatttttctattgagttgtttgtcctatttcttatgatttggaatagcactttttattactacggatagtaagccactactatgcatgttaataaaatttttctcccaatctgtttcttgtgttttaaaatcatgtcttcaagttacatggaagttttcaattttcctttctctgatatgtcagtctttttgggtgggaaggggggcttatctgatcaaatttgatcagaacattgaactcaagaggtgagggacctgtttcttgttaaattcttctttatgatactctgcaaattactttatttttcccttcttcaaaagggagaaatattctatctggagcgatccagaggataatgaaatagtggacatgatattttgaaatcttcaaagtgttgtggttttttttttttggttttttttgtttgtttgtttgttttttggatacggagtctcactctgtcgcccaggctggagtgtagtggcacaatctcggctcattgcaacctccacctcctgggttcaagcaattctcctgcctcagcctcctgagtagcttggattgcagacataagccactgcctccagccagaaatcttcaaaatttttgagataaaccacaaaccttatcttcactcattacacttttatttttattttttgagacagtgtcttgttctgtcacccaggctggagtgcagtggcacgatcacggttcactgcagccttgacttctcaagcttacttaattctcctgcctcagcctcctgagtagctgggactacagccacacactaccatccctggcttatttttatactttttgtagagatgggattttgtcatgttccctaggctggtctcaaactcctgggctcaagtgatttgcccaccctggcctcccagagtctggaattacaagtgtgagccaccatgcacagccctcatatttttaaaagataaaattattctcaggaggtctgagttaccactttaagatagcagaaaaacatttttaaaatggttaattttatctaaagaaagcaagctgtgaaaaataccatagttttaccaaataatgtttctaaaatccaaatgtattgatatacagtaacacactcaatatgtgacagttatgtacaagctactatgctgtatgctacagagaatatagcatagagaaccaaagatacagccctcaacctcgaggagtccagtaaaagaggtaagtgtcaaggaggaaatggtatcggtgaagataaaattacttcttgttgagtggatcaggagagaccttagagggcaatggcctgtgagttggatcttacaggtgtaatttgaacatagaaatagacacgcacacagaactttccttggaatggaaataatgagcaaaagtagaaagtaggaaattatggagcttgaagagaattactgaatagttcatggtattaacatgaaaaggggcaaggtaggaaataagtttggaaaggtaaaattccagtttttaacttaatgggtgaaaacagttctgcttttttttgtcttaaaaattaatatgagaaacaaatatgaactccatctttaatgaaactaggaaaaatatgagagatagattacttaatctataattctcacttagatgacaaacagatgtagttacctacaaaaggaaattctaaaaagaagtctctacttaggattcagtttagttgccaattaacagatacccaaaatagaaatgactgaaacaaggtagaattattttttttttcacttctgtctgaaagtggacagtcctgttcaagtctgccattcttcaggatcttcaagaatctctttataggcataagatagctactagagctccaaccataacatatttgttttagataccagaaaagatgggcccataaaaagacacatgctttccagctgagttatctccctttaaagcaatctctctgaaaccatacctagttgactttgacttctgtctcattgccacctttttctaagggaacctgggaaactttatacctggatatattggtgggcccaataatataggactctgttcttaaggaaagagagagggatggacattggtaaaacagctagcagtctctgcataggaagttgatttacccacctactctggaaaggttcagcttccacccagctctagaaagtcagcagccagacttacccctgtcacatagcagtttgagaaattgaaccaccctggagaaacagacctacagatagctacatttatatctgtaggtttttttgcctattaaaatcccagctgataaattcattcctaggtagatccaagagaaataaaaatatatattcatataaaaacttgtatgtgaatgttcataacaacattattcataataggcaaaaagtgataacaacccaaatgcccatcagctgatcaatagatatacaaaaacatgatatacccgtacaatagaatattcatcagcaataaaaagagtactggtacatgttgcaatgtgtatgcatgttttcaaccttgaaaacactgaagtgggaggatcactttaggccaggacgtcaaggctgcagtcagccgtgatcgtgccactgcactccagcctgggaaacaggagagactctgtctcaataatagtaataataataagccagtcagtcacaaagtaccacatattggatgattccatgtataagaaatgaaaatgccaagaataggtaaatcaatttatatcatcgtgacatatctgaatgctaaggtttaaaaaaaaattaaaattttctagaaagaaaaaataggttgcatacaaaggaatgttgggggtggggggatgacattggaattctcagtagaaacaatgaaaaccagacgttagtggagcaatgtcttgaaaattctgagcggaaattattttcaacccaatattccatacccagagcagatctcgaatgtcaaactgaggagtttggattttagcctataagaaacaaggagcctttaaacatttttgatcaagaaaatgacctaatcagagttttgctatggatggattaatccagcagtggaatttcaggtaacttagtttgcagatactaagtctgagagaccagttaacaaaaagctgtaagaagatataatgagggctccaaggcggatagtagcagtggaaatggagaggcagagacaagataggaggaacgttttagaggcaaaatcaataggatgtcacaaagtcatcattgttccaaagccatctaatcagataaaagccagtaaagcgatttcctagaatcaatattggcagcattttcacattaaagccatgtcatataggagggtgttgggacacaaaaagactctgtgatgtttctgcctttcattcaaatgcacttaaaactaggaaatgactgaaaacagtggtactgtattgtcaggcattccaagattccaaatgcctgttgccagccttgctttggaagtgctacttaaatttaccaaagactaaaggtaaagatgagcatatggagtagaatattctcacccactccaaacttccctcaaataaaaaccttcacagtaatgttctcaattctaaggctcactaacaaagtatggttttaagtagtctactttttctttgtcaaaagatacctgaaagtaagtatggtgttcattggtaggtggaattatggaacaatattctcagcttcttgagtttctccttattaattagaattttttaactttttatcttgaaattatataaagaaagttgcaaaaatagtacatacagttctgtagactcttccccccagctttccccaatagtgaggtcttataactgtagtataatatcaaaaccaggtaatggacattggtatagtaatattaaataaactgcagactttattcagttttcgccaattttacatgcattcatttgtgcatgtgtgtgtgtgtagttctgtccaatttaatcatatgtatagattagtgtaactactaccatgatcaagataaagaactgtttcattaccaagaaagaactccctatgctacccctttatagtcatacccacctccccacacctatcacatcccttaaagaactactaatttgtttcctgtctctatcgctttattattttaagaatagtgtttcacagaatcatatagtatataattggttgagattggcttttttttttttttacactaaacatatgcccttgaggtccatccaaattgttacatgtatcagtagtttgtttcttcggttgctgagtagtatttcattgtatggatgtactacggtttgtttaaccattcagccattgaaagacgtttgggttgtttccagtttttgctatcattaatatgaataaagctgctgtgaacagttagatacaggtttttgtgaacgtgttttcccttctatggggtaaatgcccaagagtataattgctgggttctatggtatgtacatgtttaggtttgtaagaaactaccaaacttttccaaagaggctgtgccattttacatcctgataagcaatgtttgcagaggaattttttatgtcccaagagattttcacttatgttttcttttagaagttttatgattttagctttttttttttttttttttttgagacggagtctcgctctgtcgcccaggctggagtgcagtggcgcgatctcggctcactgcaagctccgcctcccgnnnnnnnnnnnnnnnnnnnngtttcttcggttgctgagtagtatttcattgtatggatgtactacggtttgtttaaccattcagccattgaaagacgtttgggttgtttccagtttttgctatcattaatatgaataaagctgctgtgaacagttagatacaggtttttgtgaacgtgttttcccttctatggggtaaatgcccaagagtataattgctgggttctatggtatgtacatgtttaggtttgtaagaaactaccaaacttttccaaagaggctgtgccattttacatcctgataagcaatgtttgcagaggaattttttatgtcccaagagattttcacttatgttttcttttagaagttttatgattttagcttttatatataagtctatgatccatttagagttcatctgtgatagctttaaataaaagatcttaattcagaacttattgatgttctctctatatatatattctacatatatattgaatatatatatatttttaagagacaaggtcttgctctgttgctcaggctagcgtgcagtggtgccatcatagctcactgtaaccttgaactcctgggctcaagtaatcctcctgccttagcctcctaaagtgctgggattataggcatgagctgtggcaccaggcccagtttaagatattacaaaattctaatcaaaactacacacttgccccagccaaaccagttacaggcagtctgcctgcctttggagaagaaagtatgatagactacttacttctctcctcatctgctcttcccctgtagcctactcaccatgtttttaggcaccctccaggttttggggaaggtgaagcaacaaaaagatgagaaagaggataacaaagtctatcttagccttccataatgctcactgagcctaacagaaatttgaagctgacttttctctcatggggtgatttggggactttttcagagatttatcatccctgaggagctctcacctatggtttcattgactctgacagatgcatttctcttccaagtgctcacttgcgaatcctttctagaaaggagttcttgatgctttggtttcttcatcatgcagtcttatggtccgcaggaaacctccacaaatcttttgccctaacaacctctaggactacaggcttatccaaaagcatcaatgctcttgctctgccaccaacagttagttggtcatttctcatcatctagatttcccagatggaatcaaaccctgccctctatgtatcttttacccttctcccttgtaggtagcaggaggatgagcctcacaacttctttcaaaaattgtttctcacaaaatctttcccattctccattctctgaccactttttatagtcttgacataactgagaggatcaaggtagtggaactggttctaacacatttcctttgtaaatgctgcagttgatctgatacatgactttggtatacagaatctgttttatctaggtgtctcaattgaaactgcaattttcatatctcattgcctatgtatgtaatacttctataaatctgtaatctttagctaccgcacaaaaggcaacatggcccagtctttccctctcaatattacctcctgtcactcctgccaaaagtcttctttatagtattatacttgtcatactgtttcatatttctctgcttttgatcttactgtctcctctaacccaaatgccatttccttttcctataccctgtcttttgtcaagctcacttctagttcatcctcatgcaacagtacccaagtcaggagttacatgctccctcccttctttttggtattcttcccacatatcatcctagactaagtgcctaccccaccccccaactacctgagtccaactctgcatactttattctaggactaacttttttattgaatttatcttttcatatgtctgcttactgcagcagattgaaagctcctccaggatacaatctttgtatcttcattccctagcacaatgactgtcctattgaggaactcaatacacatttgttggcctgaaacagaagaggagagtcaaaactgacttccagataataaagaattacaatcttttaaaatatggtctatgtggatatgacaacttctcagaaattactggactccaagccattaattaatcaatacagtctagctatcgattagagtttcctattccagatttacagccatgggccaattaaggatcccttagttttatgaactaaaacccaattgaagtatctaattgcatcatgataacattttaaattcattaaaatgctttatcttaatagaaaaaatatttctacacatttactccatctttgtattcttccagtgaagagtgtattcaagaatagctttcctgatctcaaccagatgaataatttacataaaatgaactaatgcatgtcatatcactgcaaaaaaagctgtgtgtctacaatcttactccttcacatttgtattgtactgcagtttatgaaatagatgtgaaattatagattactgcatttgattctcacaactgtgtgagatgtaggaagagaaatcattatccacattatctacacatatcttaaatgagataactgaggttcagaaagaataaattatttactgcatgtcacatggctaataagtggttctagctgatgtgaatatgtagggcttttggcttcagtttgagtgtttttttccattatactctttgttgtgtgtgttgatacgaatcctaacttgctgacaaaataagaaagaagggaaaaacaaaggcaaaaaagtacacacacacacacacacacacacacacacacacacacccctcttataccagcagaatactatacggtaataattgagtcaatttatgatcataatatttctgcaatttggaaaaatacaaagctgactccgtactgtactcttttcatctctcctcctctgccaaaaaatccaaatggattgaatgaaaacttaaaagcactaaaagaaaatgtagcttatttcttatgatcttggaatttaaaaaccctttgtaaacataaactggggggaaataattataaatatgacagaaaaagaactaatttacttaatatacaaagagtgtttacatatcagttaattttaacaattaggaaaatggtttaagaacatggaatagcagtttataattcacagaaaagggaactgagattgccaataaacatgtacaaatgtcctcaatctcataattaaagaaatgcacactaaagccataatgaaataccattttttaccaattaaacaggcaaaagattttgaagttcagccacatctcatgttgaagatagcaggtagaaacatgcactgctgatagacacttaaattgatgttgtctttatggagggtaattgagccatatcaaaaatttaaatgcatatgcccttggatctagcaatttcacatctgagaatttgaagtatgaatgtatgcacatgtgcatgaagatatatgtagtaagatattctgaattttgttgctaatcacaaaaaaaggaaacttagatggtcatcaaggactgtaaattattacaggctcatgtaaaggaatactatgtggtcattacaaagagacaaagtatatctgtaggttccaatatggatagaagtccaaaatattctcttaaaaacagtattgtaccatcccatttatgtaaatgaatatgtatatatagacatatatgtttgtatttaaataaattatgtatattatgttaaatacatgcaaatatattgttatataaatatatgtaatatgctatatattacatactttatataattatatacatatatgggtaccttcgtataaaatatttctgggttcacaaaaactgttaatggcctcctttctataggaggttgtgggaggtaccctttttttattctttaccttctatccttctgaactcctggaattttttaccaagagtatttatcacttactgtttcaggagaaaaattaaaagatgattaatttttttaaaaaacctgtttcaaacccatgtctccctctagctattttactgttgtcaccccttcacaatcagacttgtggaattaatcttcacttcctcatatttcattcattttctcaacccattgaaatcttatttttgtcctcttttctgaaactgctcttgccaaagtctccaattacctctaaattcaattcccaaattcagtggctactattaatccacctttcttgagatccctctttcctggccttctgtgatacttgactcacctggtttttcttctttctcaaattcttcagtgtcttttgtcagttttgtagctttaaatgttaacatgcctcaggttatgtttttaggttgtcttctcaatatgtatgttctgtttcactgttcacatctaccccgacaggaacctcaaactcaacttgtataaaacttgattttatttgtactctcacctcaaccagcattgcctcctctttcctatccctgtgaaggacatcaccatctttcacccagtgtttcaagccagaaatgagcagttgtcctggactctaccctctccccaattcctccagcattccagtcatcaaagcctatttacctcctaaatatctctcagtgccatctacttcttccccatatctgttagtctaattcattatctttactcagattactaccataatcaatgaactggtttctaggtctttcatttcttttctctccactctctgtgtactcctttctttctccactccttagccaaggtagttttactgagacacacatcttaccatgtaattccccttctaccacctaaagccttccgatgtacatctactggtattgtgatcaaattcaaatacccacacatgactacaagtctgtgatctctctcaaacgtcattattcaccaggcctcacccactccaacaccccagcctcttctccttctaacatccatactatagtagagccacactgctgaatttctttcactgtctgaacaccacagccttgcatactgtcatacaggccttttcacatgctatccattttctgtagatctccacacctgcatatagtgaaatccaccccatccccatgaagatggttacaactttgtgttactgttttctccaagaagtcttctctgaaccacccccaccttaaaatcctctacttagtgctcatagagccttttttggcatcctttttcgtaagtcttgtcacattgtattataatggattgttaactcactagattataaattgtgtgtgagtacacagaccgtgcttttcttcttcacctttgtattccttgcatctacctctagtatagtgcctgacccataatgcacaccaggtaattattggttagatagatggattcatacatatattcatttattcaaccaaacgagaaactaatgggaaagcaaatcagttatgagtttaggaattactaaaaagtcagtgttgccaagcatgttggctcacacctgtaatcctagcactttggaaggctgaggcgggcggatcacctgaggtcaggagttcaagaccagcctggccaacatggtaaaaccccgtctctactaaaaatacaaaaattaactgggagtggttggtggtacacatctgtaatcccaactacttgggaagttgaggcaccagaatcacttgaacccaggaggcggaagtttcagtgagctgagattgcaccactgcactccagcctgggcaacaagagagaaactatgtctcaaaaaaaaaaaagtcagtgttattgaacttcaccagtttttttcctctcttatccttctacccattacttttatggcaattatgagactaaaagtctagcaactgaaatcagaaataaggaaataaaagctgtagtctgtccactcttactggtatgttacttgagttggattacgagtttggtttggtttggtttagtttctgttttttaaaattcaatgtagttgtgtttatattgaatttgtttaataggtgctagtagattatattacctttgcaatttaaggacaaaaagatatgttataacatggtacagtttctgtaaaggaattgttccctagtgtctatcatattggaggcaagttggattttctactccctagaatatgtcttaatgtttataatctagtcttccttctgtatccaccttcactgtgtgtatacatgtatatgtaccaagtacaaagtaggtaaggatatttttgtctatgctgatacatttctttaccatgagtttctcattttgagtgacaactcaggctgacaaatatccttcttcatcattaccagctggtcccattagaccatcctgtcctagaggctgagagcagggagaagtaagacctatatgttatgtttccataaatagctttttaatgtgagtggtgtggtacatatttttaagctaacataaaaatcagtgagtaatataagcagtagagactactggctttaactacagcaggtaaaccagctcagctggtgctgtcaggatcctcaggctgaacaagtctttgcacataagtagagctctggcgaatgagctctaatttctttttttttttaatccagggaggaaaacctttaaaattataatacaagaaaggatgtgcactttcaaatggcaaacatcagttgaagattttcacaaaatacctaattggaaaataataaaatccagggagcaagtaaagctacatttttcccaaagtgaaagctcaaattcaatttttaaaaaactgattagacactatataaacttgctggtagagtattagggtacccaattttgttaattactacctaggacatttttaaacaaagtgagtgccttagaaatgcatactggtgaatacaacagtatgttgctgcacccagcttactggctgagctatctcatcaggaattcactgaagcagtctggaatcacaactgccaagccaagcagaaactcacctgcactggagtccaggattttatgtggcaataagcatttttaattaaaagtttcccaattcctaaatttggaacttaatctgtaaacatgtagcagattgagctagcaccaccaagcctcattggagctgtgggggaaatgtggcattctgaaaaattggccagttaagctgagaaaatccagctgtgttttacttaaaattgcactaatcagtgttattttattcctctttttcttcaccagtgtatctgctgttatgtgaatgttggctccccatctcccagcccttcacttttatcttttaagactgatttcatatagggatgaggattcaagcaatataatactcattcactttagtgagtaatagaaagcctcacctggctagtagtttatttcttaaataagtcagaagcagcaggtaattttcatcagcaaagcaattagattttaaccattacctatcacattgctagaggtcttgaagtttacacagaaatcaagattgtctgctgaccttaagataaaaatataaagaatatggtgtgccttaattagaagtaaaattgcctctgggaagcagttttttatttaaatcaatacatagtctgttggagccctgaattattcttacatggtgttcaggatgatggggcagtatgggaagtagtcagggagagaacctggccagtagtcaagggattcacaaagtccactttcaaggatgggttagattttttgatgaaggccattgtcagattggactgggaatcattattttaaactcattattctcccaataaatccacattctgctttctgttagaggagtaaactctggtgccaaacagggctactaaaactctgtagttagtagatctaagaaaaatcaattcagaaggaggtaaacatgaattagaggaaacttggggttactaatgctattacattgaaatatttgtacaaataatgcctcccctgtcccaagccagtcccaggctgtttgatcttcctgtttactataatcttgcttctctgggaattacttctgtcttcttagagatactttcttcccaatacagggagggcttgcttatttattcaataataatgttgaatatattcgtgactttggttttcaattcagtacacacacacataaaaatgccaaaagatatgacattctgaactatgtattaattaaaatttcggtaactaggaagagtttggagttataattctaagtggcttagttttaaattctcttatggctacatttgaagttagacctgagtatcaaaatgaaacttgttcagcactggaaatacagtgaaaaaatagttttcaccatctttctgtaaaagaagaaaatatatgtaagccaggtaagtttcagtaaaataatacctagaaacattaaaccacggtaggcactgtaaaggaaacagaatacatgtgagagaaagctttgtacttgcaaggtgagatataggaaatagcttctagtaggggcatgggaattgtatatgaagcaagctaaagtttctcaagttagtccctagtagaggttttactttttattttttatttattttgtatttttggtagagttggagttttaccatgttgcccagactggtctcaaattgctaaactcaagtggtttgcccacctcagcctcccgaagtgctgggattacaggtgtgagccacctagtagaggttttaataagagattatctcccactcccagagttggcctcgtctcttttctattgccttttactgagaacttgttcatagaaatggatagaagcctcaccattccttcctttctgtcttaaagtagtcaactttgccatgtttgcagagcatgccccttgcgttattcaagccatagcttcttgctgccttccagctctaatctccttataggtgtagcaccatggcaacagacccagcctagagcccaggtgccttgtttgttacctgaggggctgggtgcagcctgaaggaatagaataaggaatattacctatcctacaaattgtttggatagatgaagtcttgatctgttgtttgtgtttctgttctgcttctatggaagacttgaaataacacctggaaaacatttattcaaagattttatcagtaaccaaaggcaacaaagaagccatcttctatttgttctcgtcttctaaacagagagttgttttctgacatatagttcagaaagtgacttgctataccgggacatgtggcaccgctatgatttggggttgcactgccaggtggctctaccattgcttcatgtaggtagacgtttattttgtttgaaataaaattaatttatgctttagaaatttttcctagagaatttaaaaaataaaagttgcctttgtcatacctccttctgttttaaacatgccttaatctttcctgttgagaagctcaccccagagcatgagaggatttttcctcccagcaactcctcctgggaaaaatgagctagaattgttgttttgtttaagaaagattacagtgtccagtttccttaatcaggcttcccgtgtagcatattgggaaagattatatgataattaaagtacaatctttctaacatttaattatttatagttgatgtactatatttgcagtacataacatgtcattgtcttatacatagaacagaaggaaataaatatggagcttacattgttatatttttcttttttgtttttttaatttttaaatattttaattttttgttcttgcccaatatcagaaaaataaacattgtcattttaagatacaaaacattaggtagcatttgtcccttttgtgcatactttgtactgtcaacaagaaatataaatgttgacttttttactttaaaaattactaaatatcagaacacatgttttgcagcctaaactttaaatggtggcttgtgtgtgtgtgtgtgtgtgtgtgtgtgtgtgtgtgtgtgtggaaagaagaagaactaaaatccttataagcttaagatttttcttattttatgaaatttgattaaacagtgttagaataaaggtagaaaggagaaagcagccttagtgctagtttcttatatctttttactttataatttaaccaaaagctactctggcattaaatatttaagttccttttagtgttaatgtggttatttcaaggaattaaatgaagctacttatttaatgtgttttataaaaacaattgtctttacacaaggcatttctttttatccttattactaagtacttctgcttgaaatatatgtgtgtaactctgggtgtttacttcaatagatactataattattgagtcaaactgcatggccatccagtttgggattcaagaatattgtacttacgtttgactcctttaattctttcaagaggaaggcagtgaagtactggctcttgtagtgacaagtcatgattcctagcattcttcttataagcaactaggaaacaaaatcagccaggatgactgaacggtgttgacaaagatctctcttctagatgagagtttgggcttttttttccatgctgggaggtttcttcaaggcattttattctttattcatgcttatatagtaaagcatgtattgaaccaaaagcctgccagaaaagaattctatattgagatggaaatcaggacttttgaaagacaaggtcttgtgataaaaagttgagcttcgactctgtgtgtgtgtgtgtgtgtgtgtgtgtgtgtgtgtgtgtgtgtgtgtgtgtgttttgccaaagtagaaagaaacaaaatgaagattcagccactactattctgtcaatcatataagaggataaagctataacatgaaaaacaaaaagaaatcatttgtcttttggcaatacctttgcataagaaagaatatataagataaccttaaagagtatatatttctccgtcttccaaaataggaataagaataaaaaacaatttctgtaatgggatttgaaggtcactcaagactagtaaaattatagtatatttttatgccatattgaaaaaaagtgtgtgtgcactcacatagatatatagagagaatatatttgccacataaatatgattactattattgttactgtagattaactattaatttgttcctcatttatttcttcccttaggcatttgtacatttattgttatcctccattgcattagaccttcatttccttgctggccaagttacactaccttaaatatctttttctacttttaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggtaaaaataaagtgtagaaaaaaggaagagtagttaaacaacaattggattttatgtccagtaattttgcgatttcattgctgtacagttgatgatttaattaactggttttcagttgctagaaattatctacttacagagaaaaagttagaaatcttttcatctaatcatatttgcagttaaagttattaaagatagctttgcattccttttggctttgcctcctttcagtaaaatttgattcttagtacattttcatcaggggacaagactaacaataacattacattactatgttaatttttagtattggtaaggatgtcactcatcatgttatttttctaaccacagcatcagtggttcaagatctgagaccatgtttttcttatttatccatccatccatccatccatccatccatccatccatccatcctaattccaggacattttgacctaaatgtcttatttatttttgaaatcccctgtaactaacccagaccccagcacattgcaggtgcctgatttttgaataaacaaaattgccaactatcataaggtaatttctcccttccaaatatgtactactagccagttacaagtaaaattcaaaaactatatatacatgtatttatacatacatagaattattagggctgagatttgattaattaacaagagcttactaagtgactacagatgagtcctatactagatgttgtagaagtcaaaagatgtttgtttggttcctcttcttatggaccagcactgtccaaaagaaatatagtacaatctgcatgcatatccaaaatattatcatttcaacatgttcactatcagagaaattgtttcctttttttttaaaactaagtcttcaaaatctgatgtgtgtttacacttgcagcacatctcaatctggaatagccatgtgaggctagtagctgctgtattggacagagcatataatctgatcggatttattaggttgtgaccagagattgagttaataagtgagcagacttcagcaatttgggcaagacatttattggtgttcttttttataaaaatcagttgaactttcttgtatttgcggaactcagttcattaggctgtatatcaagcccagagttaggtgctaagtatataacaacatatttcatttttaaaggactgtgttaatagtggtcaggctaacctaataaatgactagaaatcaacaggctggttgcgtagtggaggaaaaatgggttccaaagatagtaattcaatattagtaactcttcaatttcatttagcacccttctataatatagtgaggacagtctcaagaaatctgataagctgtttcagaaactctcatcctttattacctattttttactaactcaaagttgaacatatttatttgcaggtaatttaagttattgcctaaaaggcctttaattttgatttttctgaaccataggccagttttaatttccttggatgaatttaaaatggcctttgttctcatacctggaaatggatgtggatgctacctaagcaaaaagcagatgtagatgtagatataagtatcggaaaactagcaaagatcatcttagtttcttatggtatgatttaggttcatagcatatgtctaactcacagctttgcattccttttggccttgtctactttcaataaaattggactcttagtacattttcgtcagaggatgagactaacaataacactaaattagtatattaattttttagtattggtaaggatgtcgctcattaggttatttttgtaaccacagcatgagtagtttgggatctgagaccatgtttttcttatctatccatccatccatcctaattccaggacatttcgaccttatcatttaagagttagaggtatgctgtgaaccctaatgacagagccctgaaatccagtgttttctttttcttatgtctaatttttatgttgaaggttacctacttaagtggaagtaaatgcttcagctgtaattctgcttctgagagagacaagtggatggaaaaccttcgcaggacagttcaacctaataaggtaatagtagcttcaagtatctaaaaaatgtataactttgtaagcagttaattgatagaaggtaagtgtggtagtaataccttaatttgtctatagcttgagagttttaaagcacatttatatgttatgccatttgtagtaagcccttattatatcaccataaagaagtatctgagactgggtaatttatcaagaaaagcagtttaattggctcacggttctgcaggctttacaggaagcatggtgctgttatctgctcagcctctagtaaggcctcaggaaacttacagtcatggcagaaggcagaaggggagcaggcacatcacatggtgaaagcaggagcaagcgagagagagagtgtgtgtgtgagtgacttggggggaaggtgccacacacttttaaaccaccagatctcacaggaactcagtatcaggaagatggcaccaaggcatgaggaatctgcccccatgatccaaacacctcccaccaggccccacctctagcactggggattacaattcaacataaaatttgggcagggacaactatccaaactgtattatcattttaagctaaaagcagtcttactgcagatattattgccatggttctaccagcatggataaaaggactctgaaaagttaggtgaattggccatgtcagaagctagtacatgatagaagagggactagaatacgagcttcttaacagcttatctcttttatttgcagatattagactggttatatgaaaacttaccgttacaaaatgatattttcttaacccaagtaaataaaatagaatgaactatatataatatatataatgaactatatataattcttcaagattctaatgcatgcttgtttagagcttgctgttaacctaagcaatgagatagcaatccctttcattatttgttgactccccttaatagagtacctaatgaacattgccaacttaagaaaaaaatgtttttttttctgcaatgtcagctctgaaattcagctttgttgcctctttataggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggtaagtggaaaagggggattgcagtacctgaagtctcttccctacctttcataaaccaagatatggatattgtagaaatccaaattagagaaatgtgctttactattggtcaaaacaagaagaattaagaagaaaacctattagatccagaaaagatgaagattataaaactaaacaagtaaaatggagagaccagcaaatatttaaagccaatttgcatgaaacatagataacacagccagctctttcttgtctgacaaaataaatggtaggattggcacgataaccctacagcatgttcaaggttccttatctttaatttagttctagagtgttgtatggtggttttcttcctcactgtattttatttaagtttaactgatgactgtatcctctaggcacagaaggaagtattccagaagcatattgagtattagcaagagtctttgtgggattaaaatctatatttagaataaaaatccaagggatatgatacaattggtagctgtttcatgatacacttatttcaccttggatagaagtaaaaactcaggaatattttttatttaaaggagaaatatgctggttgtgggaagaacaaaaactagttgagagagtctttgacctatgaaggatattaactaggaagagttaccgttatactgtatgcaaactggtcatgataaaattacatctcagatccaaagaaactcacagctagaataatgtatttagaaccaaacaaagtactattactatttcttgatatgtcggaatatatcaatatattcaatatttagtctcttatctggcttctatggattataacttttgtgtttaaatttacttatgataatcttgggcattctgtcattaaaaagcttatgagtttggagcgaggtgtcactgaaattttgaattgtatggatatatttctacttttcagttgctcaaggttcagaatatacattaagacttttttaaatgacttaatactgatttacgtacattttaggtagaataaacacccatttaaagtggaaaagttcagtaagctttgaccgattttgcacccatcgaaaccaccactatgatcaagatacagaatgttaccgttacccccaagagtttcctcctgtctcttagcattaagtttaatagtgattcctaagtctacaactctgttatactgttaagctgccccagagtaagtcccattgatgtttaaaatgcttaattttaaagtaaaagtaaatcagcatattcctcctattttggcatttgcagcccttgaaatatccaataattatatagcattcaaaatatatgatgttatcacattcaaactgaacaaccaacattgagctttactagaagttctttaagactgttgaggaatgaagcagctgtttctttgcacctttatttccccttatgctatccttctggattgatggatggatggacggatggatgggtgggcgggcagacagaaagatagcctagacaatgacttcaagtgatgagttcagtagattctacattgacactgtggaccgatttgtaagtattatatattgaacacctaatatatgccagaaactgttaggtgctggagatatggtggtaaacaaaaacagaaactggttttctggggaaaataaatattaatcaagtaattacagaaataaatatgattacagtgagaactacagaggataaaaagagagatgatactatgaaatggagcaaggggagctgactaatggagttcaggggcaatgttggtcagggacaccttcactgaggaaatgatgtgtgaactaaaatccaaaggatcccaggaatgagctacctgacagtgggagtggaagcaagggtgggagcagagcagaactgagaacagtatttggaaaaaaaaaaaaaaaggctttgtggtgaatagagaacattgtgtgtgttagaaagggcttggtgtattaaaggacctaaaaagaaaaggtacaaggcttgaaaggtagacagaaaccagaaaatatagggacttgtagactgcattcagaattatggcctttatcaaaagtgcaatggaaaatctttgagggaattttaaatgtaggggtaggaacacctaacattttatcctgattgctttttttcctttcagatgaatctgatagctttagttttaaagcagcatttccaggatgtctgatatttcaaaagtctcttctaatgtgtattatttattcagttgctttctgcctgattgaacattattctaccaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggtatgaaagagaaaaacatctattttcttttatttacttttcagttttaagctatttcacccccatgagacgaattgagctcaaattctgcatgttatttagttctagctgactcaggtgttaaggtttgaatcatggctgtaagaagtctgcagtactcaccagtagagaaataataataaatgtagaaacagaaaccttgtcagcatacactgctaccccaggtccccagcttcatgattccaggatgcacagtaatatcagcagtgtccactgatagatctgaggtggtctgttttgcccaaagttttgggtgtttatatgatgatattattacctagtcttgagagtgttaccctgacatttgttatcatgcatgcaaaactctaatcaaaagtgaagaaactcttgccacttcccacaactcccccacaaatttctgcctttctctagaatttttaacataactaatttttgtccaatcagtagttcttgctgactaggctacgcacttgcagttccagatttggtcatgaaattgaggcattaaccgctagagtaaggtactgtgctggtcactttaatatacatcatgatagagcagatgtgagttccttgaaggaaatagccctttgttttacctccatatccccactacctgcacacactgttgagcagcactgtccgatagaaatatgacccatgtgtgaatacttttatttatttttattttttgagtaattgtaaattttctagtagtcacagtattaaaaaggatgaagagaaacaggtgaaattgataacatatttcatttgacccagtatatccaaatactatttaatggtttagaagaataaaagttattaattaggtgttttacttttttattctttttgaaaatcagtgtgtatttcacatgtatcacacattttaatttgcacaagccatttctaatgctcaacagccacgtgtgactatcaagaatagaaagtaaaaacatgttgaatgattggagagatttttaccctcgagaagtttgcaatgtaaggatataacattagggatatctctataccaaaaagagacattctgtgttctttcaaataattttaaaaaaattgaatccagctgatagaattgtcaaactttctgtgtgaaatacatttatgttttgtatgtagtttgatgaatagaaaggttaaaaacagacattgagcaagagcagataagataagaagtagcatgggggaaaggacccataaacaaaaagacatagaggtgggacagaaccaggaatgtgtggaataaaactatttagctggaaaaagacatgaaagaaacatgtgaacaacaacaacaaaaagattaaacaataattagaactaatttgtgaaaacctcaaatgcctgggtgaagatttaaagtttacagtaataactggagagccactgaaagttttgagcaggtgttttcagtggaattaacttagcagactgattaagacgagttgtatccaggcatggtggctcacatctatagttccagctactcaggaggccaaggtaagagaactgcttgagcccaggagttcgaggcagcagtgagctatggtcacatcactgcactccagcctgggtgacagagaaagaccttgtcttaaaaaaaataaataaataaataaaggtgaagaaagcctactgaaagccaatcaattaagaagccattgtaggctgggcgcggtggctcacacttgtaatcccaacactttaggaggccgaggcaggcccaccacccaaggtcaggagttcgagaccagcctggccaacatgctgaaaccccatctctactaaaaatacaaaaattagccaggcatggtggcgggcacctgtaatcccagctaaggaggctgaggcaggagaattgcttgaaccagagaggtggaagttgcggtaagccaagattataccattgcactccagcctgggagacaagagcaaaactccttctcttaaaaaaaaaaaaaaaaaaaaaaaaaaaagccattgtaataagaaagaatgagactctgaatgactgtaatcatgcaagtaagaatagagaggaagacggatatgagaaatattaaggttgaactgatagaacttggcaaatttttcagtttgtgggaagcaaggagggaacgaatattacagagaattgtggggtgttgtgagtgactagggggatgatgagattcttaacaggaatagaaaccacagaagtagtaggtgtgaaacagtggaaattacatatatattcaatttgaagttctagtaggaaatctcaggggttttagataggcaatctaagatacctgtctagctggctgttggaaatttgagactaatttatgcttgtggagaggttaaatgaagctgtaagattaccagagcaggaagagaacagggccaaggatagatcttagagtgcacctgggtttatggtatagaatgaagaagaggaatcagagaagtgatcagagaaagagagagcatccaaaaaagaaagaaaaccaggaaaatactgagtcctagataccaatagagaagagagcatcagtagagtcagaaattatggaaggtaaagaaaaagaatggatattgcatttggcaccttaaatatcactagtgatggctcacactggtttcaggaggaaaggaggcaggctgtaaggaatagagtgagtcgccattcaagaaacaggatcactgtgtttacatgaagcagacacattatagtagctactacaattagtttctgctctgaagcagattttttgtcttcctgcttatcttcatatttttttctctaatcatatagacattaagaatggtacaaagagcttaagaaaagtacaaagaggtttatagtgtcatttacataaagagcttattacagccataaattatatctcatgatttgctttaatgatttgtgttttgttaaaaaagtccaccaaaaaaaaaaagcatctcaaaccgtattctccattctatggagataggagtgagtatttattgactatctgcttctttgaaatcaattattcatatttgaaattcagtgtgctaaacaggatttctgaatgaaataatttccaaaatgaaaagtggatactagtctttttataacagtgaatgattaaatggccgatgggctcaatgaggcatgaaaattaattcagtggacatggaaagaaattcaattaacccctcagaaatctctgtaataatatttataatccaagagcaagggccagagtagtaaaaatggctgctgcttctaagagcataagcagaattaattggtaagcttcttcaggacaggggctgtattgtcttcttctcgttaaagttttgctatatttcatatactttgggcaggaaatagatgctgtttccagactgcttgaagaattttcagagagaattgattttaaaagttgccagtaatagtgtacgatatctgtctgcttcttagccagtccttatcttaattaaagcgtcactctttctgcacagactctgcattgtttagacttgaatcttccatctattatcccattttacctttccaattgaaatcagattgcaccttggtatcctgtgacacacaggaaatactatctgtgagatacactaaagaaagccctgatgaaaagacctgatttccacttgtagcagtggaggcaggtttctttcggcagtaatatgtccatccttgttgacttattcctacatgtgaaatttttatgccagatagtaatgagttaatgatttacatagaaaatacatcatagaacattctgggcacaaacttaacatgtaaacaacataacaagcaccccctttggctctggtttttttttcaaatgcaagaaggcaaacttaagtgggttttttaatctgtgttggtaattaagcaccttctagttacaaatcaataaaagcctctcctttcaatatggtacattctgcatgctcaaacattggttattgtttcaacagttaaagtattatttttctattttggagcattttaaatatgtgataatcagggacaaaaactttttaagctggtactatagacaattaatttacttctgggccctggagttatttatctggcacttttcttgaagaattaaagaaaaatatggttaatattcatgttttttattaatattagtattttttcccttgaatacatataacctaaaagaagtcactaaacagaatatttaggatacaggtgtagagtttggccagtttttacatgggatatttgacattgatttcttagttttaaatttaggtactctttaaatgaagtttaattgtggaaacacatagcacaggagacatagagaacatattgactacatatcttgggagaattgataacattttaaaacagtcttttactagttttggccatttcacctgacaaaaaattattcaaaagttgcatgatttttaaattaaaatactttttgtatggtgcacctactaagagccaggtaccatattagatgcttttcatgcattatgtctgttcctcaccacaactctacaggatgattgctattaacactgttttacaaacaagacagctgaaactcagacgaattaagtgacttttccaggccccacagtcagttaaatgatggatccggatttgagcctagatctctgacctcaatgcctttaatttttctgtgcaccactttcctttctgtataccacattgtttcctgttctctaagcatttttcctcaaaattatcgcttctcatctcctgtcacgggtatttttaaaagctttcatttatccaaatactaaccactttgatagaaatgctctttctgctgctgatgctgctacttagttttgcaggcattattgttcactttcatgaagtctgttataactagcctgaacctcaagtaataaacacatatttaggaggatctttgaaagatccactcctctttcataaagacctataaaaaaccaagaatacatactgccatctctgataaatatttattgagcacctgtaacattttgggagctattcagaagagtcaagatttgaacatgaataaaacctagtacctaacctctgaaggtattcatcctaggaatgaaacaaacacaaataatgagaaatatgaagtagtcgaagatatacaaggtatggtgtatactagaggataaacaggtaaggtaggaatttgttctttcagggaatagtgggtgtatcttcatagagcataggccgtatgaacacggcttctaaactaaatttatatggaaaagcatatacagattatgtaaggagatctgctatattattgtgcaatgttgaatgactgtctccgttacaagaggtaaacatagaagatagatccttacttgcatccgtgtttggcaccaacattagcacttaaaaccttcactggactattcaatcaagcttgggtcatttgttcttctagaataacaataatagtcacctaagtagagcgagccttaaaacataacaagtttgtactaattaaacatatatttagtttaatacattttttgagtagtatcattaccacttttataaatactgtgatgatgatgttagtgattgctgttattccacttccaggataagaaaaataaacatgatatgtaggatgtggcaactcttgggttccaaagcaatgaggcttcatgggccatcttttgtgccctccctgtcagatctagaaaagaattccccattatacgttttaggacagaaatcataagtccttttattctattcaggaagacactgtttatagctataccgttatcttctctcttcaaataggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactggtgagcttatcttatcctctgccttacattttttcatgtaaaggtcatcacagtggaacttacattttttcatgtaaaagtcatcacaatgttaacaattattttacaaccaaaggggagggtcttggagaaaaattgaaagtttccctaatacagtcccgtctaaaattgaaatctctattgtaagcagaagtacttttgaactggctatctacataaatataatctctctaatagaatattagtactatagcctctaatatcaaaagtatttcttttgctttctaaaatatttactagtgttgaacagatgtgttcatgaattttgatcattgctctaactccagcaattggcgaaattttggaagatttttgataaacagtctttagagagattatggtgagttatactaaaccagatggtttagtcaggagcctcatgccattttcccactttgcaaaactaaatttaaactaatccagagttctgtagccttgggtttccagtctccatctggcctctgtgaattttccaccgcctctcagccatgaatcaggtaaaacctcatcccggaatttctactaggtcctcctcacagcctgactcttaagcaaaagtatattgggtcagggtggaatcacttgtgcttgtactggtacttctgtgtttagaggttttggtacttctttccttccctagtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtaggtgatactgttgtaaccactttaaaaacacagtttaaaaaatacttgaggcctaaaatttggatgagggttgggagcctcatcactcatgttaccagattttcactgtgttattaataaatatagcaaaaaaatggaaacaacttaatcacttcatagaggaatggttaagtaacctatgatacatgcattcaatggaatatttgcaggcactacaaactgtttacaaaaactatctaataatatagagcatgaagataaaattatattaaaagtgctgataaaaatactttagtgggaaaaaaagggcagaataaaaagtggtatgtatactgttatcccagcaatatgaaaacacaaaaatctaagtataaaaaaagttgggaagaaaagacaaattctgcggttacaatgtctaagacaattatcctggccacttcaaaaaagacaattttatgaaaaatgcaaaagatggaggggggctgttctagattaaaagagattaaatgcaatacttgaaacttatttggatcttaagttggaaaaatatatatatatgtccttttgggggcaatgggtggaatttaaatatatagataagataattcgtgaataatgtttttaaaagttttagtgtgataatagcattggtttatgtaagagatattccttattctgaagaaatggacgctaaactatttagaggtgatgtctgcaacttagtttaaaatggttccagaaagaaaaaaaaaaaaatctgtctagaaagagagggtgtgaaagcaaacttggcaaatataacagttggttattgtagatgaaaggcatatgggtattcattgtatattctttcaacttttctgtaggtttaaaatttttcaaaagaaaattaggagaaaacagttgggaaggaaatgtactaaaatataaacagcagatatatttgggtagcttgaatgatacatccacacttttttctttctacttttcattgtttcaaacttttttcagtaagtttatgatatttttataatttatagaaaataaatttaagaaatggctgggaaggaattcacatttacagaactgaccacagatttactcagtattgatgcttaaagacaagtttctgttagcaatgtattgaagaaaaaaattggaacttcagtgaacagattgttttctagtataagtggtggctttttagaggtgtactattttaattttgtataatttatatataagccaatgcagaaatatacatatttatcgatatttgagctaaaaatatttatattttattttggaacaggttttatggacttaaactaggccctgcagatagctagaatctagataggcaaaggagagaagtttttctctagtgcaagtaaatagcatgggcaaaagcttggagaagaaaaaaatgtgtaatatatttgggagactttgtagaagctagcagtattgaaggtttgtactggtgagcttttggtaggtaagtgagggctatattgcagagaaatttaaatcccagaactaaaaaaaaaaaaaaaaaaaggagttttggctttaccctttagagagaatagaaagctattctcaaagcattagaatattaaagtgatattaagaaagtatgttataacatttatcacttatagataataaacaaaattagtcattccctccacaaaataaaaaaaagtaatagttctgtgtaatgtcaaatcaaaatgatcatatctctcttgaatatgttctttctcattttctcatcctctacttcaggtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataaggtaaagtaggttggtggaagatagagaactttaatgtacctgaattctggaaagtaactatagagtgatagcactcactctttctgctaattgaaagcaactgtttaccctagaaatctgagagtaaatggtcatcatttctgagtaaaatatgagatcgacaaccatgaaactctagaaaaccatgacattattaatatatgtttttaataattatctgaattaatggagtatatttctctaaatttatatatacagagtgcatatctgaaaacttgactagaaactaatatattggtatatacagccttatgcatgtctaataggataagatgaaacctcatatagtaatttctaataaaagtatagatttagctaagaaaatactaggtttatcatgttttaagtaactacccatgaaacaaatttttttactatacaagtcatagagtttcatataattattagtgctaacagtcattgttttctttctttacagatgtgaattaagaatacagaaagcaattatttttaatcgtttgctaagaattttattatataccgtattaataagtaaatatacaccatgccaatcattttcttccttctggaatttaacaaaaaggaatagatttggtagtaaaaaatagtctaaaagacgttggctaggcttattacaataattatttattgatgtttttgtttgctacaggcactttataaatatgtgtggtggtatgttagaataacttcaaaagacagtcatttttctatgataatgatctacttattttcctctattttcctatcaataaaaatgctatatcagtaaaatttgaaggggaataaaacctattaacaaagaccactttgctgaggaaacatatgtggtaatgtgtcctccagtgcttaaaatatttgtaaaacaataaactgttccttattctcgaggaccttttcttcacttttagaaatgctagctagatttttaagttgcagctatgccaaagataaacccttttcatgtgaatcgtagcccaacattattgagcaagtaaaggccttggtggcatctatccctgtttgagtagggtagaagagtctgttgattgttgagaaggcaaagacccaaaggcagctatgccaaactgactgacagttgaaggggacccctaagaccccatgagaataagaattccctaaataaaaaaatgattgaaatggataaagcaagtattaaagagttcgtctttgttgaataactgcatctcagtggaatgcagattcagttttcctgtgaaatgggcctggtttattcaggatcaaagtctttttaacgggctttgctgtgtaaacacactttctcctttttaatctgtgtttggtcctgggaaccaggaatacatctagacatatctcatagaggaagtttacctgattttgctgttaaattaacaataaaaattgtcttactgatggaaactcagttggcagtgggtcagggttcccaagattgactgggatagtggatggcagtatcatctgtgtgccctgcagtactctggattcctgaatgagcaccttcttatatgttggcatgcatttcttttctcacatgatcccttttctttgaaagtttatcatactagttgatcctctgatcttgaagttcttttggttagaaggaatttggttctgcctccaccctcccccaccttgatctactagcctcccaaagatttagtttgcttcgcatgcctattttagttggaatggcattagtttggtagttttgagcatgtcttttaatttttacttgcataatcctgatttcgatttcctttctttcctcgatgtctgccgcaccttgtttcgcctcctccattcatctcgacgccatggttctgctgctccataacaatgcattatgaacctgccactcccatatgcaaacacttacccttccctccaacctacacccctccatcaatggccatcgttgtgccaaaaacaatctgtggtggatgtcgcaatgcttattatccaattagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacaggtatgaaagagagaatttgaccactatctcggagaaacataatgtttagatttagcagaagtatattcaacctatttgttgaatttacaagtttaaaatcatgagcaactgaagactcatctgacctgagagcagtccaattatttgtcataataatgcacaagatctgggatgacttattttctagaatggtagtatagagagttacaatatattccacaagcatatttttaaaatttctgtcttgcttagtggaagactaaaggctttatgaaattcatgtttctgtacgttatagcattcaaaatcttggagaacctcggttaaaaccattttatagctggctatgtcaactggacaggtagatacaatgtcgatgcttagactgttttagggattggcaagacttgtgccttttgcagggacctttcagttgtgtgcttagaacttcttctcttgaaggtttagacaagtaagtatgaattggaatatttggggaaggtttaaaacctaactaggaaattattggaatcctggttaaaactgaagacagtgatgggttggtatctacagtgttattctgtacctttggggaaaaagtaaaaatgctggattttattctaagcattgtaataattccctaattagataaaatctgagtttccaaagaaatgtacgtatccacataagaaccttcggaggagttcatatgcctgaattgaggcatcttagccatgttgaagttgtctcaagagaaattaagtgtcctttccttttccacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggtaggtgtgagtgctgaaggggcctggcttctacttggtccatctgtttccttggttctttatacataaatcattgggaaatcctattgttaacaagatttcctcttaaaagcaacctttaaatggaaagaggaaaggaaaaatttgggaggcttctgcccaggtgtgactacagaatgtagtttgactcattacccttaagagtctaacaaacacgcagaggcccccttccttctcttcaagcagcagagctgctacctcagtttgcacttagagcaaatctatgatgttgaatgaataattagatacttaaaatctgtaggcaaaaccagctattattttggaaatctgaaaattaatccttcttaattttttttcttaagcttccagaataaaggtttgcattccgagccaagagtttaatatgactgctctccattccatccctcaactccttctggaaatacaaagtcccatgtggcttttcctggaaatagctagaaaaataaacacttgaacacctgtagagtcaaggtaaaggagagagtaaaaagatagaagcacaggtggaaaaggaagtattctaaacatctgcaaatcccttacatttctatttacatggacaagcccagctaacatcacatccaatcttaatataagtttttctaatttttttattgacaaataaaaagctttgccaagaaactaatcatttcttccttaaatattacattttgaagcatcaatacatatttttccctttgaaacaaactactgttaaatatataatatacacattcatataatttttcatgtatataatatatatctttatatatctttcatctaaaaagatttttctcctaaaaaagcattgtattagttgaattttttttgaaacctaatgatagtactaaaaaacttgagattaaaagagttctatgacaaatccttttatgcagcaaaataactgggcagggagactgcaataaaatcctagtttgtatctgttatatatttgcatttttacagtttaggcacttacctatatggctgcctctgcctccagtctgctatgatcagagccccttgcacctactttgattttttaattggattatttatagaatccttggatacagaaatagaagaagggatgaaaagcatgactaacttaagctgtttctggaagcagacttcctgggctaaacctcctagttggtcattttttactgagtaataaagtttttctacagtcttaaatttttcatttttattttgttatatttcccaaaattttaccaaatcatttgatttagtaagcatttttatttgaagaaaaggaaaaatagatatcttttatatgtatcatatgtattttttatatataaatgtgtatgtgtatataagcataaaatgtatgtgttagaaggctatcagtcattcctaccttattgtgaagtagtttcctcacatcacttttgtgctagattctagttgcgatcaactactttcagagaattaagatgtttattgggaggagaaaggaaaaaatacataattttagaaatcagaatactgtgtagaagcaaatatctactcagggacttagggcagcacaagggcactgaagataaaataggattagcgaagagcatgagatctggcagagagggacaggacagggaaagtgtcctccacctgcttttcaaaagtgtacttaggcccagccctgtacagaaaaggaaaataaagattcttttttttttcttttgcttaccctttccttctgtatcatggagggcctatgactcaggctggttgtttattaatattataaattaaatagccttttttgtgctcatctggaaccagttgtcatttataacattttttctttaggaaaatacaatacctatcgcataagcacataatacatgtttctgtgggttatgattagagggctgcctggatggatgggaggtaggaaatgcatacagtctccaaacaaccaatataaaaattagtttttgtgtcacagccattaatgagtcaccaaatatattttttggcatgaagtggggtacaggcacagtgagatgtccaggtacagctttgaatattaatctttgtttatacttttgctggtactgccactgtcctatcagttgaagcataaatcaccgtattttgattgctcaagtttcttttttttttcctacactggcttttggttcattgttttgaacttacattgttagttttttatttttatttttatttttttgaaacagagtcttgctctgtcgcctaggctggagtgcagtggcacgatctcggctcactgtaacttccgcctcccaggttcaagcagttctcctgtctcagcctcctgagtagctgggattacagatgcccaccaccacgcctggctaatttttgtatttttagtagaggtggggtttcatcatgttggccaggttggtcttgaactcctgacctcaagtgatccacctgcctcggcctcccaaagtgctttgattacaggagtgagccaccgtgcctggcctagttttttatttcttatctgtttcttgcttgctttgttcatctcactcccatgaagcctctgaagttctatataatcagcacatttttaaggcaaattcctttacatattttaattgcaaattgtgttggggaattctctcccagaaactagaggatttctttgtggggattgttctgtaggcggctgtaattatcagtagctttgtcccatgcaaattccatttatatcttagcacaaagtagtggccattgtctgcagagtaactggcttcagtcttctacgtctaatgagtaggaaggaaataaaatcctggtgaaaaaattcacagataaattttttttcaagaaactctcttaattttttaacccatttcagcctctgtttgtattgcttttttcttattttcctctctattttgtttttcatgtatcatctacttcgtacaaacagtagactttatatatatgagttgttcagatttatcatgtactctaatcttagaaatttgaatttgaagagaccttttaaaatagataattgacaagcctgttaatatgatgctgcagttttcacatttagatttgttgaactgtctcttaaccaacctcttcaagaactcccaaagtttgtggattaatttattcggccctttctttggtgttgatagcagaagggttattcatttatgggaatccgactatttcacactatgaagctgaaaccaattggtcttgtttatgtctagtaaatactagcaaggaacgaggaactggcctcagcatagccaggctatgattaattgtagtatcagtgaaactgctgcatcaggctcttttgccctaaagcgttactgtttttccagggaaaccctatacagctttatctcaaagggaagatattcctaatgggaattcctgctcctttttctttttgtctttttcattatctttgatgatcatgttgaaagtcagtggatataaattctctttctaaggccattcctaagcaagatggaatctgaaccacttactaacctcctccctcaattttttggactataaactagagatattttttgctatttatccagcttataaggagatggaacaatcattgaaaagaagcctttggtgcccttccaaaggattaggggaaaaacatagaatattctctaagtaataaattatattttagtaatgaattctaaagataatccagaataataaatgaataatattttattgagcatctgttgtgtatttaactagtcagtatcatttaaaagaactgtatgatatgatgcccattagattgactaattggaaaataagagcaacgcttataagaccaagaatatataaaagatagtatatagttttttcatttgaagaacatactacaacaaaaaaattcatgaaacaaaaatcacctctgtttcctttcaatctagcacaataactattttttatttattctatatttctagcctttttacaattttgtgaaggctttatcattaatagaaggaatagttaggattgatctattttgtcacttttatttttattattttgaccacctactgtatgccaagcaaagtgctaggatatattaggaagtggctgaaaataagatttgaccaacaaaatagtagaaatttctagaagttcattcacaattgcttagtgtgtacgggtctatttatataaactatgcacatccatcctcaggcatgaagctatttttattgatatataactataatctgtaaatcgactaaaccagatctttcttcacacctttaagaaatgtccctatgttacttttgcatgtgtaagttttaaagtctctcccaacccatctctgatagccttttagtctctgcaatcagttttttaatctggtcttcctcactctccagttcatcaaaataccccttcttttaaaatatttatttagagtttaactgagttctatttcagaatggtataaagatccttaagatgtaatggctgtgataggggagaaaatgcccttcaattatgaaattatggaattctggtccttaaaatacaaatccctctatttaattataaaaggctaactcacatgccaagttttgtactctctctttagcttactctctctctctgaggcaggacagaggggaaaaaaattgtgtgtttccatcattgtttgtggagaaagcactaatgttcaatagcctaatataaattgtaatatctaatgctagtttttgaaacataaatattgtaatgactgacacctaacctctctgtagcactctgaagtttccaaagaattttcaaatatattgtcttatcctcacagctccctatgagatgatcaagataggtggtggtgacagtgttggtatgtctattcagtagattaggaaaatagactacccagtatccatcattttgatcctgtattcaagaaattttccagtataaggacccttgagtgatcttaatccatcatgaagtcagtgttctgtaaagataaccagcatcacttgtccttctttttctctaaatcaataatatgaaaactaaatagactggtgcaaaagtaattgcaggttttgccatttaacccacaattacttttgcaccaacctagtatttgccattctgatatataaatgggcactttgtgagtttgtttagcactaatcagttttttggtttctgattgtgtctgggctaaacagatattttgaccatcaggttatgctttctttctcttatttaatcatcaaatagacttttatggcataaaagacttttatggcagaggtcatttattaatttcagcaggcaatttgttacctaccagtatttggaccactgggcaaattaacaattttaaggctttgactttctttagagggagaataaggatgcctcttggatatgatatatgcaactttctattcagaatagtttgcacttatacaaatgtatattctctttccccacccctagccttggcattagtaaaataatacttaaagctaagagcatttattagaaaactgagagatcacagttaatgtcttccaagaatagctgtttgtgaaacatagcacacgggtgagctgttaggggaaatgctaataactgtttctgatgcaggttcagtcacctgtggactctgccacaatgtccccagtagagaggacagcagcctgggttctgaacaatgggcagtatgaagaggatgtggaagaaactgagcaaaatctagatgaagccaagcatgctgagaaggtagaacctagtctgcttcatcaactttctgatcccaaaatgacaggccactaaaaaggttatctagctaagaacataaactcatcccacccccatcttcacctctaccccttatgttaatcatcctatacatatctatgtaaaataggtcagtggtgtgtgtgtgtgtgtgtgtgtgtgtgtgtgtgaatatacatggaaaatgttcatcttgctagggggtggcagttagctactattttttttaatgtagatgccttaatctagaggacactctactattcatttctagtcattttaggtaaatatttcatgtttctgtgtttccataaacttgttggtcttcacccaaggacaaaattaccctagggcaagactttttgtttatcttggtaacaattaggttttggttttagttgttttttttttttttttttttttttgccttttctggataaagaatgtatagctctataaatgactgttaaaaggatattatctattgtttagattttgtttttttgttttttaaggaaaagttgacaaggggtaaaagggttatcaaacaagaaccttgtcatcatatatagcattatattatttaattgacaaccagacaattagcttctttttatcagcatgatattccagtgtactcaaaccccagccacagcaactacagtacaggaaagggccatgtaactaattgagtcactgaatttatgtaaagctccttagaacacaaacatgtatgttccagcaagcagtacaaaattgggcaggtgagtcatattacaaaaatgggcaaagaagcaatattaattggccctagagaacatgtaggcctttgtttagtgcttgtgactggaatactttacacttttatagttggggaaaaagcagcaataacctctgccatgaaagtcttattgattcatgggcttaacattatagaaatgttgcttgttctctgtagggctgattctagtagaacaaaggaatggcagtctgatgagctaagacacatcagagatcctacagtgcagatgatgacacagaatctttttctcttatagacaactgacttttggcttattttaagtgatttgtcagacttttaagtacttcatctggtttttttttccccctttcatttgataccatcacagattggatgtggcttatagcaatggtagcctagtgtagagagagatacatatatatgtagaatttggaatgccaagttaagatttaaaatgtaattttagtaaggaaggcaatgctccattaacatttatgccagttgataattataaagaatattaagaacagtatagggaatgacagcacagccagcatctagctacactgcttagggtttcttttgttaaaaaaaagaaaaaagaaaaagaaaaaaagaaagaaagagaaagaaagaaaagtaaatcactgatttctaaaagcaatgtgactctagtttttgtctccttgcctcctctgccctagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggttagacatcacctggcagcagatgtgggctagttagcaagacaaagaattgagatgatccacagaaccctgaaggaatggcagcaaaagccatttttatccttgtggtactgagtacaaatgtgataattgactgtatctcttaaaatatcctaaatatgagaccttgggcacttcctatgaagataatctgtttttctttaaccataacaattagaaaaaattaaaacttggtggtttacttgagaaatcttagaggagaactcggttttaaaaatgtaaatatccaatgcccaagactaaattaatctttcaaaataagtccagaaacatggaaaggaattttatggaatatctttagggccagaggacctcttttgagagtgctgcagatgccaagggagaaaaagggagggtcagttttaccaaacacttgtatagcactcgacatgggacacacacctttctaagcactttacacataatagtttgtttaatctttatcacagcctccacctacgcattattattctcattttacaaataaacaggcaacaaattcattaagtcacttgcccaaggtcacatagtgatgcaccaggatttgaatcccggactccagattccatgctcataacctctatgcctcaatatttgtaaaatgctatggacaggtcaagtaaacagaactgtttgttgttttaatagtgtggaggtaattgacagtcttactgagaggtgtttgggtagactggcagaattaaacatcaatgagttaagatgtgaatggcggacagaaaacaagctaaacatactaggtatagagtactcattgaggaaacttagctgtgcaagggaagagaaagtgggccaggtttagggtaacttgagattaagagagggttgtttgttttttgttggttgatttgatattttaagatgaaataagttgtgctcaggaaggaatctgagagagaagagggaggaaatgattatggggttactattccaagggagatgaaaatgtgtgggatccaggcacaaggagaaaaatcaaccttagatgtcttattccaaggtagtagagaagaaagaaaagatggttgcaggtgtcttattaaaaagggcagaggatattgagttttcctgttctctacactagctagccctttctttgaagatgttgatatttccttcctgccacattctaggctaatggctgtggaagaggaactgaagaaggatcatgctgagatgcaagcagttattgatgcaaagcagaaaataattgatgcacaggtaagcaggctttgaatctaatagaaggcacttgtttatagtaacgattatttcctgacttcacacccttgcaaatgccaaggcaggtacccaaaaatgtgtcattgaaaagttctagacgctacattttgaagattaaatgagtgtctgtgtgacctccattattttcctttctttcactggtgagaagtctgtttactcagcaaagtattagcgtgtttagtgcagttgcttgacaaatctcaacctagtgcatgatggggtttgcttctttccctatggaaaggagggcattttctaagggcgtaattgtgaaaagtgcactgcatgtgcctggcttgtgacctccactgaccattgcttggctgtgctgttcatggtcttgtcagtcacgtccactgccatcaaccttttgccccagacagtaatggaattgccagggaaagacaaggttgtaaaaaggtacctttccttgttgttcttttggtttagggtttggcattgctgcttggaatgtgcttggctgctcttctttgttggtgctgtgcttagagagcatcttttgataaaactttaaaaaaagaaaaggttgttgaaatcagaacctaggcttctgctcactgtagctcacacctgtgacaccaatgacataaaggctgccaagagcacctcatagggacatgtcaatgattagagcaaaatccaggaggcaagaagtgtttctaactcctttttattttatcattgcaaaatatggttgtatttcttagggtgaaacaaataacaaaaagcagttacagtttttatagttttgatagtggctgatctagccactgaatgtgttgcttccctgaagatagccgatccaggtttgcatttttcaaccttaaatgacatatcatatccctaagctgtgaaataaaaaatgagagcaaggattttatgcatagatagcctcctcccttctctaggtatcagctagtaatcaacatattttagagcccccagtattcttaaacatgtacttaacagtctagtttccttacagagtccatgtggaatgggtttatttttcaacaaaattgagagtgaggctgaaagcacggtcgtggaaagaatgcttcatgggcctcacactcctttaaacacactagacttggaagtcaggtgagagttgtgaggatgcaatcagcactgctccttaaaatattttggattcttgaactctatagtttctggatacttagacatgcggagaatcagaagaaaggtctgtagtaattatcttacttggtcctttgaaagaaatctttctagatgcccccagggtaggtgaggtaagggtagtggagactaggccatctcactattcacactataaaaaatcatcccagagacttaagaaaaacagcctggataaataaggcaattgagtcaggaaaactaatgttagtaggttttcactttggaaatttcaatataacaatataaagcaagaagagttctattaataaccacacaaggagagatgttagtactaagagataaaacagactttttaaataatttcagctggtttaaaagtatcagtcttggccaggcaaggtggctgatgcctgtaatcccagcactttgggaggctgaggcaggcggattgcttgagctcaggatttcaagaccagcctgggtaacatggtgagacccacctctacaaaaaatgcaaaaattagtcagacatggtggctcatgcctgtagtcccagctgcttggggggctgaggtgggaggatagcttgagcccaggaggtcaaggctgtggtgagccatatttgcgccagtgcactatagcctgagcgacaaagtgagaccctgtcttgaaaaaaaatgtaatagtcttaagcagagggagcttgggtgtgccacagttgtggttctgtacacaggctgacaggacagcctcatgattagctcctgaagatttctaccccaccccctaattttatattagggctaggtgactgggtataaagcagaagtcacctgctaggcataggaggtaaaagccagggagggaatctgatttattaggactcaaatgctctggaaagtaaggactttctctcagttaaccaggagggtgtcatgtgtaggaatgggagaaatgctatcctcaaaccgtaagtcactgtcagactggtggtctgctaagctagttaatgttttcagtccatacttcaagacagtggttttgaaatggtttggttctctggactattttggtagaatccaggcacctttcataaatgaatatccagctccttccactgaccactcaacagcaaggaccacactctcaactaatgaatcaaatcatactgggattggttaaatataataaattacctacccaaacacaaatattactatataataaattattctaccagagacccactgtggatccctaaagaatagttgggagaatccactaaactatatttggaaaacctctgcaccatgcatagcacaaatcctaaacactatagttaaattttaaaaaattatagtgtccttaaaaggaaggtttcttaattccagctgttggcttactgatacattaaaatcttattatagcaaatgactttaaacatcctttggcattctttgtaatgaatgacttttgtatcagatcctttcttttgtaaggataaatcttctctcttaagtgaatgatggagcagagcagcccttctggcatcatttaatagaatgaagacgtgtttggggtgaaagcttcccagagaagtgactcttatgtcaacacttcccaaaacactaccagccaggtgcccagtaaactggttttcatgtctctcagcagccctgtgctcccaggaaaatcttgtccctgaattcagcctctgcctctttttgagtcatttcatgctacaaggcacaggcctgcatcagccactttctaacaggaactgcaaaaggatgagcactcctttggtgagtggcagaagcacctatcctggaccttgtagcttaggggccatagggatcctagtggtgatcataaggatccatttcttaaatatcagaccagagaatgtgccacctttcacccctgagcatgaggagacactgtggctcccaggatctctctatgtgactcaggtggagaacagagaagggcttcctcctatgagaagcaaaagcagctgcctagttactgttgcaagtgatatctccgctgtgttaaattacaggtcataaatggagatgagattattcaaacaggcaagtaaaccccgcgtccgttctctagctgagcagttcccagccctggcccagtgcactggcctcctacacattccagctcctgccactccccacatgggaatccttcctgtcaggtgtggactagattgctttcccttacaatccaggcagaattgaaatgtccgagcatcttttgtcaactgaacttgactttcataagtctctatttgattttttttaacttttttgttttattttgagaggttggcaatagggggaaatacaaagggagtttctttatgtggaaactttcagctgtttagtaggggggctgtttgtcttcagttgttacctttttaggcagtaagtaattacagtcattcttaggctttttgaccctttaaaaatcaaattttttatgaattatttatttttggatgaaccctggagaatcctaatttccttatgaggccttataatttatcccagttctgaaatatcttttctttaatcgttcaagaaattatcagttactcagtttagagatcattcctaataatgcgagtagggaggggggaatatcatacttagctcttacctcttgttttctagtattcactggccagttcttacctattggcttttcaaagatctatatttgttatcccagtaaacttcattggttaaaatttttttaataataattattttttaaaagccttgcagctctttcctttagttttgtctatccttaaaatgaattactttcctaaaataaaaagcattttataccagatgcatgggtcattaatagtgctgattttgtatatcttaccacatgagttctccatcagggaaagaaggatttttttttaaatgataatgacaagcaagagctagtttgttgttgtttctttttttttaatatacttttgaaactgtgaccaccagcactgctgccttacggatcctaccctcctgcccccagaaagcaggagagtaaagggaagtattacttgatgccatggtggtatgtgattttacctagatttttcccccagggccgtggtcttcactctgcatgctcccagtagcatgtgtcccaaagtgtagcactacatgacagccctgggtagctgctgttttaatagcaaggagcagcaccagccctgagccctgctacttcctctctgaactttaccatgactaaactttaccatgcttttctcagggtcaattttaaaaacccctaaggtagtaaaactccttttggctttggaggtattccctatgtgttattttctttttaattttacaggcataggtaaagactgtttcctgcgttgttttctgaaaactatagacttcatgttagaaaggttctagaatgatttactgagctgctgaagctaagattagggtatctcttctaacctaatccttaggagactgataatgttttgataaaatgattttattaaaaaaattttagatagtcctactttcctttagttagactgcctattttttttcctcttttcttcccccttggtttttgtgtgtgtgtattcaccaatgcttggtttccaaatattgtttctaaagcattttttttcagagactcaaaagtaaaatgaaagcaatctccgtattgggcagccctcctggagtaactttgagctggaatgggtctaggagcctgtgttctctgtttgttctcatgtgttatgttgatggcattcccttttcggcacatctccctccccatattcaagtaactccttggtctgagctttttggctgcttttttcccctcttgctgttgcaacctcaccttgttggtgactctacactgccaccatgtattgttttaattttgagcacaatgtgaattccttccaaatgtgactgatatgccctcttttggggctaagaacccatagatcacatgctcttctcctctgtgaaatgaaacctctggtgcttctttctttgccacctaatttccatgtttcaattttgacctaaagcacttagtataataaggcagcttgatacctgtgttgcatagtctgaggtaacacatggtatcacttttacatgacagtctaatgtcccaagagattgttaataaaaagtcctgctatgctgaaagaaaaagagagagagaaaaaaataaacacagatccactgggctcaggggaagctgaacctgaccagtgtgcagaaagaggcagagacgttccatttgtctgggaagcaccatgcatacaactgtttgagagaaagcactggactagtcattcagtaaagaaagcgtgttacctcctgcctgtagcctgaataaagccatgattggtgtgttgtaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagagtttacaaaactataaatatttgtgtctccacataccatcttcatcttcacacattcactgtgctttcctccccatagtgggagctgtcatcaccaacagggtttactctcccctggagaggttatttaaatagctgtccataagccatccagatcaacaccctttcttccatacagaaaagggctaaccataccacagctggaatctctgaatatttcctattaaaaattttttctatgtgttgttataatttttgtttgggataaagactctatccattgtactagcaaatctatggggggtaattttatctccatctttaacttttaaagtacttcttccccttatcccctcaataaagaaaggaaatccaaatttgaagcatcactctcttaaaagaaaaagaaaataatggaaagtgtcaggatggcacattccagttattattccaatgctcgtagatctgacaataatgacccaatttcaacacttgtcatccatagccttattattatagaacagaaaaagtcatggaaacgaattcatttccttttttccagaggtgtgcaatgtcatcttgaatgcaaccttgattaccagaagtatggaaggttacatgttaaacagacattatatatacaaatatatatataatatatattcacacatatgtacatataactgcacaaataggaaaagttcatgccttctatgctgttcagatataatgttaaaagggtctcaaacctctttaagcaagatctaagtagttgttttatattgagaaagcaacaatgtttctcgaataagttgatgttgattttaaattataagctttaaagaattttttttctagaaaaaggggatggaaaaaaaaggacctgagggagccatatgcatcaagtgagtgtttctccataacagaatatttataagagaacatgtatagtgccctcttttgagtgatgccgacagacaccaagccctccttttcaccaagtcccaggcttgcattccagcctcttgagctctgccctctctcaggtggatctttgtgttggaccttacgtttcagcaacctcaccatggccacataacccacaaccttttaaaacagtttctttcatagcaatccctgtttctgccagacagatctaaaatgggagtttctcactgtgtttatctgatctgcacactttatatccagctgttttggcacttttacgttttcttcacctttggttttggtttgcaaattcttacaccttctctccaagcggagggcacactgtggtcaaaatcacttattttattaggaaaaagaggtaactgttccaaagtgtagtgtcctttgttgaaggaggagggatgtaagcatagatttgttcttgtttctggctattctcagctcaagccatgtttaattcattctttgtaaaagccttcaattgtgccacagaaaacctggtaagagaattgtcagtttcattggccataagtatgtaatgtgggtgatgtcttgccattgaggtttggaagctcttaagtgccgattatggattacagagggctgataaaattacttatattgggaattgagagaagccccaaaaaatcaaatgtgcttttgatggatagagtgtatcttattagcattatgggagctccttagagggctgtcttcactgaaagatttaatgcccaaaacatttggacagattatgcagccttctactaccaggttatcttgaatgaagaagaaatagtaaaaaataataataatagagcattaccaataagctaaaagttcagagttgctgatagatgttaaatgttaagttatcctgtgagcctactcctgtccaaccttttttctcagtatttctttagagaatgctgcaatctgtataagttactctgaaggattttttaagaagagaagccaccaacaggtgataatttttatggagatgtttcttaattggctttccctcagttca

SEQ ID NO: 13439 - DNA, 40505 bp, Human
  misc_feature (1)...(40505): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttactggccctagcacctacaagttcattcacagttccttctcactgacttcaccagtgaccactatcagtgacttcaagggagaaatgaggggggagataaaataaagtgaatggggaagagataaagaagagaggtcttttcacagtttgccagaatagtcccttcagtggttttaccccagggcaacaggagcccccttttagtttctttctcttttaattttcttttcccttcccactttttgcccactttttgccttatttgtgtctgactcaatttccgtctctttctctacttcttcattcccagatttggctgtagaaaattagaaagttcttgaacttggtttgcacgggtgcttttactttaacatgaaaatgaatgatcagcctccttctaatttcatcctagagtctactgcatccctcctaccccctgcacaggaatttagtcacacttatctctcccactttctctcccttcttcactttctctattgctcctcctttcatgcttgtacctgcttttccatgccctgtttagcctggcttgggatccagcaggttctccaagggttcctgcaagaaccccggctgggtgcccaggtctgagcctggtatgtgcctcagtatcacaaaggcctcctgtaaatgacacacattgttggaagtttcagaaattctaggtcaaaatggcactgaaatattaaggtatttaccccaacccaagcaacttttctaaaagttgtagagagtgtgacctctttattaattgaaacgtgaaaatcagctctagtttggaagctgagaaaaaatatatatatatgtatttatttctttgttgtttgaattcttaatataaatggtttaaaggaccattgaaaactgcatgcaatcacagaaggttttggcttcaggcagctcccgccatgatcttggggccccattgattctttcatctttcaggcgtcttactgtttgaaccttgaattttaacctgggacatgtttgactaaaatgatgctgttaatattttctgttgtgcaaaacacaaagagaactaggctccagggttgtttctatttgctaatgctgtttctgttgacttttgacttttctagtttcccagagctatggggacttcccatccggcgttcctggtcttaggctgtcttctcacaggtacggagcccagtcctctctgagttccttgtttgggtgtcttgtttttttaagctttgtgctgcatgggtttattaccagtactctgcatacacagtccaaaagagtgaaaagaaatagaaaactataggacgttatccagaatgaccacaaaccttcagttccctttgctgtattgcacttactccatttcaaaaggaatgctctccagtggcagttttagtacatatataatgttggcattgaaatgttgttagtaataatgtctaaatttacttactactctcttccttttcctaggacaaggcttctattagagctggattagataaattcaggaatggtcagctgtgggaggtggcacatctgttgtcccagccccttgagcagctgaggtgggatgatcccttaaggccaggagttcaaggttgcagtgcactgtgattatgcctgtgactagccaccacactccagcaacatagcaagacctcatttaaaaaaaatgttcaaaggaaataaataatagaaaattcttgcccaagaaatcatacttgtcttaaatcataactctcttgaggaaagatgcttacattgcttctaaatctcagagtcacctttatcttctctaggaatcaaattgatagatgaatgtttggctcttggaaaatcttaaaaactttcccaccaaaaggatcattggggtaatttgttgaagtgtgtattggactgtcttagttttcctccagatatttatgcactgcagatgttcgccatgaaaccagtgctcttctattctgaggagttagctcagcccgttagtgtctttgtcttacccatttggatatggtagaattgagcaagaccagagattcaacagttctaagctccactaagtataccccatctacagagtaataggtgatccagatgtacttacaaatcctatcttaacaagctttaggaattatagtggtcatatattgaagttgggtgggagtctcacaccaggttccaagggagattacaaatcactaattaataattaagtcataatatctcttctatcagtctcgggtttcttgttttctaagttctgtgctccatgggtttattatctgtactctgcttacacagtccaaaagagtgaaaagaaatagaaaactacaggacgttatccagaatgaccacaaaccttcagttcctttgctgcattgcacttactctattgcaaaaggagtaagtgcaatttcagtctaaataagcgagactgaaatttgagcttcgaagatgaacttagagttttcactcttgggttttacttaccaattgtgaattaaaatccgtatcatctggcaccactgcactccagcctgggtgacagagcaagactccatctcataaaaataaagaaataaataaacaaataaatccacatcatcctgctttggccctggaagtcatgagggagagacggcatgcccgagggctataagaaatggaagatgtggaattcttgagcacagatgtgctttgtgttttcttcagtctgtgtccttgcctccattcttattccatgtgggttttttttttttttttttttttttttttgagacagggtctctcgctctattgcccaggttggagtgcaaaggctgactgcaacctcaatcccctgggctccagtgatcctcccacctcagcctccaaagtagctaggactacaggtgtacaccagcacacctggctaatttttttatttttttatttttgggggagaccaggtctcactacgttgcccaggctggtctcgaactcctgagctcaagcgatcctcccacttccacctaacaaagtgctgggattatagacatgagcctttgcgccccagcctcttttttttttaactaaaggaaacctttgcagtgattgtgaaccataaagaacccatatgtgcttgagcccgtgccatcttgggatatttttatggttacacataagagtctgaaatatggaattggaatcagacatcctctgtctatttgagtgtttggaggggtgaatctagtggggcttggtggagctatttggaacatttgctgctctcagcagatgcagtggctgttataatgggggagctttcatgggcatccaggctaacggatttttgtgtagaaatggtcattgttcatctaagctgctactgttgcttctctcagttgtcgggatgagactgtcctttctgactgcatcctattcagagcgtgcttccttttgcagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccaggtgagttggctgggtctccaggaccaagcttcttctcttcctgtctctcctgttaaatgtactaaggttttaaacatatatataaataattaatatttattgcgggaagtttgaaaaatgtaagcgaacacacacaaaaatcatttgtaatattatcaagaaatattcattgttagcatttcagagctgtattaagtttggaaagtcatctttgttatgacatgtcctgtattgatactgtataaacaatctgaaatatactcatctctattcagttcattcaagttgcacacatactcacagtgtgtccagcactgggctaagtgttgagtacacaaaaattaataggtaagccctgtcttggagttgctgatagttcattataatatcttccaaataaacactcgatttttcagattcactatcaacatacatttattcttggagagttggaaggaattttctttttccttttaaaaaagttacatatatatatatatatatatatatatatatatattttttttttttttggtaacagggtctcactctgttgcccaggctggaatgcagtggcatgatcatcatagcttactgcaatctcaactcccttggttcaagcgattctcccacttcagcctccccagtagctgggattacaggcatgcaccaccacgcccagctaatttttatattagttgagacgggggtttcaccatattgaccaggctggtcttgaactcctgaccttaagtgatctgcctgcttcggcctcccaaaatgctgggattacaggcgtgagccactgtgccctaatttttatttttatttttgtagagatagggtttcactgtgttgcccaggctggtctcaaactcctgggctcaagtgatccacagccacctcagcctcccaaagttctgggattacaggcacgagccactgggcctggcctactcctgcattttaattaaaaggacaaaagggtcgagcacaagtgatggcaatttcagtatgcagttgggtaaattaaaaaggactatggctagaatccttggttttagaacaaaacctaaactgtttatgattcttgccatccttgctgttttggcataggtgtgtcttcctacctttctgccttttctttttcagtttttaatgggctcctcttcctaccctctataactacgagtgtccccagggatctagaccctctttactttttcatgatactcttattcatatgaaccttccttcttaacaattaaaaaaaaccaaaaactttgttttgaaaagggaaggtatttagaatgtcactccaacttcattcacacttagattccttcaggaaaatcctctaggtgtggagggattttcccctgctgtgaagagaatggtaggaacgtgaatgtgttaaaggcacacgagtccctgaagttttaatccgtgtaagattgtccaaaaattcttcttgttccagcacagatgccatccaagtagcccctgcatcgctgtctgactgagatctttttattcgcaatcatgcagacgtaggggccctttctgcagctgatgtttgagactgttagaacttcttaccaccgtagcttaagtagctgtttttcttttggaaaggaaattctcaggctccttctccttctttaaattttatgtatttctcaaaggattactttttaataaacagatttctatgctatttttgaatcatactgactataggtggtaagagtttttaaaagcatttcataataaaactcgaaatattttttcctgttttaaacagagttggactgtattattttattgttaatttttgtttttagttgtttaaattttgatttagattcctggttagtatttatttatttatttgtagagacagggtctctctatgttgcccaggctggtctcaaactcctgaacacaagcaaccctcccaccttggcttcccaaagtgctgggattacaggcatgagccacaactcctgtccagtattgatatttatcatcagtattatccatcaggagacaggcaatttggtattattcatacttaaaaatcactttgtagctgtcatgataactaatgccagtggggcaattcttctggatatatgtgtaaaggtgaacttcatacctaatatcaataatgccagtgggatagtttttctggatttatgtgtaaaggtgaaattaatgtctaatagagtcttcattcttttttaaaccacagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaaggtacttgtatcatctccttccttctttaaataagagtaacaggcaaaatcataaggtgcgtgtaggatttttttttttttttaaatcatcatcactggtgatcctaaattctgatttggggatttaggaccccagctaatacaatgtctgtggctataataataagcttaaaattactaaaggccaaagcttgattacccatgcaagatttcatgtttcatcagttgacttcaaaatactgtaaggaattcttttcttacataagcctcttactttcattcacattcctgactatggcggccctaaaaacaaacatacacccagggggttagatgcctagattaattttagtaacttaagaaaagtgatttgaagaaagtagtttagacttcaaccctttgatgtccacagttagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttcttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtggtaggtaccctcaaaacgtgcaatggcttggagcagagcaacagggctcagaagacctgcatttgagctcggtctgtcactgatgggcacatcactgagtttctctagaccttagcttcccacctctgggatgaacacatttgattaaatggcctttaggactccttgatcaatgggagagtttgaaatgatagttcctggaccaggcccttcagaatacataaagagtgtgccgtaagccttctttttcagaagtcagacagaaataggaaggttctctggctacaagatatcaaccaaaaaattagaagagcaaaaaaaccactggattttactattgcggagacagtgattgattctcatcgtcttggcttctgtgccctgaggtttgattcatctgatagtgttgattgcccgcaccccttcctcttctgccttgttggcacccaggacaatgtgtcttcctgttccacctcctatgtgcctgacctttgcatggctcaccttcagtgaaccgttatgatgtaatcattcagcaaaggtttaatgaagtttgctcaatcccaagcactgtaccagaagctggttcagtattgcaggaagaagggaggaggggagatggaagtggggaaggggagccaccatgctgcctcttggtcactggagatttacagagtctcagtcattctaatgcattgtcactaagtgtgtaagacagccatgtgtaagaggctatgaatgcccaaatgcaggaatgactaatattcttatggagaacaaaaacgagatatatatatttcttgcctccactcctgacttgtaaatttctgctccctgttcttttaggcatttgacagctttctgtccttctatccattgatctccctccttttatccgtttctctctcccatgcatttgccgctgcttttcatttgtcctggggcatctgataggaagttgggcattttcactattgcctcacaaacttcacacagtgaagggacatttacagtccaacaaatgtacatcttccctgaaatatgaagtgatttggttcttctgttcatacttgattgactttaatccttaacacataaacactgctttctatttataggagacagcaatttttttttccaaaccgaagtacatgctatttggcttacaaatatataatcaaagtattgtttcatacagtatgttttttccgattataaaagtaatgcaggtttattgcagaaactttgtaaaatatggagagacaaaggaaaggctacttcccagagcatcactgtttatattttagggagataaagcttttatttttcatttgtatttctttcttttttttttcttttttcttttttttttttgttgtggagatgaggatctcactacattgcccaggctggtctcaaactcctgggcttaagtgatcctcccaccttggcctttcaaagtgttgggattgattacacatgtgagcctctgagcttgactgagataaagctcttaagtatttcttatccatagataaacattgaataataggtgttattctttaaatggtaatttattacattctttatccttcagcagtatagcacaaacaccttatatgtgtcattaactgtccttttaaaaaatgggctgggtgtggtggctcatgcctgtaatcccagtactttgggaggctgaggcaggagagtcacttgaggccaggagtttgagatcagcctgggcaatgtatcaagactccgtctctacaaaaatttttaaaaattagccaggtgtggtggcatgagcctgtagccccagctactcaggagactgaggtgggaggatcacttgaacccaggaggttggggctgcagtgagccatgattgtgccactgcactccagcctgggcagcagagtgagattctgtctctaaaaaaattaaaaacaaaataaaaaatctcatgattttctaagcagctagcttttattctttaggttttatcttttagagcagttttaggtttacagcaaaattgagaggtacagagatttcccatgtgttccctacacccacacatgtgtagcctcccaccttgtcaacatccctaccatccatttgttataactgctgaacctccattgacacatccatatcatccagagtccatagtttatcttagagttcactcctaggagcgagctttttaaaagtcggttttcttccccttttgctgtagaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatggtacattccgctttctaaaatgtcagttgtccatgctgctcgggatccatatgtggtaatcattatttaatggaaactcttccctgtacagagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtaaagaaactctctgcccaagtatgcctttttttagtgtgcatcagaggcggactgaggtttgtgtgtgtcttacaacccagacccaaagtcagtctagaaaatgtaacaatctgagttaagagatgcttgaaatcacatccctttaatgataacattgcaaagtggtattagtatgctggtaagtatttaatgagaagatgagaagaaagaactaaaagctctggcccctggggaaagacaggtcactggattcagctagggtggaagaaaggaagtaaaattggactcaccaggattgaatagattgaatatattccctgatgttcatcatccatatcgcaagtagacagatatggtgattacacccatgaggcagttatcacatcaccttacgtgaaagttaacgtcataggcttaatctggaacccatttgccctaattgaggactccacaggaaagaagagtagagcctggctaatcaggagagagatgtgcagtgagttgcttggatccctaccttttaatcagaatggtagattgctctcatctcttaattggtggtggagttttgaatgagtcacccctcagccacagtttcctcatctacaatgtaggataaacaataccttatgtccttcaaggcaaggaattggatcagatgatatcatgaggcctcttaaggttttaagctgtgattagaacccaagagtcagaagatacatctcacagcacccagctaaccagccctatacttttgtcagaaatcatctcagaaagacaaagtcagtcctgtatttcaagccttcaggaggaagaacagagcctttctcatcagttccattcacctcaggatttgctttcttctttgtgaactaaattccacgtgtaattgagaagcaatgtctgagaaaatggaattttacagcctctatagaatagtaaaggaaaaatgaagtgggatactgaatctggaaggctttctgttgacacaaaatgaaggtgtacaacaaggagggcagctttccacgaggaacttccatgaggctgtgcagccagagaggaatagggtaacaaccctggtacagctaacacctccaacacgtgtgtgagcactgtctgcaagccataatccatagcagtggcaggacaggctcgccaactgagtggttctggaaagctgccttttccttttagtgattcaaggatgcttcaacgtggattttttagttcctgttatgagccagtgaatacaaagatgaacatggtagatgggggatctggcttcctggagcttaaaactccaggatgggggatctggctttcctggagcaagaaaaccagtggttttcttggccgaagaagtgaagagaacaaacagcagaggataatttggtaatcagcatcctagtgtgccccagggtactctcttaaggaaatccagtcctggagcacacccagtatggtccagcctgctgtcttcgtaggtctgagtgccccagtatttgcaaagtgttttggagcctatgaaatgctttcacacatacaaatctcctttaattaactctcacaatgactctgtgctatgtgtacaattatcacgttttacacacaaggaaactgaggcatggagcattgtaataatacccgagatcttctcactccatgaccaatgcttttcttctccattccagttgctttttcaactgtgatgatttataaaggacaatcaaatgggcacatactatatttatgcacatacatacacacacacacacacacacacacacacacaaccagatgtcatttataatccatgtaaaatatttttggggaagtttctctttaataaagtttgaagagacatatattttttttttttgaagaggcatattttttctaacttttttttttttttttgagatggagtcttgctctgtcacccaggctggagtgcagcggtacgatcacggctcactgcaacctccgcctcctgggttcaagcgattcttcagcttcagcctcctgagtagctgggattacaggcatgtgccaccatgcctggctaatttttttttttttgtatttttagtagagatgggggtttcaccatgtttgtgaggctggtctcgaactcctgacctcaagtgattcacctaccttggcctcccaaagtgctgggattacaggtgtgagtcatcacacccagcctataacttttttttaataggtgatagaatcccgtgcttgaaaaataatcaaacaaaaagagaatgcattgtaagaagcctcactgtactcctgtccccagctgcccagttctcccctcctccccacagggaaacatcttcattagtttcattaggttcttatgaaaccttccagagtttctttaagcaaaatacaagcaagtaggactgtcatatcctgcagaccgctacatacaaatacatagaaagtgtcctcattctatcctccagtgatattccattttttggctgaaccacctaaatgatggatatttaggggaagcaagtattttttaaaaaaggtaaaaatcaaaggtttttattttttatttttttaaagaaaagttggtaggctgtgtttattcattcagaagtcaggccgtggctgaactgatagctcttggagatggccattgctcatctctgaatgtctggttttctcttgtaagaattgtgtgtatgatccagaccttcagtgtgtgcactatatattgagaattccagaagagatgatatggacaagaaaaaaagatgactttactttttacagtaaaaataaaacttaaattgaagagtacaattgtttaaacaattggaacttacttagctactgcttgttgaaacaaaatcctttttttaaaaggtatcgaagcaaattaaagctgatccgtgctaaggaagaagacagtggccattatactattgtagctcaaaatgaagatgctgtgaagagctatacttttgaactgttaactcaaggtatgtaaagggagtataaagataatgctagctctgtagatgagtgtcttccaaggaaagcctggcacttttctccccggtcatggaagaaaagcagcacttaggggagaagcagtgtctgcatatgtcacatatcgggaatacctctgctggactcatgaattcaggtatttctgggaggttctgggttactctagagtaggcgaggaatccctaggctccaccagctagctttatttttgtagagatggagtcttgccatgttgctcaggctggtctcctgggttcaagctatcttcccaccttggcctctcaaagtactgggattacaggtgtgagccactgcacctggcctccaccagcttacttagcacctgcttctcaatctgagaagagagaagcagatgaccttagattgttctggagagttttgctacaagttttccttatagacattgtacagtggtccttaccagaagggagtgcccaagtctgtttacattcaggctcagcacctatccagagtcccagccatgagccaggtgctgtctgaggtgcgctcatgtgatcctcacagtaaaacctgtgatacaagcaacaccgtatatctaatttatttgaccacagatttagaaaagaatctttaaaacctaataacataccacagatgcattttggtaaatgctgctttagattatactttagctgaatccattagttgaatcctaagctataatataattttaagaacctccttgcctttcaagccaaataaccaagggactttctctctctctttccctccctcccttccttccttccttccttcttctctccctcccttgttatctcttttcctttcctttctctccttccttccctcttccctttttcctttctctccttccttccttccttgcttccttcttccctccctcctttgttctctcttttcctttcctttctctttttctttccttccttccttcctcactcactcttttcttttcctttctctccttccttccttccttcctccctccctcactctctcttttctttgcctttctctccttccttccttccttttcctccctccctccctcccttgttctcccttttccttccttccttctttcctttcttccttccttccctcttccctcactctctcttttcctttctctccttccttccttccttcattctcccctcccctcccccctcccctccccccccccctcccccctccccccctcccctccccttcccttcccttcccatttttcttctcaccatgttgcccaggcttgcctcaaactcctgggctcaagtgtttctcttccacctcagcctcccaagtagctggggctacatgtgtgaggcatcacaaccatggacttttcactttcttcactccaggttaaaaacatcacagggataaatctcaaaacaccaaaactgtgaaaatgctgctaaccatgtgggtctgtctaaactggagtgttacttgtacaactggtttcagcccctccggagtgttttgaatgccatgtagatgagttgtgaactcatattccactttgtagtctcatatgttctgggacacgagctattccattctgacttctttctgcctcttgcagttccttcatccattctggacttggtcgatgatcaccatggctcaactgggggacagacggtgaggtgcacagctgaaggcacgccgcttcctgatattgagtggatgatatgcaaagatattaagaagtatggaaaacagatgtgtcttcttctttcgtggtcagaatatttctcccttgacacaaatgatgtcaaatacattttacttattgactataagatagggttttgggtgtgatagcttcagggtgtgtatcttttgtcatgaatagctgtgagaagaaggtccagggctctcattagaccttcaaaatgtctccaatctaaaaacaagagtgaattttaagaaccactgttctaagaagatttttactaccctggctcacatatcttatttggtgaactttgtttggtagtcggactgcatgtaaacataaatgtgactgcttagtcccttatctgcccacctgctgtttggtgggttaattcgccattccctcctccctcccccgagtcctcagccttcttaaatgggcacatgagcaatgtgtttacacttcatccatggtaactggttgtgttcagaagcctcagttgtttcttcctctagacagagactcctcatcttaacttctagggctaagaacagacttggatgttgactggggtttctagtagattccagtgtggagcaggattctaggtcttataactcaatctgaggatcatcgcaaccctagtgacaccctaggggctcttcccagtgtgagtgttgagaagggagggctccaggcctttttgaaggggtgggagattgagatcattaaatatggttgaagttgaactgttcagtttgctcataggttcaagattggggaatggtagtcatattttattaaacttgattatctctgcctgctatgtaaacacttagctttcagttgttcatgtgtgagttattccctcttcagcacatgcagacaagttttaatgttcatctgcatgtaaaataaatcagtgtgtattgccccgaaatgcagacaaggtcccaactccttgccatcttagagtgttcccgtggctccactcattgccatgactctcaggaattggccctatacttaggccctttttctctctagatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccagtgagttcctcaacagtcaggacaactcatcagctgagccgcatctgccccaggcggaactttgaatcccagataggggtcatatagaaatgaaggtcccaaggcagaaattcagttacgaatgctcttaaaggcatgtgggactttgttttattttgttttgttttttgagacagagttttgctctgtggcccaggctggagtgcaatggcacaatattggctcactgcaacctctacctaggacgttgttttagattcagatccaaaactgcatttttgcagaggcccctcaacattttgcttgtctaataatatagctacagtctctactttgaatgtctgtgtatgtggatggagtgtggggaaggatcttctgtctcattgctccttaaaagatagatgaagccaaaagcaatataagcaaaatgcaacttacaaaataagctttataataaagcatatgaagtagaggtgtctgcccatatagtagctgtcaattgcatttatcctattcaaattctgtccacaaggttactgttggagcaactttggagaaaatactgagttctcctgattgaattttgtccccttcttgtataaggaaagagttgatgtagtttcctgggtgtagatggtttgagagatggtactgcctatccctaaaatgaaccaggcagccctcacacttccccaccagcagtgagagattcctggctcagacacagccacactaccttgctgcccctgtgcatgtctgccaggaaacttttcattgtgcctctctctcttgtcacgtagccctgcgttctgaactcacggtggctgctgcagtcctggtgctgttggtgattgtgatcatctcacttattgtcctggttgtcatttggaaacaggtagatattttctcataaaactaaagatctttgaagccaatgagaacaagcatagcaacctagttcagtgcttggcacagagaaggagctcagcaattacatgtggagtgaacgttgttggactctactgtgtccagtcactgtgctgcttcagtgaagctctggtgcactgggactttggtaattcaccagttacctgtcctggtcatttatagaaaccgaggtatgaaattcgctggagggtcattgaatcaatcagcccggatggacatgaatatatttatgtggacccgatgcagctgccttatgactcaagatgggagtttccaagagatggactagtgcttggtaagttccatggggtaacctcccaagactcccttttcccttgcacacaactttacaatttataggccttggcagaatagagatctgagcttgtgcttagtaagaactaggcaatggaaatttgctttcagaaatacatttctgtcttgacagtaagttaattggatcattgcaatgatttttttaaatctctttccataacaaattatagttaaggaaaattttacaaagggagaagagaatatgaagagggctggcaaagatacccaccaaaattgcttttctttagaaatgacacaaattgaaaatgaatttctgtgactaaaaatgagcagatgagaaatgaatgaggacaaccacaaaatgtattttgattcagtacattctgaagatgcattagatactcctttttacatatttggaatatggaatataaaaatataggtacattttgaggcaaaatatgtaaaaataagcaagccaacttatcacaagcatttcaagtatttcaatcctgggctgagaccaagtatatgaagctttagtccaagggagtatttcttttttaaatcacattcctaatgaatgaaagcaagacaaaggcaaatgaaagtagaggtagaggttgtgttatgatgaatgatctaacagtatatatgttaaagaatgccaaatgcaggttttaattatccaccggtctcattgcaaaatacagaagagtttaagtcttcttagagagttaggtaaactgaaatcaagcaaggcaccagagtgaaatcacctttgcaaaaattgtaactgaggaaattatgacagtgaatgagatatgacctaaccaactccattttgctttagcctccaagttgtccttgttccttcctgggcataggccgaactaactttgagaggaacttagtttatagtttgactttgaaaaaaagacaataatagccctttgccaaaacaaaccctctttttgcctgggaactagactgcctttgcgggactaacgaattagctacaagattagaaagtatggtttaggggtcactgttgtaaaacctgaggtcagtgcttgagatattttggagaccctgtatttcgatgcaccagctgacaccacccaggtcaataaactggctcatctgatcttggggcccctacctaggaactgactcagtgcaagaggacagcatcagctccctataatttcatctttgacccaaccaatcagcactccccttttcaccccctacccaccaaatcatccttaaaaaccccattcccccagtttcagagacactgatttgagtaatagcagaatagtagaaattcccccagtttcagagacactgattcgagtaatagtagtaatagtagaataggtctcccgtacagctggctctgtgtgaattaaaccctttttctattgcaattcccctgtcttggtaaatcggctctgtctaggcagcggacaaggagaatccatggggcggttataagagctgccccccaatttcaaatatttatatctaagctttctttattttcctgcctatttcccaacaagggatgaggagcttagggagttaaaaagtagtaaaatatggggaaaagggcataattcccattataccaagaggcattgctggtgaagcaatacctttccaggtacgattttcagtaacacagacgtgcagtaagaggcagtgttggctgttagtgtcttttatgagccaagtcttttcctggcttggctatccgtggtgagactgacaccccgggaaatgtttctctcagggtgagctctttcagggtgggacaacagcttcagtgtctttacgtatgtctcctcccaacatgaagctaattgctgtgctctcgggcatgtttagctcttggtagagtggctttcctaacaaatagggagcagtgagcccagcctgaagtttttatttagtcactccttagaatcagtgatattttgaatactgaagtatttccagtggctagtaatttactaagacaaaagatgcccctgtttgcatatggaaaacagaaggggagagagccaggaggtgtgggtgagagccccgaaggcaagaggatcccaggggctggcccagcacggagctggtagacagcgcgctcacaccagggagggctgcaccctcctttctcccgtctgtgttttctttcccttgcaagtgttattcgacaaaagcaattatgctaatttccttccctgtgggctcaattccttttttgacacgatgacttggaggagtcattatgattactccaaacaggaaagacactcgcccagctgtccgcccgcagagagctggctacggtgcagaaagctgaggaggcgtctggagtttttgggtgttaatgattctgcctgcccacaggtcgggtcttggggtctggagcgtttgggaaggtggttgaaggaacagcctatggattaagccggtcccaacctgtcatgaaagttgcagtgaagatgctaaaacgtaagtgctccttcctggggattttttgagcacggggattttttgagcatggggatattaagggaatttctcaaaatcatgcagctagtaaataagacatttaggactaggtcctgattattttgactccaggttttatgtgtatttagattaggtttatttagattgctcttgctgcctgtatgttggaaaattaagagcttgttatttccagtgacttctttttactagaaagaccaggaattagttattagcactgaggccaagtagctatttgcttcttttagacttctggtaaatagaatgatatccaatcacaggattagtcatattcttggtttttttctgagaacaggaagttggtagctcagctggactgatatgtgatttattctttcaacagccacggccagatccagtgaaaaacaagctctcatgtctgaactgaagataatgactcacctggggccacatttgaacattgtaaacttgctgggagcctgcaccaagtcaggtgggctcactgacctggagtgaggattttcactggacacatgtggttgtgaaaactgttcaatcaggcttaaatcctccactctccatccccacacatggcagggaatagaagtcccttgaatggagctgactggtcccttgaattgatggaagctcattggtttttgagcaaaatctgttgccagtccagtcatagccattcatggctctttattaaaaaaaaaaaaaaaaaaaaaaaaagcttttttggtatcttatttttttctgcgccatatggtctgcaggacaattcatggcttttctgttcttcattttcatacccatctcctaacggcttttgtccccataggccccatttacatcatcacagagtattgcttctatggagatttggtcaactatttgcataagaatagggatagcttcctgagccaccacccagagaagccaaagaaagagctggatatctttggattgaaccctgctgatgaaagcacacggaggtgggtgcaaagagagatgttgctgtctatcattatcttacaggcatcacaaatggaaagacccatgtcctgatagatatcatgtctgcagattcagtgcccaaggtagcaagacttagagtcaaaccaccctgtccagtctttccatggtcatgcagagagatgcatgatgtctaaaggtgttttggactggggtgtcacatgggaaggccttgctgataggtttgaatgagagtgagttagaatgactctgggagctcttctgctatttacatgtgatccacttagacctataaaatgcagctctggccagggatgcttgagttctggaaccttgcaagaactgtctgtggatctccaagctcgaggtccttgctgaacctggacctataaatgacgtcaatgatagtgatccctactgcagaaatctacaagtggctataaagaactctgtaggtaagaaattctgtaagatcagaaagtacaatgaattcacttcataataaattacttggtggacaccaaatgggtgctaaattgattgggtagaaggaattgtatgcccaagccacatgaccacacggctcaagttccaaccaaggcttgtgagttgaaaaactgagaaagaataatgacagacttaatgtagtgaattcttcaaactttaagtgtaatggacttacaggtccatgggagcacagccccactgtcttagatgtggctcttcaggatgtgcgggctcctgctaaagatgtgcagggaactggctctgaaaacaagtgaacagtagtcatcatggcagctgacatttgtggagtcctttgtatgtgccaggtgccatgacaaatattccgctagtctttcccatctttgtcagtgggatccattctacgtcttctgaaaagtgcttccttgacccccagatcaagtcattttccttacaagctattgaaacctttcttccttcacaacacagctgagtttgagttgatctgtgtatttattttgttttttacatttctttttttccctatttaaaaaatttttttatttccataggtttttggggaacaagtggtatttggttacatgagtaaattcttcagtggtgatttgtgagattttggtgcacccatcactggagcagtatacactgaacccagtttgtagtcttttatccctcacctgcctctcaatttttccccgagtccccaagtccattgtgtcattcttatgcctttgcatcctcatagcttagctctcacttatgagtgagaacgtacgatgtttggtttccatttctgagttacttcacttagaataatagtctctaatcccatccaggttgctgcaaaagccattaattcattcctttttatagctgagttacatatatatatatatatatgcacacctacacatacatatgtatagatacactgcagtttctttatccactccttgattgatgggcatttggggttggttccacattttttcaatatgtgaattgtgctgctataaacatgtgtgtgcaagtatctttttagtatgacttcctttcctctggtagatacccagtagtggaattgctgtgatgcatgtatttgtgcgactatttgattaatgctcatttccttgactagatcacctcatgtgaaaggtatggattggttttgcttttacccagttagctcccatgcctacctcagtacctggcacataatcatcatctactgaaagtggaatgaccacttcagaagggcaccctgggtaagatttctctttctgtttttacagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggtaaaagtgtctatactcactctgggtgttgggactttccagtggtttaatatgatacttaaagtatttagagggaagtgtatagggatggtaagtgaacctggcagcccacgtggtctctaaatgcaggtctgcacaaccagttctgtgacatgtttccaggtttgtggcctgtaaattgaaaagaataaaagctgacaatgtaacaaattttttaaactttaaatttaatagttttaaagaattttcttggtgtgttcctgcagtaaacattttaaaaaaaaaataattatttattctgatataatgaacttccttttttattgctgtctttttcttttttaatgaaaatatggtgattgattttttttaatgcccttacttggcagaattacaagttggctgtcttatgttggttcctcaccttgctttttttcccttaagttttagaagtctctgatgtctatgagttcagtaacccttgcttttacttttcctaacattcaatttgtgataggaactctagagtagataatttgcagttatattttctggaccagtgtttctgttgaatgtattttgaaggtgggtctatctgtttttcaagtacatgaatatgtggcagggttaaattgatttataaactccagggagtccagctgatgcccagaccagatggatcacttcacatctgctcagggtggttcctccagagccctgaactggtcacagacatgaagctggaagtctgacattggcttgtcctgtgagcttgcctttttgggtctgagccttcccattagtcaatgcaaaaaagtgttgagctgccctggacattgttttggaaattattgatgtgctctgaatgttttcaggttcttaagtgaaaggtacaatccatttaaaaaagaatgtgtttgttttgcaaagctcagtacacaatattttccatttctgcggttccaagttccattcacttctcattgccaaatgggtgaacttccaagcgcttttaaaagattagccagtgagagttatcggaaccagtacttcctctcccctcccatattgttaaaaatagtttacattgcttcccaggctgggctggtggagttggcacgagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgagaacttctggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaactactttttcatgtagcttgtatgtgtgctccatgtatttcatcatggaagattttagtgtgtgtttatgtgtatgtgtgttttaaaggtagctgagatgatttgctaattatggttgaaaaaaagaaatttaggaggtaaacaaaataattatgtgtaagattggtccttgtggctgtgtgtgtgttttgtgtgtgcgtgtatgtctctgtgtgttttaggctgttcttttattgctataaataaatacttgagactgggtaatttataagggaaagaggtttaattagttcatgattctgcaggctttacaggaatcaagatactggtagatctgctcagtttttggagaggcctcatgaagccatgaagtcatggcagaaggcaaagcagtgcaggcacatcacatggccagagcaagagcaagcgagagagagaaagagagaggtgccacacacttctaaacagtcagatcttacaagaagtcacttactattgcgaggacagcaccagaaggatggtgctaaattgttcgtaagaaatctgtccccatgatccattcatctgccaccagtccccacctccaatactggagattacaattcaacatgagatttgggtggggacacatattcaaactatatcatactgaccctggaccctcccaaatctcatgtccttctcacatttcaaaatacaatcatccctccacaatagtcccctcaagccttaactcattccagcatcaactcaaagtccaaagtcttatctgacacaaggcaggtcccttccacctatgagcctgtaaaataaagaacaagttatttactttcaagatacaatggggttataggcattgggtcaacattcccattcccaaagggagaaatcggccaaaagaaaggggctacaagccccacagaagttcagaacccagcagggctgaaaactccaaataaactccattgactccatatcccatatccagagcacactgatgcaaggggtggagctcttgggagggatggaacaccctgtggctttgcagggtttagcccctgcagctgctctcaggggctgttgtcgagtgcctgtggtttttcctggtgcagagtacaggctgttggtggatatattattcatggaggatggtggccctcccctcgtagcttcacgaggcagtgccccagtggagactctgtgtggggacttcaaccccacatttcccctctgcagtgccctagtagaggttctctgtgagggctccaatcctgcagcatgcttctgtctggacaccctggttttttaatatatactccgaaatctaggcagaggctcccaagcctcaactcttaacactctgtacacccacaggctaacaccacatggaagcggccaaggtttatggctgtcacaagctgaagcagcagcccaagctgcacctgaactcctttgagccacggctggagctggagtcatagggatgcagggagcagtgtctcgaggctgcacagggcagtggaccctggggctggcccatgagaccattcttccctcctaggcctctgggcctgtgatgggaggggctgccatgaaggtgtctgaaatgccttaaaggcctttttcccattgttttggcaatcagcctttgcctcctttttagttatgcaaatttctctagcaagtggttgcccagcagccctctttaattctctcccaaaaaagcttttactttctctgtcacatggccaagctacaaattttccaaccttttatgctctgcttcccttttactttttttttattttaaagagatggggtctcactatgttgtccaggctagtttgaactcttggactcaagcaatcctctcactcatcctcccaaagtgttgggattataggtgtgagccactgcgcccagcctctgcttctcttttaaatataagtttcaacttcaagtcatttctttgcttctgcatctgactgtaggctattggaagcagccaggccatatcgtgaacactttgctgcttagaaatttcttccaccagatatcctaggtcatcactctcaagttcaaacttccacatattcctagggcatggacataatgtggccaagttctttgctgaagcttaacaagggtgacctttactccagttcccaataagttcttcattttcatccgagaccttggcagcctggatttcattgtccatatcattatcagcattttggtcacaagcatttaaccagtctctaagaagttccaaactttccttcatcttcctgtcttcttctgagccctccaaactcttcttatctctgcctgttacccagttatctttacagcaattccccattccttgataccaattttctctattaggctgtttttgcattgctataaagaaatacctgagactgagtaatttataaagaaaagaggtttcattggcacatggattctgcaggctatacaggcatttgcttctggagaggcctcaggaagcttccaatcatggtggaaggtaaagggggagcaggcatatcacatggccagagcaggagcaagtgagagagagagagagagagagagagagagagagagaggtgccatacagttttaaacaggcagatcttgcaagaagtcactcacttttgcaaggatagcaccaaggggatggtgctaaaccatttgtgagaaattcacccccatgatccagtcacctcccaccaggccccacctccaatactggggattacacttcaacatgagatttgggtggggacacatatccaaactatatcattgcgtgtgtgtgtgtgtgtgtataatttttaaaccagatatatgtttctgcatatctctttcctttctttcattctttctttctttttttttttttttttttttgagacagagtctcactctgtcacccaggctgcagtgcagtggtgtgatctcggctcactgcaactcattgcaacctcctcctccctgattcaagcaattcccctgcctcagcctcctgagtagctgggattacaggcacatgccaccatgcctggctaatttttttgtattattagtagagatagggttttaccatgttggccagactggtctcaaacttctgacctcaggcaatccacccacctcggcctcccaaagtgctgggattataggcataagccaccatgcctggcctatatatctattttctaagatagaatctttgcatagtgatattcatctgtgagatctaaacattctacaaaaaaattaagaaaatatttttggatgtgttctttgggcatgcctctgcaacctgatgatttcctgctgcctgccagcaccaatacatttaatttcttttctgcagactcagaagtcaaaaacctcctttcagatgataactcagaaggccttactttattggatttgttgagcttcacctatcaagttgcccgaggaatggagtttttggcttcaaaaaatgtaagttcaaggaacacagacctttttagacccagatttcagtgagtggagtgtggaaggagatgctaggagatagatgttggaaaggccattaataacaggggcctcttacttacctgtctctctccttcatcccctacgcaggtcagggagtctgaaatcatcaggcatctactcttctctagagctttctctctgttgggagtgggtggagtgagaacctgggagaaggccagccctttatatccaggcagacagctccaagtgccaccatggatcagccagtcttgcaggggtgatgctatatcagctacagatggcttgatcctgagtcatttcttccttttccatgcagtgtgtccaccgtgatctggctgctcgcaacgtcctcctggcacaaggaaaaattgtgaagatctgtgactttggcctggccagagacatcatgcatgattcgaactatgtgtcgaaaggcagtgtacgtcctcacttccctcactggtcaggctcatcctccttcactttaatctctaaagtcaggtgttgcttctagagattcggtgcctgttttttaaaacatcaatagatttcaaggggtcagtacactgccttggcagcagattgcccaggtgtgagtgccagctccaccacttacttaatttggatttggggctagatacttgactgttctgcccctctgtctccctgattgtagtgggaggtgataatagtacctatttgctgagttgctatggggattaaatcaatgaattcatgtaaagtgcttaggacagtgcctggcatatagaaacagcactcaataatgttagctattttatttatttatttatttatttatttatttatttatttattttctttttttttgagacagagtctcactctgtcacccaggctggagtgcagtggcgcaatcttggctcactgcaaacttctgcctcccaggttgaagcaattctcctgccttagcctcccgagtaggtgggattacaggcatgcaccaccatgttcagctaatttttgtatttttagtagagacagggtttcaccatgttgcccagactggtctcgaactcctggcctcaagtgatctacctgcctcagcctcccaaagtgctgggatgacaggtgtgagccactgcatctggcaagtgttagctattaatatgtcaattgcgtgtatgcatggacaagcatgcattcccaaggatggtgtctttatattttaagcttttatcagattttcaaaagccatctgtgacccctaaaatagattggaaccatttgggtttatgtatcttggaggcacagtttccttaaagatactcattttgttgtctacttgaaccattcttcccatcccttccacttctcagcagatgacatagctccctgtggggatatatctgctccctgtaggtacaattccaaatcacctcactgcactggatgtgagacagcttatggcagctgctgcttccacctagagaaagacatgggcctgcatccatgctgtgtgtgattcatgtactcatgtggccgtgatagctgtaatcggctcatagatcattggatctgttcttagttttgttcccaggaatatctaaaaataggaaactggtccattcagggcttacaccttttgggtgaaaattcaggattaatgtttttggatattattcctttggaggacataaaaggcaatattgaccattcatcattcatctagtatttattgagcacctactatgtgccagggactgagagttcagtaatgaacaaaacacatgtaaaagacactcaaatgggacaagataattagcacaagttattaagagcccaaggggaacccttttctatttccactgctgtggatcatcagtgagtagacatgggtttaactgtctccctccttccttgcagacctttctgcccgtgaagtggatggctcctgagagcatctttgacaacctctacaccacactgagtgatgtctggtcttatggcattctgctctgggagatcttttcccttggtatgggcctgacattgctgcttatttgggctgttctgaaacaccactggaaggaaaatgtgttctttcaagccccaggatgtagacagtgttaagataacctggtgtgaggccagtatgctgcagccgcctcaaaccacatgttgtgccttattgtgtctgagataggcccatgcaggtggagatgggggtttttgttgggggttgcgtctcactcctggcctctgcccctcctctcctttgggctatgccagagtgacttcctcccactggaagtggtcccaatgacattcgcatcccagctgctttttcattttgggctttgggtcacatgggttcacccatggagagtgggccctccctcacctggtggcgattgatgctcaggtgaaaaggggtacgtggcgggaagggcagggctctcattcctggttgtcattggccagtcttgacaacccaggtgctgaacaacccaggtgccctgggctatccggtgaggtccctaagagaaggatgagccataaccctgacatctggatggttcatctggggagatgagacttacacacttagggataaacagtgtgctgctgatttaaaattgtaatttgagtcttgagtaaagagaaaggagtcctggaatagtgtgggaaggcttcagagagggaacttaacttgacctggccttggctttgaaagtgtgaaatgtttcatgaatttatctgtgatcaggatgtaatagtaaagtgtgtcttcctgccccgtctcctttttcatcctagttctccctccatggatgatcacaatggatcatccccgagtggcttaatggagtcctgtactcccttaaaagcagagaggccacaactttgatttttgctttagctatttgaacatacctggtgaaaaagactctctgggttttaatgattcagaatttctccttgcttttctagttcattttgtctgtgttgatccagtagtcatacacattgaaaaacacttgaacgcttatttctaaagatgtagaatttttgtgatggtacttggacttgaccaacctggagtcctaattaaacttaaggtttgagctggtctctgaagtcaaggagatgatgacactgaattttcttgaaaaaaccagtgcttcaaggctataggatctgaaaggttttctaacagtgttctatcatgccaagtgtttcagcaatgcactgagcgtttgttagtcctggtgttttattgtttggcttttaggtggcaccccttaccccggcatgatggtggattctactttctacaataagatcaagagtgggtaccggatggccaagcctgaccacgctaccagtgaagtgtgagctccttccccatcccgggggcctgtgttcacagtctgtgggtctagggggagggaggggccctgagacttccccctgtgcccactcttgagttctgtccccacagctacgagatcatggtgaaatgctggaacagtgagccggagaagagaccctccttttaccacctgagtgagattgtggagaatctgctgcctggacaatataaaaaggtgtgtttggatctgtgggtggaaaggtctggataaagctggaagttataccagtgagctgtgctgttccgcagttctagaggagcattttcaaaagaggcaaaagactgtgtgatccagtggctgggcttcatggcggtgctccacgagaccctagtagcaatgatgaatgaaaaccctccccttcccgtggggctttcctttcatcttatatgtgcagtacctgtaagcactattctccagatgtttgagtatcagaagttagtgtgcagttagaagactcagggcatccatggccattacatcactaatttgagtgcacttaaatccatgcgaaattggcttttaccagcggactggaaggaacaacctcagctgttatctgtggcaccagctggttttttgtggaataggaagcattgttcaaaggaacaaatgtaatttcttggaaccaggcaggatatgtaaatgaatgaaacaactttctgctgaggtgttgagaggaaaactcagacataacctcagtttcttagattgagattagtccctgtgtagactttttatacttatcatttttcttccttcttctcaaggaggaatagtgttaggagattgtgtgccgaactggaagttaaatgcttctgtctgttaattatctcactgcccactacaactttcacaggtgaggcagtgaggaggcagaaggaaattaaccctcagttggtcaaagatgctctgactggtggaaatgtgttggtgggaagagattgaagttattgttgaaaatagggtcttttcacatccaatgtgagacctctccaatgtttaaggatcatgaaggctttgggtattatccacccaatagaaggcctcactgcctctctatgggacccatccaagccctggaaaggcaacgtgatggggaccagaaggattctcagttgtagctactgacttggagaaggggctactggtatcttagcacctaatggcagaagctctttaccattggtggccccttcttcatgttctatgtctctggggatagttgacatgactctccttcaactaagtcccacatcttccaggtagtttggaaatatgtacagttaaataatggtaagttctgagtgtctctattcatttttgaggtttggttgttaacacttgattaaatatgttcaatgaatgtttatagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacaggtagctgtgggggcagcctcggtgtctcacctttcccctcccctataggccctgaaggagaggacccattttcccgataatggtgcactcccggttggtaaatatgtactcagggacaagttgcagaatcctcaggaggtccacgtggttttgaaaatgcttcccagatgattctaatatgttccccctggggctgggagagggatgtgcatgttgtggggagagggacatgcttccctggtggagaatctttgagctaaattctcaggtaatttgatcaaattgatacagaactgtgattactgagatcatataagcctctcctgccattgtcttaaatagtcattgaactggggaaaaagtgaagagaggcgggactgggtcctttgacgctataccctacctgtgaatttgaatcacctgcagagatttaaaaactgctgatctacaagcctcacccaaaacaacaaattagaatccctgggggtggtggccaactgctccctggctgatttgtttcttctttcttttaaattttgtattatggaagatttctaacgtgtgcacaattcacatagtatagtgagctgttcagtattcgtcacccagcttcaatgactatgccctctgccagcctggatgcacacatggccatgtctgtctctcctcagcctcctctggattgtttggaagcaaatcctagacaccttatcatttcacccataaatattccagtgtgtgtctcttaaagataagggctctattttaaagaagaacaacagttattaaaaataactacaatgccgttatctcacccaaaacagggacaataaatcgttaaggcatcaggcagccagttaaagttcaaattatctcacaaatattatcatactccattaaaaagtgggcagaggacataagcagacacttttcaaaagaagacatacctgcagccaacaagcatatgaaaaaaatgctcaacatcactgatcactagagaaatgcaaatcagaaccgtgatgagataccatctcacaccagacagaatggttattattaaaaagtcaaaaaataacagatgctggtgaggttgtggagaaaaggggaagcgtatacactgcttgttgaagtgcaaattagttcagctattgtggaaagcagtgtggtgatttctcaaagaacttttaacagaattaccattggatccagcaatcccattactgggtatataaccaaaggaatataaatcattctaccataaagacatgcatacgtatgttcactgcagcactattcaacgatagcaaagacatggaatcatcctaaatgcccattgacagtagactggataaagaacatctggcacatatacaccatggaatactatgtgttgataaaaaagaacaagatctgagataccatctcccaccagtcagaatggctattatttaaaagtcaaaaagcaacagattgtggcgaggttgtggagaaaaagaaacacttttacaatgttggttggagtgtaaattagttcaaccattgtggaagacagtgtggcgattccccaaagacctagaggcagaaatactgtttgacccatcaatcccattactgagtatatacccagagtgatgtaaatcattctattataaaggcacatgaatgtgtatgttcactgctgcactgttcacaatagcaaaatcatggaatcaacctaaatgcccatcaatgatagactggataaagaaaatgtgatacatatacaccatggaatacgatgcagccgtaaaaaggaatgagatcatgtcctttgcagggacatggatggagctggaagccgttaccgtcagcaaactaacacaggaacagaaaaccaaacaccacatgttctcacttataagtgggagctgaacgatgaggacacatggacacatggagggaaacaacacacactggagcctttcaggggttggggattgggtggaacatcaggaagaatagctaatggatactgggcataatacctgggtgatgggatgatctgtgcggcaaaccaccatgacgcatgtttacccatgtaacaaacctgcacatcctgcatatgtacccctgaacttaaaaagtggaaaatacaaaaatgaaattaaaaaaagaacaagatcatgtcctttgcagcaacgtggatggagccggaggtcactatccttagcaaactaatacgggaacagaagaccagataccgcatgttctcacttataagtgggagctaaaacaacgagaacacatggacacaaagaggggaacaacagacaccagggcatagttgagggtgcagggtgggagaaggaagaggatcagaaaaaatacctatcggatactgtgcttattatttgggtgatgaaataatctgtacatcaaaccgccatgacatgtgatttatccatgtaacctgcacacgtgcccttgaacataaaataaaagttaaaaaaaaattatcatacacttgttttgttctgtctgagatccagataagagtcacacattgcacttggttgctatgtctctgtaagttcactatgcctctattttttgccctcttacatattatttgtgaagaaaccatagtgtttgcctgtggagttcccacaatcggcattttgctgattacatccttgaagtgtccttctcaggtgcttctgtcttctctatgtgttgtaaactggtagttagtctaggaacttaacctgactcaggttagatctttggcaaacatgcttcatagatggttctgtgtgcttctgtcaagaggtatgcactgtccagttgtctgccttttgtaacattatcagtcattgggtgatcattacctagaatttcttttttttttttttttttttgagatggagtctcgctctgtcacccaggctggagtgcagtggtgtgatctcagcttactgtaacctccacctcctgagttcaagccattctcatacctccgcctcctgagtagctgggattacaggcacatgccaccatgcccagctaatttttgtatttttagtagaaatggggtttcagcatgttggccaggctggttttgaactcctgacctcaagtgatctgccggtctcggcctcccaaggtgctgggattataggcatgaaccacctcacctggcctagattctttaactcagcaccaaggtggagctaatgcccaggcaggactgagaatcactggttgacgtggtcagatggaggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgtgtgtgttttcctcttctttcccatcagaacattattttggaggcttatgactgtgacctttgttaaccaatttaggtataatatgtagacagcccttgtttatttgtatggactgggtaattttgaaagtatggcttttctattttgttttagaatatgttatgtgatttgaagatgggacacagtggcccatcagtcttcggttttttattatgctttgctcaggccagtttttataacgtgtttatatctcttgagcatacggtgttcctccaagttttgggggtctgcgatggaacttcacgggggtcggggaaggctgggcagtgaatctagggctctctgtctcagatcctttctcaatttggttactttgtgtttgtgggctctgaataatatttgagttgtaagagggttctgcttttatataaagttagaaagtcacattggaataaataacatgagaaaggtgcccagaagttttctagggctacaacaggctgagctgcagaatttgacacgccaggaattgaactttctcagttgaagttcacgttcaagttaagtaacttgtgtggcatcacacagctagtaagtggggggaccattccagacctaaggctttctgactccagaactcccctttcagccacttctctagtacgtaaggagccgtcacctgggccctcaagttgggggttggtgggggggcatttgatgtcaagagagaggggaagagggcattccaggcaagtggcaggagatcctgagaacacagtttggatgctcaggaggcttccgggagagcacctgatgggcctggctgcagcttgcaccctgatgggcctgacttcaccccctgctctgccttcccaggcctttggatcaggcattgcttatgttctcttccactaggattgagtagggaaagtagaaattcttgcagcttgtcagtaactttgatgaaagacccagcagaaaagcaggaaagctgaagagtaaaaatgatgggtggaccttggttttccacgtggcctaccacagcatgtcaggcctgggggcagaatcttgccatactgtgcagcccaaatttgaatgccaaaggctttcgtttgtctctggggggccacagtctaggtctagttctgtgtaggagttgtaatatttgctcttctctccctcctccagctcgcagacctctgaagagagtgccattgagacgggttccagcagttccaccttcatcaagagagaggacgagaccattgaagacatcgacatgatggacgacatcggcatagactcttcagacctggtggaagacagcttcctgtaactggcggattcgaggggttccttccacttctggggccacctctggatcccgttcagaaaaccactttattgcaatgcggaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaatcaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagtttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggaattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcag

SEQ ID NO: 13440 - DNA, 18650 bp, Human
cagaatacatacagaaggaaagaaattgccgcagaagagtctgagatgtaaaaaaatgatctggcagaacgtggacacaaattctaccaaaaattatccataaatacttttgcataattaagtaaccggtcaatgaaaagggacataaaccaggaaaaggcagcgaaaaacaagaaacataaacttaagactcctctgtggttatgacatgactagggtaaaaatcataggtctagaaaagttaggagtagaaggtttgaatcccatttgagtgatttagcttctcaaggattttcctcctttataaaatgatacagcattacttcagtgttataaatgcaaatagttaacatgtgttaagctacataaatacaggggattgaaaacatgaactctgaagtcttcagcctggattcaaattctcgctccatcactatgaacctgtgtgactcttgataataaggtacttaacttttggatgccaagttttccatctgaaagtggggatcataataatctacttcatagggttgtggtgataagtaaaacatgaaaatggcttaaaacagtgcctaacactgaacaagcactcaataaatattaattactgttattgtgttgttattaacaacaggcataaacaacttaggagctggtttcttaaatcaagaaacaggtacttatgtggaaatttggacagaaaagctctgtcttagggtatccactgccatccttcaaaaatggcagataggtatgaagttcgcaagagtgaaaaggtggcctgtaatagaccagctcgttagtagatctgacagagtgaacataccttacccattctacttctgctactcttgtgggaggtaactagagagaaaggaaaaagtcttggctcttgaaactgtttcctcagaagaatttgtactataaagaagtatttctcatctgctacagcaaaaacgaaacattctaagcacatattttagtataggtgctgcttctataaatactgactatgggtcagagaatccgatctagacctggttctaatccttgtgtggccttagccttcaacatgcacagagtacaaagaggttcttgaatgacagggtctctaaggcatttccaactctgacattcatattcaattacagacaagtttctttccttggtaatggttgtagaaaattactaacattttactaaaatacagttcagtaggacttctgttagaagaacaaacctgctgaattatctataagctcagagtacatataattacagttcaggaaatataattacccacaatgactgtgagcattctatcattctaaaacctgtcactaatcccaaaaggagatgctataaaaataaaaagcatgtgatgctaaaactatctgggtttagatttccctaaaatctttaactttattgaacattttaatgaagatgacataatttattacagaggatcaatttaattggaattgcatggtatgaatctaaaacattggctagtaaagtcacctggtaattttaatactagttaggcaagaatgttttaattaatgccttacaaacactgtgtaccattttcatagtcttaaggcagtgagctttttaaaggtaagaaagctatcttatcagggtctcaaaagcctcaacagcactagcagcgtatctttgcacagagtagacactgaccaaaatctgctcaataaactggggaacaaaaaggattacaataaggtggtagctggaagagttattctctgaaacctaatctttaaacaaatgccaaagtattacaacttaatattaaatttaagaaattaataaagttaattctagcctaatctattaacaccaataaatattcagtttttccctcagatagtttttaagattactgactttaacatagattaatatgaattctttttgctttttctccttcactgatttgtttttcaaaagacatcattttacaacctcatttcaaaatgaagacttttacctggaccctaggtgtgctattcttcctactagtggacactggacattgcagaggtggacaattcaaaattaaaaaaataaaccagagaagataccctcgtgccacagatggtaaagaggaagcaaagaaatgtgcatacacattcctggtacctgaacaaagaataacagggccaatctgtgtcaacaccaaggggcaagatgcaagtaccattaaagacatgatcaccaggatggaccttgaaaacctgaaggatgtgctctccaggcagaagcgggagatagatgttctgcaactggtggtggatgtagatggaaacattgtgaatgaggtaaagctgctgagaaaggaaagccgtaacatgaactctcgtgttactcaactctatatgcaattattacatgagattatccgtaagagggataattcacttgaactttcccaactggaaaacaaaatcctcaatgtcaccacagaaatgttgaagatggcaacaagatacagggaactagaggtgaaatacgcttccttgactgatcttgtcaataaccaatctgtgatgatcactttgttggaagaacagtgcttgaggatattttcccgacaagacacccatgtgtctcccccacttgtccaggtggtgccacaacatattcctaacagccaacagtatactcctggtctgctgggaggtaacgagattcagagggatccaggttatcccagagatttaatgccaccacctgatctggcaacttctcccaccaaaagccctttcaagataccaccggtaactttcatcaatgaaggtgagttacctcttactgtaaaaagtgggagtatgaggtttatatttttatgccttatgaaacaatgctcataataaatgcttattcattttgcgatgttatatatgtacattaaaatttctattgttttttattaatatcaagaattgaacttaaatacatctcctcttccagctctgaagttccaggagtttataaaaacttaatgtattctgtgaaaaaaaccagtcttccatccaaattcttatgatcgaggggctactattcttgagacaggaataagtacatgctccactccgaaccactcctgtgcaccataaccatcctatcagcttctagctaggtcgtcgctgctacccgacaattcttttatttacttcctgctgcttgtacatcatcttcttcaaaagaaacatgtaaaattttgctttcactctcttcaagctgtaattacacctcattatctccactctcagcagatgactcaactactactatactgagtaagtctaatcaggtcctgggttttgttctttcttatcttgaaagcatctgtacaaaagccatgccttcttgccgtcagcctcaagaaaaggtatccctcctattttccaaggctaaacaattagtactgtgtatcctaagaaatataaatgttcattattataaaaaaaaactattgcattgatcatgcatgattccaaactctacttttaaatttcatttctttctctcttcatgcattcaatgtcagtcactgatctaggtgtccagaaagcaaagatgaataattcatctttgtttcagtttactaaacccactgctaactttctgaattcagtattttatgtttattttacacttgcatccattttctcacaactcattccccagaatcctttacaagctgatttgcttccttagagtggaagggaaaacccaaatgccccaaagcaacgagtaaataaattgcagctcattcacttattgaaaaggcaggacataaaacatatactatgaaataattttaaacaataacaataaaaacacagactaaagactagaaagaaatatatcatgaagtggtttcatctctctgtcagtgaataccacttcgctattcacagccctgctttcctggccttctacattttaatattcttccttcacttcctatttctttaggtccttcactggcatcttcttccttctatgccttaaagtctttcttcaagatattctactttagagtattttggcttcaagtatcaccactgctcagatgattcctgaatgtagctctccctcctgatttaaccaaagctagacgtttgcatttggatatttcaccattacctcacatgctactgctttctttactgaaacaccttctttcagcttatctgtcgtcaatttagcagatctcaaggcttaactcaaataatacctctgatgttatgacttcctagattcaaacaaacacacctaggtggctttttccccaaatcactgactatttcttaaacatgttttctatatgatattacactgaagttatttatttatatgtctgtctccttgctggtctgaatgcttctggaagacagttaactgtcttttcaccatttgatctcaacatctctgttttgattaatgttgtcatccatttccaaataagcttggctcatctttgatacttccccagctgccccatacacagtccactgaattctactcatgtcccctttttggtctcttgtgtgcatgtccctcatttctattcagagccagaactcttgtttagattcaaatgatccacagcagcagctagaagacagagactccataggctaccagctgtgtgatcttaggggaaagaaaattatctgtgcctcagtttccttacctgtgaaatgggaataacagtatttactgcataagatttaacaattgaagagtgcttagaacagtgcctggcactcaaatgttagttcttactatgaactgtgtaatagcttgccaactggtgtaactctgttttctctctccatcaaaatatatttacattgccagcagattcatcttcttaaactactcacatatctgcttctgcaaacagaaaaagtccaatttgcttagtctggctaagaataatgtcctcctaaagaatgaagcctactttcctagcggaccttccactagtttccttcacaaaaaccatctgttccaataaaacaaattcactcattttcccctaaatattttcatgctttctgcctactcaaagaataaggctcaagccaaaccaaccaaccaaccaaccaaataaataaataaataaataaataaataaataaataaaaaaaatgcaactcctccttgaggcccttgttgacgcctacaggtttgaagtgatcgttcctctccatgaatacctctactctctgtaacatacataagacattttgtatagtccctcttaaattatcaattatctttacatacactcagaatacatctaactaagaggctttccaactatattataagctccttcctggtagatggttacagtgtcttacctgcagttgctaaatatgtgttagttgatttggtgacatttttatagagcttcttaaaattgtcattccaaagaccctcatgaaagtaatttaatacgttatatcatattggatttgttcattttatactgttctaagttacagtagcaataggccagagtatcattaaattaagtaaatgattatcattattaatatcctcgccgggcatggtggctcatgcctgtaatctcaacactttcggaggccgaggcagacggatcacttgaggtcaggagtttgagaccagcctggccaacatggtgaaaccccgtctctactaaaaatacaaaaaagtattgggcatggtggtgcgtgcctgtaatcctagctattcaggaggctgaggcaggagaatcacttgaacctggggggcggaggttgcagtgagccgagatcgcaccactgcactccagcctgggcaacagagtgagactcaaacaacaacaacaactacaacaacaacaaacaaacctcaatccctttgatttccaaaggaaaatgcagtgtataaagtgacccactgggtatagaaataaaaaacagaaaaaaaattgcttttgatatcctttaaaaattttgttttatgtaagcttttatataatttatcagtagtttgtatacgtaagttataaataaacataattgagctgtgtgaatttttttaactgatgaggtatacaattatgtaagtatgaagacaactgccatggagtattctatgtgatccctgaagcttgagtggatggtataaccaattctagcagaaatcactattcacatttttaaacactgacaaacttttctaagaaaatgtttatacaaaatgaaacataccaattctatgttttattatacacttagcattagtacaaaaaaaaaaacccacgaatgctacagaattaaacctcatattagggatttagtatgtcaaaagtcctcttaaacacattttgttttaatgaaaacatggtgtacctatccccagtgaaactttctttaacacaaaaattaagggcagataactttttctgttattcattatttgttttatgtaaacattaactttttacttattttattctataaatgtggatctcttaaattcaaagggataatctgctagaccataagaattactatactaattagtacattaatgaacatataagggaaagagcatggaattaagaacacctggttctaccactacctttgttatgtgaccttgggtaagtcactgccagtttgtgttttctcatttgtataatgagagtgctggactggattattctaatatccttttcaaattctaatattctgtgatgcttactaaattaaattactacaagcaacaacaaataggctggctattttccttacacaatgtgctcaattattcacttatgttatttttacatctgtctggaaaaaaatgtctcaggctgtttaggtgcttgcacaaaaagggtaaagatggatggctactggtgtacttatgtatgctctggcaccaagaaattcctattactgtactttacatggaggtacatggtcattctaaagtctccacatgcataaggtgaaaatatacaacaatgtatattttaagaggtgtttagccagttacaaaagataaacactgtatgagactctacttatatgaagtatttagagtggtcaaattcatagacagaaagtagaattgtggctgccagatgttaggcggagggtgaatggggagttgtttaatggttatttaatagttacagttttgcaagatgaagagttctggagaaggatggtggtgatggctgtacaatataaatgttcttaatgccaataaactgtacatttaaaaatggtgaagacagtaattatgcatatcacattttataaaagatgttatgacaatcttttattttctttaaaaatggttataagaaaaatctacctcaaaaaacccatgaagttataaaaaatagtatttagataaaaaacatttttcaaacacattaccttcttctctaccttaaaaacaaaatgtttgagaatgtaataatacacctgacaagctgcaatcaatgaaattcttaactattaatgttatttggtgcctgcattttgggttagtcttttattaaaaaaaattactcttttacaaatagcgtatttataaaaacaagtttattccttgtaggagagctgagtggagaaagttccttcaccatgtgtaaaagcatagatctgagtatcagtaaacttggattctggcaaagctttctggggtccagttgcctcttttgtaaaataaattgttgtgatgattaaatgagggggtacaggtagaagtgctttgtgtagccgagacgggtggatcacgaggtcaggagatcgagaccatcctggctaacatggcgaaaccccgtctctaccaaaaatacaaaaaaattagccaggcgtggtggcgggcgcctgtagtcccagctacttgggcggttgggggggggggggcgggcagaggcaggagaatggcatgaacccgggaggcagagcttgcagtgagccgagatcgcgacactgcactccagcctggcgacagagcgagactccgtctcaaaaaaaaaaaaaaaaaaaaagtgcttcgtgtatgatgtggcatggtttgaccaccattaatcattgcatattttgtacacttccctttatgtgtctttccttgtcatattaggtatatgaggacataaatggtaagcttaaaaagttaaaacttcgtagtggcgggcgcctgtaatcccagctacttgggaggctgaggcaggaaaattgcttgaactcgggaggcggaggttgcagtgagccgagatcgtgacactgcactccagcctggcgacagagcgagactccgtctcaaaaaaaaaaaaaaaaaaaaagttaaacttggaaagtagtcattagaaactaaaaatatgctttttagtggtaggcttattttaaatcaccaaatatttacatttttcaaattatttataatgcttcttaatatactttttaggtataattggtttcaatggaatacttatactaacatttaatacaaaacaaaaaaactagttaagccaaggtgctgttggaaaatgactgtattagccagttatgagaacgtaattgataaattctttaataattaaaagtttgggttgctaaatacagtttaaacatacagattaataaactaagtaattcatattattacagaaagaccctactgtcacttcagaaagtatttgtctcaaacttcccactccagaaatgttgaatatatttaactgaaagttaatgcacaacccaactgaaaagtttacctctcaaaagatcctacttggtaaccaataatttgaaagctctgaattggtttactgtttctcctgtcataaaaaggattctctttgtaatctgtaattctctttgtaaaagctctttttacagaaaaagaacacatatgttacagatggctcccagtaaagctgctattcaaagtgtgaaatccttttttcttttttaactcactgttctattcaaaatatgggttcttaataaatacaccttgggaaataatgtggcatgactggtcaacatttttctttctataaatcagaggtattaatatggtttcattagccctatgtaaactttaatcctcacataaattgaggaacagagagactggttcttcaaattcaatgtacagaattccagttgcctgctttgagaagactcttgcaaaaaatagttgatactatgcttagtttaaaagaaaggtaattccagtttataccttttgaatcatcatgaacaaattcctgattcacagatcaatcaatttatttctgaaaatatgcaaacctgtgaattaaatctggcttctcaagaataaagcttaaaattttctatttgtcattaatttctttcaagcaatgttctttatggtacagaaaaagcagtgaaaacatttaagatagggacaatagagaatctaattttagggcagaaagtaaatacgattttcaagtaataatgagaaaatatttctgctaggatcaacaatatacactggactaagacaggttaatggtatgtttataaaaataaatacaaataaatattgaattctgatatctaatatctttactgaggagaaaaaaatagctttaggcactgctaaattttatccatatgttctggaaaagaacttcaactacatttccctaagtctaacagatatccaactgtaaacacaaagcccgctgcaaaacatgggttgaaaattaaagctgaagataatcttaaatttgcataattgaagtcttatgaaatcaaagctggattcagaaaaccagaactctccattttgctttaaacatctgagtgtctattaaatagcaaaaaatgagtatagctctatggaacaaatgatacttgacaaatattctgtcaacattcagaacactgatgtttctaaatattctgcagcaaagcaaataacctaataaaagtccaacctttgaatatatacttaaatgtaaactgtcaaaactatactcaaatgaatgcagagtaaacatttacgaaaatgatattcatagaataagcaataagcataacatttacagaatatgcaaatttataaaatgagataaatatatatatgttgtaacaaaactactttcatgtgtgcattaactataatactaataggttttaaagtaagagcaatgctcctcagatatctcagctagttcttagactttgctaccatgtgcgctacataactccatcaaagtacttgtcatattatagtggaattctctctttcttgtgacttctcccaccccccacttgactctaaggttgtttctttatcccttgagcctaaaacagtccttagcctgtagtagatgcagaaaagacatttcttgaaagaataatgcagaactaagggaattctgggaaccatgcctactaggaatcacatagtttcatatctacatatctgaattcctaagtgggctcaaactgtggatacatactgaaagataaagtccttgcctatgaatactgtaagtatacaaatatactacctgcattacacgcaataatctaagtatgaacctgggagtcataatttacttttccttccatctcactcccacataagaaattaaaattctgtaaatttcatcttttctgaaatataggctctttacccttccttcctacttgactacaatgcatgtttctataatgtgaagtagcccatatgtgactagtgaaaaggagaatagtggtagcaaaacagagaggttatactggtttacatgggattttttccaagcacattaatgttttgtgccacaggtaactgcagctgaatacaaattatgttaagagctaaaattggctactatttttaacgcatgaatttgcagaacatgaggtttttcagtaatatttatctgcagtagaaatgactgtacattcatctttgatgagctatattaaatttattaaataagcagacattaaataagctactttattaaataagctacaattatgtgttaagatgaggaataaaggagaaacgaaataactaacaattaccgatgatgactactttgttgggtatagtgttaagggctctgaatacgttcactaagttgagtctatcccagaagcacaaagttggtttaacattcaaaatacaatcaatgtaaaggctgggtggagtggctcatgcctgcaatcccaacactttgggagtctgaagtccgacttgagacctggagttcacttgagacctggagttcaagaccaccctgggcaatgtaccaagacctcatctctcaaaaaaaaaaaaaaaaaaaaaaaaaaaaaaaattagccaggcagggtggcacttgcctgtagtcctagctacttgggaggctgaggtgggaggatcacttgagcccagaagttcgaggctgtggtgagctatgactacaccactgcactccagcctgggaaacaggctccaaaaaaaacaaaacccaaaaccatatatatatatatatatatatatatatatatctctctctctctggaaaagtacaggtaacacagttctcaaaatttcaacaatcctattctccttatagtacagaaattcttataaggataaaactattatccttatcgtacagaacttttacttgactaaactctcacatatttctagtaaaatataaaatttgacaatcagaatttttatacattctttgttctaatatatatattttgttcttatatatattacttttttgttcttatattagatattatatataaaatgtatatatattcaatgtaattcgtgtattaacaaacaacaaaaagaaaaaccctatcatcatctcaataggcagataaaaagcctttgattcctgtgatgtgtctagttagaaaagaaattaaaaaagaaaagattttaaaagcctttgaaaaaatccaaaatccattcatgataaaaactctcagcaaacttggaactgaaaggacaataattttaaagtagtggttgtagctattttcaatgtcttaaaggaaaatatgtttataacgaatgcaaagatagggcatctcaaaagagaaataaaaactataaaaaatcaaattgcaactctagaactaaaaaatacaatacctaaaataaatataacgcaggaaagacaccataaataaggctttccagtttctcaaatttttactagtctgtactacttatggatattgcattataatttttaaaaatttaagagaaaaatatcaatgaactataataaacatttggactagagaaactgatgtcctcttgatttttgcgtgtacttttcaatttccttgtatttaaaatgagaaatttaatcaacaaaaaattatagacagtttcctaagggtttaaacactgatgatatgaagtaaaaaaaaaaaaaaaaagtctctgtcctcacggaacaatctacaaggaagagatcatagtctctaagaatcccttctattgttatagttgtgtaactacctaatgagattaattctatcccagtaagacccaaaaggaatactgtacatatctggcaaagtatagataacacatttctcaaaatttcaacaatcctattatccttatagtacagaaattcttgttaagaactttacttgactaaactctcacatatttctagtaaaatataaaatttgacaatcagaatttttatacattttttgttctaagagatctttagggtaattcttttttctaaatccattaatatattttgcatgtttataaaaaaggctcgaaacactggagaaggatgatattcacctgatccaaaaatgtggaaatctcaagttcaagagtcagacaccctaaaagtaatttcacaaaatgtgttgtcacttgtaaaatttgaagaaattattagtggattaaaaatggagaatacctaaaattatgaaataacatgagggcaaatgcatgcaacacagcagttcagagcagggactctgggattagacaaggatttatgtctatctagggtttaccatcttctgtgatacatgaccttagttaatcgttctatctctagaacatctatcaactatcaccaggtaactgtaggttaaatgagaaaattactattagtcatacagattgatacaactctttagatactcatttatgctaacattcctgaaatgtattctcatgggctgttagtaagtgttgttgggggaaatttaagattctatgagtttgggcatctggtttatttcagggcttttcagtctttaatatgtgaatgtacattgagaatttccaaaagggaaacataatattttgcatttctaaaacttatttgactgaccccatttgcaatgagtatctcaaggtactagtatgttccactgaaatcaaatttccaaaactgtaacttgggtattatgtaggactatgaataaactgatatcctctgatccagtagatcgatccctcagcatttttataatattaaaaaatgaattcaataagaatgaagacactttgtgcagtgtttttataatagcaaaaatccataaaacctcaatgtccaatgatagaaggataaaaatatatcaatgtcaaggattattatgcagctagaatggagactatagctgcatgaaaatgttaagacagaatccaattttctacatgtattaggattataacaatataaaaaatacatatatggaaaagaaaagaacagatgaaaacgaaacaaattaatgttccagatagaactggagtcacccttttatttagttatattttataatattgtatatatgataaacaatggtaactgtaaacaaagacacaaaggtaaaaatcttgattaaaaacttttaacatgtctcttctcatattaagtttgctgataataaatgatatttaaattataggaccattcaaagactgtcagcaagcaaaagaagctgggcattcggtcagtgggatttatatgattaaacctgaaaacagcaatggaccaatgcagttatggtgtgaaaacagtttggaccctgggggttggactgttattcagaaaagaacagacggctctgtcaacttcttcagaaattgggaaaattataaggtaaatcagtgatgcagacctaagggaagtaaaacaaatccattcttgcaataatgcaagaaacaagatgctatgcaataaataagacacacagttaaaaataactatccatatgttttttcattatctacatctgtcaaaaaaatgattctcatctctggttttaaagtcaaaattaaattgcaaaaaggaaacagaagatatacttttaaatgatccctttcagtctggatgacttatacttactactttacaaagattactattaggaaaaaaatgttgggctctttagatgaatatgagagagaccaggaaccctttttaaggatctgggtagtatactagctaatatttttagtagctatggataaattttattctcatttgcattgtcttatttgtaggatttgaagctagctatgcaaatgaatactgacatatcagaagcaaaaaacaaacaaacaaaaagagaatgacaatgtgtggcttataaaacgcaagtgaccaactaaaatggaagctcacattaccacttaaatggccagtatctttatgctatcgaatgtttaacactgctctgtaaaaatgtttactatctctatacttatttatgcactcatgtttcttcacttattaacagaaagggtttggaaacattgacggagaatactggcttggactggaaaatatctatatgcttagcaatcaagataattacaagttattgattgaattagaagactggagtgataaaaaagtctatgcagaatacagcagctttcgtctggaacctgaaagtgaattctatagactgcgcctgggaacttaccagggaaatgcaggggattctatgatgtggcataatggtaaacaattcaccacactggacagagataaagatatgtatgcaggtaagtatgaaaaactttcattctttgtagaatcatcaccttctatgcattaaatagaatctactaatatatatgctactaaagtcttttcaaaaaggtcagttttggtcactgtggcaggaaatacaaccaacctactgaaagaaatagcttttaggatttcttctataaggcaatcccaaagtgtgatctatgtgaaaaacaaagttctgggaaaaaaacacaaagcaaaacagaaacacattaatctggaaataaaatgcaagtgcctacaattcataacaaatactaactgaacacctaccacgtgccaggcactgttgtaggtgctagggatataacagtgaacaaagttcccgccctttggagcttactcactggaggagagacaaaacaatttgttaggtgggaataagtactctcaaaaataaaactgagtaagaaaatagaaagtggtgggcagcaaggcctgggatggcagctattttatatgggttcgccaggaaaatctgctgtgagaaagcaacatttgaataaagagtcgcaagaaatgaaggatgcaagccatttggatacatggtgtaagagcatttctttgagggggaaaaccaagatgactgtgacatgtggcataggaataacaaaaaagcttgattcaaaggggaaattaatattttcattagaaagaaacaactagaccatccacataatttcaaatttagttttcatatgcttttgactttttaacccaggtttcttctcgtcctgatacagagatcccctcctcccctccacccaacaattctcccccatccctgtcccaaactggtttttctctccagctgtattttggcaaacagcacacaggtctctattttaaccaattttacactggtaaacgagaaaagaggagagatagaccataacatatgtcttatttacagaaacccatttgactgctggttttattttactttgtattattttttgctattttattttgacaattcaattttcctcagacttttatcttcttctgtatctttccttcccaatttctccctctgtaactctttcacatataaacactgcttgcatctactctgctaactagaaaattaaatccccctttttaaaaaagtacattgtaagcaagcaaagagttaaaaaaaggcaattcaagtgatttttcaagcagttgatgcaacagccatcaagtaagtgaaggcatttaaaactgctgagataaaggtaactgggattagtaagggaagttcaaattaaaggtagaataagttttttatgattgcagagtaccacacctagaagaaacttttacatttatatctgtattttttcctcaaaggaaactgcgcccactttcataaaggaggctggtggtacaatgcctgtgcacattctaacctaaatggagtatggtacagaggaggccattacagaagcaagcaccaagatggaattttctgggccgaatacagaggcgggtcatactccttaagagcagttcagatgatgatcaagcctattgactgaagagagacactcgccaatttaaatgacacagaactttgtacttttcagctcttaaaaatgtaaatgttacatgtatattacttggcacaatttatttctacacataaagtttttaaaatgaattttaccgtaactataaaagggaacctataaatgtagtttcatctgtcgtcaattactgcagaaaattatgtgtatccacaacctagttattttaaaaattatgttgactaaatacaaagtttgttttctaaaatgtaaatatttgccacaatgtaaagcaaatcttagctatattttaaatcataaataacatgttcaagatacttaacaatttatttaaaatctaagattgctctaacgtctagtgaaaaaaatatttttaaaatttcagccaaataatgcattttatttataaaaatacagacagaaaattagggagaaacctctagttttgccaatagaaaatgcttcttccattgaataaaagttatttcaaattgaatttgtgcctttcacacgtaatgattaaatctgaattcttaataatatatcctatgctgattttcccaaaacatgacccatagtattaaatacatatcatttttaaaaataaaaaaaaacccaaaaataatgcatgcataatttaaatggtcaatttataaagacaaatctatgaatgaatttttcagtgttatcttcatatgatatgctgaacaccaaaatctccagaaatgcattttatgtagttctaaaatcagcaaaatattggtattacaaaaatgcagaatatttagtgtgctacagatctgaattatagttctaatttattattactttttttctaatttactgatcttactactacaaagaaaaaaaaacccaaccaatctgcaattcaaatcagaaagtttggacagctttacaagtattagtgcatgctcagaacaggtgggactaaaacaaactcaaggaactgttggctgttttcccgatactgagaattcaacagctccagagcagaagccacaggggcatagcttagtccaaactgctaatttcattttacagtgtatgtaacgcttagtctcacagtgtctttaactcatctttgcaatcaacaactttactagtgactttctggaacaatttcctttcaggaatacatattcactgcttagaggtgaccttgccttaatatatttgtgaagttaaaattttaaagatagctcatgaaacttttgcttaagcaaaaagaaaacctcgaattgaaatgtgtgaggcaaactatgcatgggaatagcttaatgtgaagataatcatttggacaactcaaatccatcaacatgaccaatgtttttcatctgccacatctcaaaataaaacttctggtgaaacaaattaaacaaaatatccaaacctcatagtggtattattctttgttttacctgtggtcatcttaaactggtttttcagtccctctccacttccttcagaaccaaagaatctgttataagattcctggaaggaactgggcatctaactgttacaccaaatcttaagtgaataaaactttaccaaggcttctcagttattgaaagcagtatatcatttcatttaaacacccaaaactttatcaaagacaagccttacagaattttcacagaagaatatcattaaaactagaatttgaaagtcaacatacaaccttggaaaactaggctgaatgctaaactgccttagccaatgggcccattctgctctccttcagagagctgatttattttactctgaagttcctagacagcataataacttgggcaactaagtttcttgagaggagagaataagaagcggtattatatgatagttagtgtaggttctgaagtcagaactgcttgggtctgtggcccagctctaccacttgctagctgtgttaccttgagcaatttataaactcctatctcagcctgaatctataaaatggggtataataagaa

SEQ ID NO: 13441 - DNA, 37976 bp, Human
agtgctgggattacaggcatgagctgtcatgcttggcccttgaatttagttttgaatgtgttgaacttgagttgtttctgggatattaatcttgaaatatgaatttaaaggagggacagaggtcactggcatatgggtgataattaaaactatgggagatgaatgacataacataagggtctaccttgggcctaggtttgaaacctggggatactaaccttcaaagaacaggcagaggacataaaggaagccatctgagagttagtaggagaaacaggagagagaaataccaccaaaaagaggtatgatgtctgatgaaatagaggttatagtaatctgagaactgaaaagtatccatggcttgttaattaatgggtattttgtgactgtttggtatccgtagagtggaggtggaaaccagatagctgtgaatttagggatggtgataagggaggaaaagaaggcaataaatgtaactactgtaactactcttgagaaattttaatgagacaagttggaaactagaggaagatacaggatcaatggaaaagttttggagggtatatgatttggataggcttaagagaaatagccattagaaaaggaaaaaggttgaatatgaggagagtgtagaaaagatgggttcaaggccaaagttgacgagactggctttgaataggaggagggatgtggacagaagtaagcctttaagatagaggaaattggggttcacctgtaatccctgcactttgggaggctgaggcaggaggatcacttgagcccaggagttcaagaccagcctgagcaacatggtgagaccccatctctacaaagatttaaagaaaaattagctggggatgctggcacattcttgtagtgccagctactgggaggctgagtcagaaggatcacttgagcccaggaggttgaggctgcagtgagctatgttcactgcactgcattccagcctggataacaaaacaataccctgtctcaaaataaataaatgaaaagatagggaaagtcactccaaatgacttccatgttctctaaagaaataaaaaagggtgtttgtcactgaaaggagggttagatagatgttttgaggagagtagtgaaagattagaatagaattgaggaaaatgggagaggtagctgacaaatttgttcttcgactgagggatttttcacctgaacagtatttaaagatatcactgttagtgtggatgccatgaatgtgttatatgaaaaaacagaatgactatatttatcatagaatatattgatttagcacctctgtgtacaaagcactgtgcgcatatacttcctgagagattcagatgagcactggtcatcttgtccaaggagagtatgagctaatagctcaggtcatgtgattgtcacaaatgcaaatgtttataaaagattaaaaatggtaaatgacacatgagttttataaacatactataacagtttgaaagagatagagattccatcaaatgggggaaaataagaggactttatgaaaaaggcacaaaaaagggctaggtgtgaattctctgttgaaatagtaattactgtgaatttttgatttattacactatttattcttctataatacaatgactggcattaaacagaagaagagaaacaaagagattaatgaaacagtgagttctctcctgtccaaacaatgttctaaagttgattatgtttttagtaagaatatagaattcagtaatcattttcacaaatattccacaaataggaacatctctgttaggtgcaaaagatacagagatgactaagatacagtttctgtcctcagagagtgcatactctaatagaagaaatagaagtaaaaagaactgtagttttgtacaacaagggatataaagatggtatatatgagtagagaagtttagggcacaatggaaggaagcatgaataaatgattatgttgatatgatagcacattttttttcctttttcttttctttagttggagaacatcaattaacaggccataaagtggcagttaaaatcttaaatagacagaagattcgcagtttagatgttgttggaaaaataaaacgagaaattcaaaatctaaaactctttcgtcatcctcatattatcaaactgtaagtatttttgtatctaataataccaaagagacacctatcttaaaatgttttttaggaattttataataattgttaattgttaaccttttacaaagattttttttcatgttcatattcagcaagtgttaattcatttaacctttatcagtccttttttttgcatactcttggttagactgaacagacattgtttctaaattagtactcaatttatgtttctaaattagtactcaatttatgtttctaaattagtacatcaattctcaagtgatgaatgaagttgattcatcacatttagaagttgattcttatccaactttaaatgtcattcagggctttgacatttctagattcatttttataatttttatctagtcaattttcactaacattcagggtattttttcctttggaaagatagaaagtatatgtcaaagattatttcacatagtatattacttgtagaactgaaagtagtactataaccataaagcttttaggaaggcaaatgtgtttttttccccttggaataaattataaacttaaaagttaggtaaatattgagataaataagataagtaattgaaagataaatatattattttaaaattgactagaccctagaaaatttaaatattcattgtgcaataatgtgtttctttcagtcatttaaagttgcagtttaatatttgttgggaaaatgtaacgtgctagacactgaaaattgtcttatttatctttaagcttggatacagttttataaaataagtattgctcttacttattgagtacctgatagtggtcaggaactgtaccaagcatttttttttgtcaagtttctgctgaatgtgtggagcattttccttatttaatttaatattatcttcatgatcagtgtctaaagtaggcttactttatagacaaggaaactgcattatctaaaaagtaatagcagcttatccaaggccacacagctagtaagtcacagagctggtagttgaggtcaagcctgattccaaatgccatgctgttaatgctccagcattccagtttttcttaaaactgagagttatataaattccttttaaagaaaaaataaatttatggatccctcattttgacttaattatttttaatataccattacttaagaaacaaagccctatgtataaactttatatgcatatagttcgaatacaactatgaaaccaaaagaaattcacaatttaaatacaaaaaaacaatggaatcaatgggattcaaagcagtatcaatagtataatgtgacaaataacagtgttttataacaaccaaaatcattgttagagagtttaatagtggaaacagtaggaggagatcaaatactaaatttatattgtgagtcaaataagattggtacagagaaagcatgttcatataaatatactattaaaaaagaagtattaataactctgagatgttatttgctagttcattaaaatcaggcattatatttaggctgacctttgtcagtgagcagtctttgaatgtcagcattaatgggaacaacttgataaccctgtggagttatattgtttacttgatgacaagagtagcatataagtgtggtaagcagagtaatacctgccccccatgtctatttcctaattcccagaatttgtgaatatgttaggttgcatggcaaagggtaacattgctaagcagctgaccttaaactagggaggttatcctggattatgtaggtgggccaaatattaacacagtggttcttaaaagtagaggagaagagtagaagaaaagagtcagagaaaaaggtctgaacatagaaacaacatcagaatgataaaatgggagaaggactcaactggccgtttctgcgtttgaagatggaggaaagggagcatgagtcaatgaatgcaggcagtctctacaagctgggaaatgcaaagaaattctgccccagagccttcagaaggcaacacagctctgctggcaccttgattttagcccactgagacatatgtcaagcttttaagataaagaactgtaagataatacatttgtgttgttttaagccactgagtttgaagtatggcagcaatgggaaactaatacagcatcattcttgaaatccttaaataaatggctggtccaattattgttgagatttggaacattcatttagtctttactgctgtacttattgttagtgaactgtggcttattggtatttttaatgaagggacccatgtggtgcatcttactggcagcaagagtatgccactgactgttcagagcaggcttttatgggattggtgtggatgaccggtgatgactcagttctcacatcactgctaggaaaccttcattcttagagtaagcttcaatgtcatatgatcttcacttgaagttcacttagtcataaacataaacaaaatgaggtccctgaaattgcatggcagtacttgattataaggttatcatccaggacctatgtattagatggtccagagtatgtatatagaggtttttaaagattgtcataagaattaaaattctacccatgagcttggtgactcacctctcctatcctttgtttctttaactttaaaatgggacacctcatttgaggattaaatgtgttggcactggtataatgcctagtgtttgataagcattggcccagagcaggaattagcaacttataaactaattccagtcctctttcattattccaaatggttttcacttaactgaaacagttagtctctgacttcaactccgtattattcatgactttgttctagttactgggtaacatctaagctaaatctctttgctcttccccactgagtgtccacttcctatgagaagagaaagctgaaatagccagactaaaagtgtcatatgctagaatgaaagtggagaagggaaagatctttccatatttgccttataccttgacctcatcacttttacaatgccaaccctgaaagactttgaggaaattttacccgtttgggtatgagtcctactatctgtacagttcccagttcctaaaaacacaaatcagattttatcaataagcagttgcaattgtcataattgtcatgaggattctaaggcttcttttcctttttttttttttttaacagagcctagctctgttgcccaggctggagtgcagtggtgcaatcttggctcactgcaaccttcgcttcccagattcaaatgattctcatgcctcagccttccaagtagctgagactacaggcatgtgccaccacaccctgctaattttgtattttttgtagagacaggctttccgccattttgccaggctggtctcgacctcctaagctcaaaaccatcagcctgccgcagcctcccaaagtgctgagattacaggcttgagccactgcgcccaggcccgaagacttatttttgatgtcatatttatcagtgttttcttgccttcatttctatatttactttcaatcattttatttttgtttgactgtctcatcctgattatttaattatttgctattttctgaaggaattatagaagattgtcagagttggtcagaaagtaattggcagaggtgaatttgcagtttaaaacttttggcttccagccttgagattaattcattcagccacattgcctctttaattgtagatctgatcttaaaacaaaaaacaaacaaacaaaaaaacactcatgtatttttgctacagaagaagcttattgacatcgtctgtaacagtgttagtgatttaaacggagagagcaaccttaccctttcagtggttttcttttgtgtagccttggactgtcaggaatagtttccttattgcaaaagtgggactctagaattagcaagaaagtttgagcattgaatgccaagaatgaaggatatttattgcatgatttctttattaacccaaattgaaaaaaaaattacaaatgaatgacctaaaacccactggtagaaaattaaaaggcacaaataggatttaaagaaaaatccaaactttcctatgaagtagaatttgttgaattgatttttgtccttttttttctttcctccataattcttaatgcaacttgattttacttggtcaaaagatgcttgttagtctggtagagatgatcttgtctaattttttttttttttttttttgagacaaagtctcgctctgttgcccaggctggagtgcagtagcatgatctcggctcactgcaacctccgcctcctgtgttcaagcgattctcctgcctcagcctcctgagtagctgggactacaggcacacaccaccacacccagctaatttttgtatttttagtagagacggggtttcaccatgttggccaggatggccttgatctcttgacttcgtgatctgcccaccttggcctcccaaagtgctgggattacgggcgtgagccaccatgcccagcctaattctttttagtctatcttatttaacctatggcctgctttttaacatcattaaccgccagcaccaccttgaaatgttgtctctaggtttccatgacacctcaggcttctgttttctttttttcattcttgtttattctgaaaactttcctttatgggccccgctttatcttcctggctgttaagtattgatgcagtcaagtacactgagctagtgtaattttcttagtgaaccctcttttgatgatttcatctactaccatggtgccatttgccatctctatgctgaagatttccaaatctttatgatttctggcccttttgtttctccagatttctgagcacatttatcaaattgtttatcggatgttcacattctaaagtcacagagtcacctgaagctaaacttttctctctcttccaaatttacttctctgtttttggagggtgtggtgggagagtggagggaggtaaatgaaaataccattcatgcagtttcccaagccccaaacttgggcaaaatctttaatttcttcttttccctcatttcttacatacaatcaatcattaaggtctgcacttctttttcctaagtgtcctctgaatttatccatttttctttgctctgtcaggttaccatcttgcttgttgtacttcagctgtttcctctgcttggaatactttatccacatctccctttccctaggctgccaattccaacttgtcttttaagtgcaattacatttgacccttgaacggtatgggtttgaaccacattggtctacttatgcttgggttttatgccgcctttgctatcctgagacagcaagaccaacccctcctcttcctcttcctcctcagtctactcaatatgaagatgacaaggataaagaccttgatggtgatccatttccacttaatgagtagttggtatattttctcttccttatgattttcctaataacattttcttgtctctagcttactttactataagaatacagtaaataatacatttaacatgcaaaatgtgtgttaattatttctgttatctgtaaggcttctgctcaacagtaggctattagtagttaagtttaggggtagtcaaaagttaaacgtggatttttgatgcacaggggttgacaccctaacccccacattgtctgaggatcaactgtacccctgaaaacctactttactcactaagactaggttaggctctaactcctctttgctctcaaagcactcaatgttcaccttttccaaagcccttaaattgtgttgtaattgcacattttcttattggtatttcccacaagactgaagtacttaggagcaggaattatggttttttttttaattcaaaaaaaatttttttattatactttaagttctagggcacatgtgcacaatgtgcaggtttgttacatatgtatccatgtgccatgttggtgtgctgcacccattaactcgtcatttacattaggtatatctcctaatgctatccctcccctctcctgccaccccacgacaggccccggtgtgtgatgttccccttcctgtgtccaagtgttctcattgttcaattcccacctatgagtgagaacatgcggtgtttggttttctgtccttgtgatagtttgctgagaatgatggtttccagcttcatccatatccctacaaaggacatgaactcatccttttttatggctgcatagtattccatggtgtatatgtgccacattttcttaatccagtctatcactgatggacatttgggttggttacaagtcttcgctattgtgaatagtgccacaataaacatacgtgtgcatgtgtctttatagcatcatgatttataatcatttggctatatacccagtaatgggatggcgggtcaaatggtatttctagttctagatccttgaggaatcaccacactgtgttccacaatggttgaactagtttacagtcccaccaacagtgtaaaagtgttcctatttctccacatcctctccagcacctgtcgtttcctgactttttaatgatcgccattctaactggtgtgagatggtgtctcattgtggttttgatttgcatttatcagatggccagtgatgatgagcatttttcatgtgtctgttggctgcgtaaatgtcttcttttgagaaatgtctgttcatatccttcgcccactttttgatggggttgtttgattttttcttgtacatttgttaagttctttgtagattctggatattagccctttgtcagatgggtagattgcaaaaattttctcccattctgtaggttgcctattcactctgatggtagtttcttttgctgtgcagaagctctttagtttaattagatcccatttgtcaattttggcttttgttgccattgcttttggtgttttagacatgaagaccttgcccatgcctatgtcctgaatggtattgcctaggttttcttctagggtttttatggttttaggtctaacatttaaagtctttgatccatccttgaattaatttttgtataaggtgtaaggaaggggtccagtttcagctttctacatatggctagccaattttcccagcaccatttttaaatagggaatcctttccccatttcttgtttttgtcaggtttgtcaaagatcagatggttgtagatgtgtggtattatttctgaggcctctgctctgttccattggtctatatctctgttttggtaccagtaccatgctgttttggttactgtagccttgtagtatagtttgaagtcaggtagcgtgatgcctccagctttgttcttttggcttaggcttgtcttggcaatgtgggctcttttttggttccatatgaactttaaagtcgttttttccaattctgtgaagaaagttattggtagtttgatggggatggcattgcatctataattaccttgggcagtatggccattttcacgatattgattcttcctatccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggatttttattgagcacctactatgggttgggtgctgttctaggcataggggatataatcatgaaggacagagtctctttcttgtgttttttatgttctggacagtaagtaaacaaattaacaagatcattttaggtaaagataagtgctatgagaatgaaacatggtgctgtcacagagtgtgactaggaaagaagaagggctaatttagattaggtatgaggaagcctcactaagaagataggtttgacctaagacctaaaggatgatgaagatctgacatgtgaaaatctggggacagaatgttttcaaagcaaggggaagagcaacatcaaagaggtgaagcaaacttcaagtgttgtaggcaaaggaagattatgtactctcaggagtggagtgaggagaagagaagtagttcaggaattctaagagtagatggggaccagataacaaagggatttgaaggccttgctaagaaatttgattgtgttctaaataggaacttttggagagttggagaagtaacatgatatgaatatagtgtagaatgggtatggtggcagaagtagaagcagacagaccagttgggaagctattgctatagtctacctgggagattatggtggctttaaccaaagtgataatctagattagtgttggctaatacagtagccagtggccacatgtggctgtgtaaatttaaattaattaaaatgaaaaatttggttgtctggtcacactagccacattccaagtacttaatagctgcatatgtttagtgaccactgtgttggacagagcagataaaaaacatttctatcgttgtaggaagttctgttcaacagtcctggtctagatggagagaaatggatggatttgatatgtattttggagggagaactaatgtattactgatgggttagataaggaggagaaagaaaggaatttttttttttttttttttttttttttttttgcttaagcaactgggattttgggttttggcttgagcaagtaggtagtgatagtggtgtcattttctgagatggaaagaatggaaaagaaacattagagagatgtgaacattaaggatattgttttggccatgataagctaagaatccattagacatgtaaatggagatatcatctatcatctttatctctcctgcaactagcacagtagtaggtattcaataattacttgtagctccataatgacatttgaacaaggtcctgatggctctaggagtccaagcaagaacaaaagaatgaaagtgtaaggaatatggtgtattgggaacaaacagtctggtttgtttggtgcacagagtatgtatagggaagtggaaaaataaagccagaaaggcaggttgttggttgatccattcattcaacagatgacaccatttaggcactagggatacagcaacagacaaaaaggcaacaacaacaaaatccttgctattatagagattatattagtgtgtggtggaggggtggtggggaaatagacaataaatcccttattatatgttatatgttagacagtgaagaggtgaggggatatgccatgtagatatctgaagggggtaaatgttacacatagagggaagagcaaatacaaaggaaagtagaaattcctgcaggtcagagatcaagggagcagaatgatctaggaagattagagtgagagatgaggtcagagacataaagggcattataggccattgtcagggctttggcttttactcttgtctaagatgggaagccattggaaggctttgattagtggtatgatgtgatctgacttacatttagactgtaggtgagcaagagttgaagcagggaaaccaattgggagtcaattgcagtgatctgtaaaagatgatgttggcttgaaatacagcatagtgtagtagtgtttagaagtaagcatgttttgtatgtactttcaagatagagtcaacagcatttgctaacagataaaatgtgagttgtgagaggaaagaagttaaggatgacgccaaggcatctggcctcggcgaaaaaacaaggatggagttgccagtaactgaagtggagaagattgtaggaggaacaggtttgaggtgggatgttaggggggtggtttcaacaatttaattttggttttatgaagttgaaatgcttattagacatccaagtagagatgtaagtaggctgttgaataagtgaatctggagttcaggggagaggtgtaagctagagagataaatttggaagccatcagcagacagactgtatttaagatatttaaagccctaagactggatgaaatcaccaagataaacaagaagtccaaggactgggctctagaacactatgatgctaacatgtctgaaaaatgaggaggaaccagtaaaagagaatgaaaatgatcagtgaggtgggaggaaaattaggggaatcgggtatcttgaagccaagagaagaaagtgttttaggaaagatcaccaactgtcccttttactggtgaatattgagtaagatgataacggagaattgactgttggatttggcaacgtggaggttgctgttgtctttgaaaagaaccaatttattggaatgatgagggcaaaaacctgatgtaaagggtttaagagggaatatgagataaaaaaggggagatagtaactatcggcaggagaggagagacataggagtggtaaccagaaggaaatgaggagtctaaacaaggttagctttttaaaatgggagatattgtagaatgttggtatgccaaaaggagtgattcagtcaagaggaaggaattgatacaaaagaaagaggggctaattatagaagccaagtcccttcgtaggtgtgggagataatccagtgcataattggaggagttagtctttgaaagtatatgaccatggagtggttggctgtgtgtggtggaagaaaagataattagaaatgaggcattcaaagaacttaaaggccatatgttaagatattttaagccttaagactggatgcggttaccaaagatatgagtacagataaacaagaagtccaaggactgagctctagagcactatgatgttaacatgtctgtttatatcacagattatctataaagatatcacttacacctaaaacagtgacagtagtagcaatggggaaaaagacattaattcagaatgagaaggagttagtaagaagattgattgatgactataatgtgaaaaggtatgaggaggtattatctgatggcctgcacttcaaagacaatgagatttttgagggaggaagttttgggtaagaatttcttttagatcagaattcattcattactagactatgcaaatttgccagcatttaagatttcattaaattaatgtgaattaatgcatctaggctctgatcaacagtggcttccaatgtgtcagaaaaagagacacattatatgcctttggctagaggtacactacactacttagtctttcaaatgaaaacaaaaattgcaaaaatgaaacaaatctgatcaagtatctagatttaagagtgggttagaaattgtgcattttgctgctataaaggatggaacaacaaaattcatactgtggaatcctctttaacaaactaactggtttcttccacaaaagaatgcaagaaaaaaacaacagagatagaggagcaacctataaattagaagagacataagagacaaatgagccaattacaatatattgattgtgtttgtatcaataaatcttctgattggatatttgatgacattcatggttttttaaatttatgcatgataacaatattttgcatattgtgcatacacacatatatttttaagttatcctttagagatatgtacagatttatttacaaaggaagtgaaatccaaattcaatgtgaaatgatgactgaaaacatatacttttacaaagttaataaccaagacattaattaccttagactctagaatgttatagaaagtttgacttattctatatgtccatacataaataagaaaagtactgtcaactcaataaacatgggcaaaagacacagcattttctacgaagaaatgtatatggtgttttgcaactgttggagaatatataaatccaccagttttctaaagattttagcattgccaaactttctttggaaaactgtctttggtattatcttttcaattggaacatacacaataactatgactcagcagttgcactcatcagtgtatatcaaggagaaaatcttgccatgtagaagaatgttcgtgttagtccatttttacattactataaaggaatactgaaggctgggtaatttataaagaaaagaggtttaattggcccacagttctgcaggctgtacaggaaacatggtgctggcttttacttctagtaagggtctcaggaagcttacaatcatgacagaaggcaactggcagccagggtgtcacatggtgagggagagcaagagaggaaggaggaagagccagtctcctttaaacaaccagctctcttatgaactgagcaagaattcacttattactgaggcaatggtgctaaaccattcatgagggatggatctacccccatgatccaatcacctcccaccagtccccatgttcaacattgggaatcacatttcaacatgagatttggaggggatgaacatacaaaccatattaatgttcacagcagcaaataatagcaacattatagaaacaacctaaatactcttttttttttttttttgagacagagtttcactcttgttgcccaggctggagtgcaatggcgtgatctcagcttaccgcaacctccgcctcccaggttcaagcgattctcgtacctcagtctccctagtagctgggattacaggcatgtgccaccacgcctggctaattttttatttttagtagacatggggtttctccatgttggtcaggctggtctcagactcttgacctcaggtgattcacctgtctcggcctcccaaagtgctgggattacaggtatgagccaccgcacctggccaaaactctttagtggtagagtagatgaataaatacaataggatataacaatggtcaaatcaaataactacagcaaacacaacaataggattgaatctcaataaaataactactagaatattacatagagcgtgatacctggtttttaaagcaaagaacagtttaacatatatatgaatttgaattattcatatatatgaaatatacatatgtagagagaggggatacacacacatgcatatgtacatatataaactgtataaaagaggtggggaggaaaggataaacagggtgttcaggatgacagctgcattgggtgagaagcaatgggatggggaaggcggatccctatattaattagttggaagctgttgtcaaggtcttggcctttttgtctgagtgatgggtttgtaggtattacattattaaaaatagtaattaaataaaaggtcattcatggactactgaagacaagtgtcatcaaccaagcatgattgctacatttctatgtaactgagttctaactaaagaaaaatcttatgtgtatgtagctacataaataatattctaaaatctcaatagattttaccaccaaaaaggtgtactcatgaatgttgatttttggctaactttggaaagatttctattttttttgattttcatatactattttatgtggctatttcctaaaaatgcgtataacttggtcaactggaaaatgcttaggatttttctggattattaatttatttttaccaattagaaatgctgtttctgaaaaatttttaaactacattagtttatttctctgctgtactaggaaaataatactgagaagtatgagtgattcatgattgaatttcttgtaatgcttcaatatacttgtattttagacagcacaagagatttgacttactcaggccaggcttagaatgtaatcctggaatttgccttttccactaaatccttaatgtaaaactgtctttttaagacgtcttccttctgaaatttgtttccctttgtccctaccccattgtggttaggggtgggggacaaagggaaattttattggttgaagttttgctgtaattttgctatgatttttcagtttcagattactctggttttggctctaagcactcacgttatttaaaagtgctaatttatacatttacttaaatacctactttgttataggcactttactaaatacatattcattaatcaaattattgtaataataaaaacatataattacaaactgagatgcgtggtctgaagctcaggaaaacgcatctgtgagtgcaaaaaggcacctcacctggacttaggaagtgacttttaagctgagatctaaaggatgattagggctcactcaggtcatagtataggattcaggtcagtgaaaacagcttatacaaaggagctgtagcaggaggaggtacagcatgactaacactgaaaaatgtagtatgactcagtgttgtgactcaaaggtgagaccaaacaacagagatggcaagggcctgatttattcaggacctaagagcaatgggaaacctttgaagattctaaattgagaggctactggagatcatatttgtgtttgaagagaatctttatttaatgtctgtctttctggctaaactgtaagctccacgagtagaggcaccaacttttgatctcaccgagtacaatacaagtaggtactcaataaatgttgtgtcaccatttaatagcttagtgcctggcagacagtaagtgcttagtaacgttatgattttcattgctctagactggcctttagtgtaagacagtggctgctaaggatttagaggtttcatgaaataattaattccaagaatatctgttgaagacctgtgatatactcagaaatggcagctaaatttatttattagaatgtcatcacttcttttcttttgtgccccatctaggatgtacagagcacaaaagtgattgaaaattgttactaaatcagaccaacctacagtgaggtgctacagcagatgcacctgccctacagtattcagtttacgtgatcactttggtgcttgtaaagatagcttttataaaactatttcttctagagttctcagtataattacctttccaaagttcatttgaaatagtctcaattcttcttcagtcatattcgtttattttatataaattagaataccttgccatgtttcttcccaaagactaatgattgccattcaaaatatttcttctggccaggcttggtggctcatgcctgtaatcccagcattttgggaggccaaggcgggcagatcacttgaggtcaggagttcgagaccagcctggccaacatggtgaaacccccctctctactaaaaatacaaaaattagccgggcatggtggtgcatgcctgtagtcccagctactcgggaggttgaggcaggagaatttcttgaacccaggaggtggggtgcgcagtgagccgagagcatggccgctgcactccagcctgagtggcagagcaagactctgtctcaaacaaaagaaaaaaagtaactaattttaacgtctccaaaacttggtttggtaaaattgtgtataggggtgtaagttgtagtttttgggaaaaaaatttattttatcaaataaagctaattttttttcttagtttttaatgtgcccagctttggatgcctagaaacacagacacacagacacacacacacacacacacacacacacacacacactcttaatttttcatgatgggaattgtttaacatttacaaaagtaacgcggtgaaaccccatgcatgtcttattcaccttcaacagtagtcaattcattgttttatctacgccagattattttgaagcaaatctcaacattatctttttaatctgtaaactcttcagtatctactctagaaaatacttttttaaactctaaataacataagcatagtatcatcacatcttttttttttttttttgaagcggagtctcgctctgttgcccatgctggagtgcagtggcacgatcttggctcaccgcaagctctgcctcccgggttcacgccattctcctgcctcagcctcccgagtagctgggactacaggtgcccgccaccatgcccagctaattttttgtatttttagtagagacggggtttcaccgtgtttggtttagccaggatggtctcaatctcctgaccttgtgatctgtccgcctcggcctcccaaagtgctgggattacaggcgtgagccaccacgcccggcctatcacatcttaattaaaataattaacaacattatccaccactaatcagcatgtagactttcctgattgtttcataaatggtttttaaagttggtttatttgaatcagaatcaaaataagtctatacagcataattggtcaatatgtctcttaagttacttttaacgtatagtttatcctttccctttttttcttgcattttatttgttgaggaaatggtcatttttcacttcctggattttgctgaatgtatccctgtagtatcatgttacgtgtccaggaaaatatatgtatgttttacagaaatgaggtcttgctatgttgcccaggctggtaaaatactgactttagaagatatattccacttaattgccaacatgaagcctatgcttttcaaaatcggttccataaaatcatgttgaagatcagttattttcttttcttagcactttcatgtatgttctgttttagtttgttttgctgtcaattccccaaaacattgccctgagctcaagtgattctcccaccttggccttccaaagtgctgggattacaggcatgagccatagtgtctggcccaagtatattttctgtttatctttaaatatgtgatacctcatctccttttactgtaaacaaatttttgtttatatggaaaaattagttgttgaagagggaaagatttcaaaaattatgtaaacttgaaagggaggatctaaaggaacggccgtgagcctcaagaaatagaataattttgtaatggtccgtgtttattgctctgtgattattttgataacatgtaatttgttgccatcttaaagtattataaaacattgaaatataaaattgtagcaagagtagatataccagtttgattttggttaaagtaacatactttgttaactttttttaattaacaaaaaagataccaggtgatcagcactccaacagatttttttatggtaatggaatatgtgtctggaggtgaattatttgactacatctgtaagcatggacgggtgagtaacatactatctggtacactaaatctctaaactaataaaaaggaaagtattgggacatagaacaatgcaaagatatcttcaaggttgaagttgcttttatggtagtgctcaactaaacatgtagagtgttagataaattttctttcttaaaaagcattccttttgaaatactgattttagaaaatatgtttcacttaattgccaacatgatgcgtatgctttttaaaatctgttccataaaatcatgttgaagatcagttatttccttttcttagcactttcacatatgttctgttttagtttgttttactgtcaattccccaaaacattgtgcacatttaataatattaattgaaatttaaatatttctgcttagcgacaaagacaaacttgtcttttgacatgttgagctttgacaagcttttggttggtttattttgtctgatttgttgagaattccaacataattctagcttgcttaattatatttagcctaattatgaaattaaaactcttgtcaaatagatgtctcagattttttttttttttttttttttgagacagactcttgctctgttgcccaggctggagcgcagtggcatgatctcagctcactgcaacctctgcctcctggtacaagcaattctcgtgtcccactctcctgagtagctggaactacaggtgcatgtcaccatgcccggctaatttttgtatttttagtagagatggagtttcaccttattggtcaggctggtctcaaactcctgacctcaggtaatccacctgccttggctgggattacaggcatgagccactgtgcccagccccagatattcttaatgcagtttcttttgtgcttgataggttgaagagatggaagccaggcggctctttcagcagattctgtctgctgtggattactgtcataggcatatggttgttcatcgagacctgaaaccagagaatgtcctgttggatgcacacatgaatgccaagatagccgatttcggtatgtaactccagggttgttcagaaaggtactagctaccttttaaagcataacaactcattgaactaagaactttacttttcaaccttgtacgttctgtaccatgaaaaggaattagctgaaatctcctcagtagcttttttttttcatttaattaaattttcattaattttcattaaatacactttaaaaatgcagatacctctagagaagttagaaggttgtcatcaagataaatccattcaatctgcattttctcctaaggaaatgatgcataactgtttttttgttttttttttttttgaagagaggggaggagtcccagacttctttgaaaatctcatgaaagtatgggcactttccctgatgaatgcatataaaccaaggtacctgaaaatatgcatgcagttggaaaaaagcccttctgaactgatccacaaagaggtccttaggtgtaacgtctaataacttgattagagaacagtttttgtcaggggtaaaaggtacataaaatgtgatttttatactccaaacactttctgggataaacatacgtggaaaggatgccttaatagggtatttgagaaaaagactaggaagtgagagattaaagagaaagagatagaaaggtacaggctattgttgcctatttgtggtctataccttgtctttaatctaaaaacctagaaactactttctctatttctcttccttctctaaatcatgaaacttatttattactatagctcagctagatttttggttcaatagattattttttccatgttgaattaaatatttctaaattaaaaacttttggaacataatctctttatgaggtggggcccatctggtttctaattacagaatttaaagaggcttttgaaagcacagggcaaaaaagtagtagtctctattttattctttcaactatggaaataggtaaataatattttgatgttttcatgtttgggaaagttaatatgcttcagaataacctcatttgtgatgggaatcaacatttttatttagaaaggaaatttagtttcactcatatatgtgatgtgctttagctttttgttacagtgtaagcactctgagacggtctctttccagttaaatgctttccactgcttttttttaataacttaaaaaaaaatgatatatggaggatccaggacttgaaattttgctcatatttatatgactttatctacttttaaaaatatctagcaccaagtaaacattacttttatttttaggattatctaatatgatgtcagatggtgaatttctgagaactagttgcggatctccaaattatgcagcacctgaagtcatctcaggcaggtaataatcagtgaagcataagctttttgtaatcttgtgttcattttgataacatttaattacaatatattctctatggaaggtaagattttaacatggtagaaatggattattcatttatttttccactgttaaagggataatggttatatcaaaaaatgttaaacatttcatttagatgtcattataaatatacttacgaagttttccccattagaaaaataactgaagtagatcctgatttaacatatctttcattttacaaaagtgcagataagagagtaagaatttgctaaatttaagctagtgtcatttatttattagatatagttctttaataataccttgcatattttccaaagtatatagagcattgttttatattttgtgtttggaaaaacgagattttgggggaaaatattgtttcatgaaattacacaagtagagattgtgtagttactcataacttattcattggtacattataaaaatgtttatacagattgcagtggtaaactcaagtctttctacagtgatcaacgtgtgattttaaaagttaacagaatcctataagagaaaatatggttaaagtattattgcaaatagcagataaagaattatcttagtccatttgggctgctataagaaagatacaataaaggtgatagcttataaacaacagaaatgtatttctcacagttctgaagtctgggaagtccaagatcaagatttggtatctggtgagggtctgcttcctaatagactactgtatgctcactgtaacttcacatggtgaaagggacaagggatctctctggggtcgctcttataagggcactaatcccattcatgagaactctgcactagtgacctaatcaccccccttaagtccccacctcctaatactatctccttgggggttaggatttcaacacatgaattttgagaggacataagcattcagtccattgcaaggagtttgaacaatacagcaaatgatgtaaacaatcaccattttttatataaacagattatattcttttcattagaatagtaaagatttactttgttacctcagacccaggtttgagtatggtaatatgctatcatgggaattgtaatgctgtagaaacgtaagagaaaaaaggaataatactataagcataggttatctggatcaaagatgattttagtcatatgagttaggaagtgatgagaatagaaatagtaagtactcaggataatgtgatacaggataaatactgtctacacagtactaattaagtactttaatgttttaaatatctctctctctatatatatgatatattatatatatatatgtatatattttttgttttgagatagagtctcgctctgtcacctaggctagagtgcagtggcacaatctcagctcactgtaccacctcctgggctcagatgatcctcccacctcagccttctgagtagctgggactaagatgtgcaccaccatccctggctattttttgtatttttagtagaaacagcgtttcaccatgttgcccaggctggcctcaaactcgtagcctcaagcaatccgcccgcctcagcctcccaaagtactaggattacaggtgtgagctaccgtgaccagccttaatattctttaaaggtgtgccaggggtagaaattctattatatgtatacattatatatatgttttctttcttgtaatagttctttgggaaaaagatttaacctatacaccatagtattttttcaagtttgtggtcatctactttgtttccctcaaaaatcaaccacagaaagtattatatgttttaattcgtatgtttcagttaaatgaatttgtgacaaataaaaataccctattcacttggcaggcttgaatagtagttggctagccccattactctctttggggaacaaacactgaatattggggagcagccatggacttcattaaagaccttggaaatgaatatgtactgaatgtagactacctatatatagaagtagggtacatagagaaaaagtgattcttgcatttcaggtttgtgttgtcatcttttttcttagattgtatgcaggtcctgaagttgatatctggagctgtggtgttatcttgtatgctcttctttgtggcaccctcccatttgatgatgagcatgtacctacgttatttaagaagatccgagggggtgtcttttatatcccagaatatctcaatcgttctgtcgccactctcctgatgcatatgctgcaggttgacccactgaaacgagcaactatcaaagacataaggtgatttttctttttgtttctgttctgcatattttctcataggaataataatgttaattaaatgattctcccaaagtctcatttcctgccctcaccacctcaccccagtactcatgcttcagccacattgaacttgtccttgtttctcaaacctaacatagattttatgccttcatgtctttgtttatattattcactttgccttgatgtcttttcttgtttcttttttgacctgatagacttccattcatccattaaagttcatgccaccccttttgtgatttccacacgtgcttccatttctgttttatcaacattttgttcatgcttttattatttaatcctcatcctgtatctagttatttctcagtgtgtcttttttctctcttaaattatgatatcagggtagagagtgtgtcttattcatctttgactacacaatgctaaaaggcctggaaagatggtatgcttagaaagtgtctgaagaaatttcaaatggagaaatagggtgagattttgtattttacatatggttaaagacataaagcataaaaagttttgctaagtttttgaattcaatagctgctagtcagcttactgtgaaggcttttttgtcacttgagaaagtttggaaagtgccattgctgatgcgcctatgaatatgacctttgtatatcccacacctgtgtatagtagcaagatgattcactgcatcctgcctatgacttatcaaggcatgtttcttagaggttttttcttcttacctaagatttcatccgtgtttgtttacaaacatgttcttttgacatctttccagaactctttccccttttcatcattagccagcaaagaatttttttttttttttaaggcagggtctcactctgtcgcccaggctggagtgcagtggtgtgatcacagctcactgtaggtagcctcaacctcccaagctgaggtgttcctcccaccccaggctcctgagtagctgggactataggcacaagccaccacacccagctaattttttttaatttttttatttttagtagaaatggagttttgccatgttgcccaggctggtcttgaacttctgggctcaagcaatccacccaccttgccctcccaaagtgctgggattacaagtgtgagtcgttgcacccagttccagaaaagactgttttgagacctctgacctttggaatatttaaatgatggctgagatagctgtttatgtgactgctgctgatttcatacaggcaaggactgatgattctttttgcatttatgtatcattttcttttcccagcctttcttcagtgttccaaacctcatgtataacaatgtaaaagtgtaaattagccaccagatttaattataaaaatgaacttagcaggaaaaaaactctttgtgtttatagttctttagcatatatacttctgttaatgacttttccttagaaaattagacatgctgatatatttgcagctgctcatatcagcatatacatttagaatagtaataggctgggggcagtgtctcatgcctgtaatcccaacactttgcgaggctgagatgggaagattgcttgagcccagaaggtcaagactagcctggtcaacatagtaagcgcccatctatattaaaattttttttttattaaaaaaaaagtcaaatggtaatgattcattgctttaaaacaggtgtttgtatatttatatacttcagaagaaaaatgtaaatatatttactgggaagagttaatttgtacgtaggtagatggcatgaaagtatcattcatctctatactttaatatgataacttgaatctatagttttcatctttttaaatttatgtcatatatatatttacttatctatattcaattttttaatgtttgggaattctcatttttttaattcttttttttttttttttttaaagagatggggtcttgctatgtttaccaggctggtcttgaactcctggcctaaagcagttttcccatcttggcctcccaaagtgctaggattacaggcataagccaccacgcctggccaatgtttgggaattcttgatttgataaaatatagttcaatagggaaaagaattactaatcatggaaaaattacaaaataccaagcattctgctttatggcttaacttatgttattgcattgacttttcatatatagctataaaccattttacaaaccatgaaactgaagctcagaaaggttacatcatgatttatgtatctgtttgcccctattaaattataaattactttaaattagggaccaattattaattcatagcaaaatgcacaaggtcgaacacatattaaatgttaagtaaatctgtgtttgttgaaaattacacaactaataaggagcacaatggggctcaacttggaactttacctgaattcaaaacctgtgccatttatactattccaaattgttacatcagttctgtgatatctatcctttcaatctatcatattttatttatctcttatgctactacatacttactgtctcaatattatttttgtacatctattattttcttgtaagatagccattggaagttcggaaatatatcttcatatttatttgcttatttaaccattttcgcttttattcattcaacaaatatttatttcacatctgctctgtgcaaggtcttgtgctaggtgctggtaatatagtggtaaacaagatagatattatcttcatggaaaacacatctttgtgttctccaggtatcttaagcttagtaatagtattaatgttatcatagttaaagtgagcggtctgaagttcaactgagcacaaatcccagtgcatctgtttattagctatgtgcaacttagttacttcccacatatattagaattttggggagcgtagtcatagatcaaaccttgtgaaattgccatttaagtaggtctgaaaatgattgaatatcagaaactgcaaatactcaacttaatataattaaagcttttagaacaatgtctagaacataatattagctattattatttttgagggaatatttgaaaaccttttagctgcacttaaagaaatttgggcatatcatgaggtttctaaaatttgatagtctttataatctaaccttaagtcatatatcaatttcaggtatcaggtagtagtgatagaaaaatataatttctgatgcctgtataatagcccatgtgaagtgaattgcttttgtctcagatgaaccttcataaacatcctagttactgctcactttggtagagttagttcagaaactgactcctgaaaatcaaaagctagaaagatggcttttaaaattgtcagttattacaaacaattatggccatttgactaaattaatgaattagaaatcaaatttagattgtttccttattgttttttaaaattaatttttaaaatataattcacatatcataaatttatccctttagattgtataattcactggcttttagtgtattcacaaagttccataatcattacggccatctaattccagaactattttatcatccgtgaaagaaactatacacactaatagtcactccccatttccccttcctcctatcccctggcaaccactaatctactttctgtgtttgtgcctgttgtggacatttcatataaatggaatcatacagtatgtggtcttttgtatctggcatctatcatttagcataatgtttacaaagtactttcctactgtagcatgtattagtacttcattttttttgcttgaaaaatattccagtgtatgaatatactacatttagtttatgcattagttaacgaagattgaattgtttctaatttgtggcttttatgactactgtttccatgaacatttacatacacagtttgtatggctatgctttcatttctcttcggtgtatatacctagagtttataattgtcgtatgttgttgctgctgcttctgtttgtttagtgattttcctgatctgattctgtaaaatctgtattcttttttatatatggctactgaaatctctctttggtttgcttaatgatcagctagtgattagataacaatttccttaaatgccctgatctaataagtctcccatcctttgctaatgggctttgtgtgatattggggtatatccttagtgctccaacaggcagttgtaactctgccttagccttcacttcctgcttgtgcagagcctcaaaatctgccagtggtgagaaattatggccctttcaattttttctcaggcaaacacacaactctgcatttgtttctggcctttctgagtcccagaaatatatcagagctttccaaagacccctctggaaattgtgtttcctaatttttccttttaagtgttttggtcagcttttcctttacccagctttcactgctgcttcaggcagttgcgatgttagacagttgccattgatttttgttttttcttttttaacaaatgccctggggagaaggctgtttgcaggagtaagctctgagtcaggtcacataaaaaccaggcttgtgagtggaggtttccagagaactgctagacatgtaaaataatgacagttctctcatggtaagatttttggggagctctaaactattctgctcctctattctccccacctcaatgccccagtgattgttaagctcctgttttctcagctctgtgattatgaggctgttggttttcaaggctgcccaggagctggacaaagggaagcggacttagggcaacttaaaaagccacaaatctcacctttcttattgagattcagccatttttcttgaataaacagtcttcagattgttgcaagcctttggttaatttccagggttctgaaaaaattgattttcacagtttttggttaatttccggtgttctgaaaaagttgattttcacagtttttgctggtattttattgttttatggaataatagattttttgagtttattttgaaagtgcttaacttttctatttgtcattgatatttaaaaaatattagacatgtaacataattttttgccttcttttacttcttttgtagctgggtgtggtggtgtgcacctgtaatcccaggtactcgggaggctgagacaggagaatcacttgaacctgggaggcagaggttgcagtgagccaagattgcgctactgcactccagcctgggtgacagagcgagactccatctcaaaaaaaaatatatatagaaaagatctatctcaagttatttttattgctgaacattaataggtgcttaatattattatatagccaataaacacatgaatgaattattttttgtgtccatactttgtctatttatcatatatgcagcatttattgagcatttactctactaggtagtagggtagagctaaataaggtatggtcactatttcaagaagttgtcgccgggcgcggtggctcacacctgtaatcccagcactttgggaggccgaggcgggtggatcacgaggtcagcgaccatcctggctaacacggtgaaaccccgtctctactaaaaaaatacaacaaaaaattagctgggcatggtggcaggtgcttgtagtcccagctactcgggaggctgaggccggagaatggcgtgaacccaggaagcagagcttgcagtgagtggagattgagctactgcactccagcctgggtgactgagcgagactctgtctcaaaaaaaaaaagaagttgtcagtttactgggcaagattaagaaaaaaatcaacaactaaaagaatgtattgtgatagaaaagtctagtagctgtagaagttttatctttgtacatatcctcagggcctggcacaccagtatttcttacttggactattgcaactagcatcaccatcatcatttttatcttttcttttttttttttttgagatggagttacactcttgttgcccaggctggagtgcaatggcacgatctcggctcaccgcaacctccgcctcccaggttcaagtgattctcctgcctcagcctccctagtagctgggattataggcatgtgccaccacgcccggctaattttgtatttttagtagagacggtgtttctccatgttggtcaggccggtctcgaactcccgacctcaggtgatccgcccgcctcggcctcccaaagtgctgggattacaggcatgagccacggcgcccagcatcatttttatcttttcaattcattttctataccacaaacaaaatgatctttacagaatgataactaggttatgctaccctgtctctttaaaatccttcaatgattttcatcaaccaccagttcaaatcatgagatttcctttttatggcctacaattcttagaaatatctgatttcatttggtactccatctcataactcattcttctttcatgatgttgagctcattccagttcctagagcacagcataactctttcttgtctcatggtctttgcacatattgtttcttttgctgggaatatctgttctgcaactctttgcatagctgacttcagatcattctagtgtcagcttaaatattactcagagtggcttccctgatcacctgcctctcattctaaattatatactctcattttactctatgcaatttctcttgcaatctttatcacaggatttgcatatttgtatatttgtaactatattttatgtatatttgtttaatctctgtgcagctaaaatataatctttgggaggaatggttctttttgtccatagtatgtcctcagtaaatattcaaaaataaattaatcagtgaatagaagacattcagtcagaatatatcttcatctgaacttaggggatgcccagttctaccaggtaataatgcctaaacaatctcgaaggagtagtttgtgttagatgaaaatggtttggtattctaggataacaatagtaacatcaagcgcaaaggcccagaagtgtgagaaaataaggcttaggagagcagttctcagactttttgattttaaaatcttgtaactcttaaaaattattgaggacctcaagggggattttttaaaatgtaggctattatctatcaatatttactacattagaattaaaactgagaaattaagaaaatatgtaatttacttaaaaataactatgttaaataatacatctttcatgaaaaataaccatattttccaaaaaaaattgtgagaagaattactttatatcaaagacagctaggttctcataccttcttcattcaatctgttgcactattttgtattagctgaagtgtggttttcataccttcttcattcagtctgttgcattattttgtattagttgaagtgtgtaaagaaggtctgacctcactcagataagtggttggaaaagaaaaaaagcatatttattattattaacaccaactttatcagaaagtctttaagtattgagaagctgttaaactcacacaaataatacaaaatttgaaatttttgcttgaaagcttgaattttatcattggcaacaaatattgctggttgttttccttaaagcgatgggcttgcttttttcatttttgagaaaatgttgtccaaatgccaagtcttaataaccatagttattcaagggtggtgggtaattaacttgctcaggatcacatagctagtaagtggcagagctaggtctagagaccagatcttttgattatattctattatattgccctatgtctaaattatttggacttgccaaaccatgtcttacaataatgtattgtggtgtttttcctagagagcatgaatggtttaaacaagatttgcccagttacttatttcctgaagacccttcctatgatgctaacgtcattgatgatgaggctgtgaaagaagtgtgtgaaaaatttgaatgtacagaatcagaagtaatgaacagtttatatagtggtgaccctcaagaccagcttgcagtggcttatcatcttatcattgacaatcggagaataatgaaccaagccagtgagttctacctcgcctctagtcctccatctggttcttttatggatgatagtgccatgcatattcccccaggcctgaaacctcatccagaaaggatgccacctcttatagcagacagccccaaagcaagatgtccattggatgcactgaatacgactaagcccaaatctttagctgtgaaaaaagccaagtggcatcttggaatccgaagtcagagcaaaccgtatgacattatggctgaagtttaccgagctatgaagcagctggattttgaatggaaggtaggaaattataatgtaataagatcatttgtagaagccatttttctatattataagctgctctgagctcctgagttgagtattaagcccaactttttctagtaatatgctatgcacattaaaaacaaaacaaataacctctataaggatgaaaagtggttgatactgggaaccaacatattttgaattatagaagtgttcttggtcaagaaaaaagtaatcaactagaaatcatctgagaaaatagcttaccagtttcagcatgcatcatagcaatgaaaaatcatgagtgtcttcaaagatagtatgtttttactttctctttttttttttagggaggttatttttcttttctcttttttttaggtgacagaggcaggtggctgtaatagctagtggttgatacaaattatatcatcaggacatatttattcagtcaataaacacttttctccaagttgtgatattctcttttatttggctagtgcttttaatacttagagtacattttccttactctcagcccacagtttgcttttcttaaaaattagtgctcaatttcatttgagttctatttgaatatatgtgtggggaggggcattttttcttttcagatatgcctttcactcttgttcttttcttgaggattgtgaacttttaaaggaagaagaaaaatgtgcaaacttaccacataaatatgcatttgacgtgttcaaataaatcagtcattttcattttattatttgtacatgaaatgaatattttcttaaaatcatttaaaaaacagatctctctgttttggagcagtcttatttagttaaaaaagagacgttaacatttttaaaattctgtactgaaacattttgaaattagtaccacagatgttttgaaaacccaaagcagtgttgtttttttgtttattttttgttgttgttgttgtttgtttttttgagacagggtctcactctgttgcccaggctggagtgcagtggcgcgatcttggctcactgcaacccagggtcaggctatcctctcacctcagcctccctagtagctgggactacaggcgcctgccaccacactcggctgattttttttgtatgtttttgtagagatggggtttcaccatgttgcccaggctggtctcaagctccagggctcaggcggtccacccaccttggcctcccaaagtgttggaattacaggcgtgagccactgtgcctggtcctctttgttccttctactccataatcatccatgaacatgttcaggcagagactggacaaccaaattagaattgatgttttagagttgatgcttatctagagtgaaagctggaccctatgtaatctctgggttctctttaagtttttcctttatctttcacttttttcttcagtaccccaaatttattcaagtagcttttcctttaaatcttaattgccatacagtactgcttagtggggattaaataaatactaaagtgaactaccagtaatataaaaaaattattcgtattcctttcctacctcacccctattaattatttgttttgactttttttgcataaaaaggtagatattttgtagtttattatttttattgatttttcactttaggtagtgaatgcataccatcttcgtgtaagaagaaaaaatccagtgactggcaattacgtgaaaatgagcttacaactttacctggttgataacaggagctatcttttggactttaaaagcattgatggtaaggaagctatgcatgcatgagctctgagaagataaaacttggcactagttgaccagatgttaaaatcatctcgaagacatccggtgggtaggtcctgcactggtttttaagcaatctagacttaaccaaaatgtaagtgaagtgaaaaggatgaaagacatgttgaatacctcttacctggcatctttccacaagaagtatctccgtggcgtaaaagaatcatttgaagtgttggccgtggagcacaagtaaggaacaacagggaagcaggttttacttttcaaaattaactgacttgtcagattctttgtcatatttctccattcatattttattagttagtattatagtgtctaaactttctccttcatcacctttcctcatcctgggtggccagggcgaccaaataggtctccattgggatttgggttggatttaggtacccatggcaatcaaggagccaaaggcgtcagggaaaattgtcatgtccaagaacttagtgtgtgccaagaattaaacttgggtaaaccaaatctgattattcatttcagaggcccaagtgggataaaaccagaataaactaagggtcaggtgctggatggaacaagaatggaacggagtttagagttagggaagttgttttaaacgaagcatttaaattttactcttgaactaccatcaactatgtatggtagtgtttatatggatcccagacctgtttcatcgaaattacatgttgttgttattaaaacgcagatccctgggaaccactccagacctattaaatcagaatttctggagattggtcctgggaatcgtagaaaatgcagttttaacaagatttctctcactttgccctccacctccccaaggcaatatatgatggtgacttttgtttttaccttagtgattttttttgttgatatgctagaagaaaataagttgtcaaggatatgctttcttcacatgcagagatatcagtttgattccaatatcaatgccgattactccaatttgagcaggacttaggggccacattttgactgtgtgcaagtcttgtgattggtagcgatgtttgttatgattgttggaaggaagaagactgtgtttctacaacacagaaacatgacattcattattaagttgcccttgctcagatgtgtttacttaatattctgaatatcataaattcataggaagggcttgggcatatatactttccatataaattgctcttctttggtccatttcagatgaagtagtggagcagagatctggttcctcaacacctcagcgttcctgttctgctgctggcttacacagaccaagatcaagttttgattccacaactgcagagagccattcactttctggctctctcactggctctttgaccggaagcacattgtcttcagtttcacctcgcctgggcagtcacaccatggatttttttgaaatgtgtgccagtctgattactactttagcccgttgatctgtctctagtttctttctgttattgcactatgaaaatcagttatattctttaaatttttatcttacttttggataatatccactgcaatactaattgagaaacatgaattatttccaggggcacacaatgctattgaaattactgaaaacaaaatatctgacatcttatttacttgtagaaatctgtaattctattgtgcctatgataaattcacataggcaatatctttaataggttaatatcaatgaagatttttaattacaataatgagttcactacagacgattaacacaccacactggcgaaccatctcaatgtaagggtggtttggcaacacctccttgctttgctgtttggtgtaggtaaatctagtttacttcctaaatttcagtaggctttatgctgtgtttatgcccccaatttattttaacaaaagaagattaaaaagtaaaagaaccacgagtaagatattatttaaatgttgaaatcttaaaaacctgcctccaagatttcagaagccaagtttttctaacagtatttgtacaaatactgcctagtgtattcaacagaaggactgtggtcatgtaacaggtaaccacaattttcaggtttcttaaaaacagctgtaactaactcaggatttttatcttgagatttccctgaataatatatttatcttaagagccttcaagtttcaaattaatattggaacatctggaattgcaacaacttttgtcttttacataaacttacgtcatttaaaaaatgtcttcaaaatctacctttctcaaattctttttgcctctatttatttttgcatttcaccaacagtgataaaatagttaaatgaaacaaagcaaagtatcaacagtcccttaaatgagaatccttatctttgatctttattttctgtgttaggtgttagggtcctggtgcagctcataatgctaattcttcattggaagccactcccttcacctcacctcacctagtcactattgtctttgttcattgtttgatcctgagtggttgattgatatagctttgaatcttttctagtccaagtttgaaaacactgttctggccctaagggctggctatgacctttactgttgaacctgatagggcagggaagctttgaacatcaagaaaaaatttttatcttaaataaataaatatatatattcacacaccagtgcttttaagcaaaaaccagtttttttgtttgtttgttttgctttgtgcaggttttctttaagattaaaaaaacacaaactatagcagggtagataatagtttattgattatattttgttttagtaaaagtatttaattttaaattctgtgtaatttatctaatttgtatttattcatttgttatttttatgttgtaattaacacttatttacctggattaccctaaaaaaattaagctcttgaaaacaaaaaaatgacattaccttgacaggcttctctttgccaaaagtaatgtatgttctgccaagaagcaaatgagaatgttagactaagtttctcctgtgttagtggaaaacaagtgtgtctatctttaaatattctttgaatcaggagtttgcgttgtgtcacatcatatggctttgcagatcttttaaaaactgatgttaaataacttataagtccaacttcttaatatcaagataaatgaatagttcaccaatttgggaaggagggcgggttgcaatttgagatagtttaaggtttaattattgaaagactgccatcttgtggccccaaaaggtaatttttacatgattatttgtatagtgataagcagtcctgctgtgttagcctggtccattatagatatggcatagttttgggttctctaaatgggtccatacctcttttgggaaaaaacagggccacctcataatatttgcctgattatgaatggaattaccttagaaataaggaactaatcagattacttaaccccaatgacaaaatccacaaaaattttgaaggcagagaaacagaaggaatccagtgatgttttagctccattagtctaataggtcagatattaaaaaattgttcatatcaaaattaccttatatggattattgccatgttttttgagagttaattatttactgttttctaattcttgccagtatttatgaacagctgtagcttgatatttacctactgaattttaggagaactaatggtcacagtttgggttcttttatgtgtatgtttttaaaacagctattttgtgaatctaggtggttggtttttagaagatttcaggagatgcagtccagcacaattagagctggaacattgttacagcaggctttttgttgctcatgggcagatagagggaaagaatcagttgttagccccaaatttccacatttcagtgttgtaaactctgaatgtgataggtagatgtgggctaagaataatttcctccagtgaagacacgggagaagagcttctattatgaggttatagataaggccttagttatatcatggaaatggactccatgtagttctagaactgcatttcccaaagtatatcctgtgagatgctccacagaaaaaatgattgcatggactaagtttgaaaaatgttgcatgctactcttcccct

SEQ ID NO: 13442 - DNA, 29653 bp, Human
  misc_feature (1)...(29653): n = A,T,C or G
ctaacctctcccagtgtggaacctctatctcatgagaaagctgggatgagggcaattatggcccggggtaggtattatttctgccttacaagtcagggctggatggaggaggatatccctagacctcttagccagtcttgcctagaatagagcttctgcaacatgacattctgggggctgggtataagaaatgctggcagtttttccatctcagggagatactgtagccttcatttgagagctagggaaagtgttcttggatttaactgtctagaatggggtttctgtcacgttgatctggggactaggagaaagagtgagttatggctcaaatgccacagactcttactgtgtttactagcatttagtagattcttcttaaataaaatttatttatttactgtatgcctttagaacaattttcagggacttaaattattttagttttataaataatttttagcaatcacaattttttactaggaagaggttctgtggggtttctcatgctgccattatggaagtcattcccctgcatcattctttaatgcaaaaaataaaaaggaaggagagatataacaaacctgacgtccactgatacgggaatgagcaaataaattgtggcatagtaatagaatactatccatctattaaattaagtgaattagagccacatatatcagtcaggataaatctcaaacacataatactgagttgtagaataattcgtgtaaaaatatcatatataaatattagaaatattgtatggatgcataacagctgtagtaaaacaggaaaatgtggactagaaggataaaagctaagctctgactagtatttctctctggaccttagaaagagaacaagagacttcaactctcatttcatttcttgctcacacctgtaatcctagcactttaggtggctgaggtgggcagatcacctatggtcaggagattgagaccagcctgaccaacacggcgaaaccccatctgtaccaaaaatacaaaaattagccgggcatggtggcatgtgcctgtagtcccagctacatgggaggctgaagcagaagaatcgcttgaacccgggaggtggaggttgcagtgagctgaactccagcctgggcgacagagcaagactctgtctcaaaaataaagaaataaaataaaatattgtaagcagaatatgtgactctatgttgagtacatgagtgtgtactatactattcctgagctatgtttcatgttttcagtctcaccatttgtgaaacccaagcaggcactcaccagatggtatgaaaggctggaacctggaggtcccacagtcttggggctttggagaggagcctaatagagcaaaccagcaaggatcggaactaagacattccttcaacaaatgttaattaagcacttattatggctgctgctcagtgctagcagctttggtgtagtgccttttaatcttccagacactttcaaatacaggacctcgtttagatgtgtttcagaagggtggatttatttgttcaccacatacttagtacttaacttttctgtttcctcaacagcaagatgagactaccgagagcttctccttcataattttgtcaaaatgaaataataatctatgtaaagaggcggatgtgctgcctggcatatagtaagagcccaagaaatgttaggtactgctgttgttatcgctgtttaccaggcacagttccaatcataggagagacggtgattgaaccgaacagaggctcaaatgtctgtggcgctctcagtaaacccatgagctttctaaatagaaaagaaactgctcctagcctggccttttctgagaccggtgcgtgtcctcccgggaatccagcgcctggcatcttcgcagggtgctgcgaaggggcgggctgggaggcggggcacggctgggagcgaggcggggcggggaccgtcgcctgctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctggtaggagtgggagaaggtgcctagcgtgtcctgaccctaactctgttctgcagcacaagggacgttccggcaacgtgggtggggtgggggatgaagggcaggaagaggtgtggctaacgctggtaacctggtaaaacccactttgagtttcatttcctaacccattaactggcatgattccacctgcactttctagggatggaatattattaaatgtttactatttgcatgttgtcatgttaaacattactggaacaccttacttgtaatgtgattaccttgccctcttttatatgattgtccttaaaaatgctatactttctttctgagaaacttcatttcccatacataaaatggtgataatactacctcaatcttgatcatttctcaactgagttattcccactacactaactgagccctccagcttcaacctccttcccttgcagtgcactctcactaagtaataattttaaaatgttcttcctctgcttaaatttttgccaaacggtgttcagactcctgactgaaccacctgggacccttcttgatgcagcttctttccgtctctatacaataatctcctatcagggctccccgactctggtgaccaagttctttcaagttctctcagacatcaaaccctatctcaagaaaccaatactggttttcctgccactcagcacaggtaacttgctgagagacaacagtgtgacaagtgattatgaagattagataaaatagtgaatggtcaatactgacatatagttggtacataacaaatagtagttcccctttccctgcacatgcctgcagtactttaaacacatggctgtatattgccctcaaatattgatagacaaagttttatcactttatgggagaaatacccaattggtaatactaagtgacagaattagccacagaatgttaaaactaagcccccaaacctgtgtccttatttaattaatatgttgtttaatttccaagtatgtggagattttcttgttatcatttctgttaattatttccagtttgactccattgtggtcaaacatcatactatgtacaatttcagttcttttaaatatgttaaggttgattaaatgacacaagatatagtctatcttgataaatgtgccatggaggctggaaaaaatatgtatttgactattgttgggtggaataattgatataaattattgttgggtgaagtaattgatatcaatatcaatttgattttactgggtaatgatattgtttggtttgcctatatccttgttgacttgttatctacttattctatcaattactgaaagaagaatgttgaagtttcaaaggacagttgagagtatctatttctccattcagttctagtagtttttccttcatgtatttagaaactctgttgttttgcacatacacatttaagattatcatgtcttcttagtgaattgatccttttatcctgtaatgtccctcttaattcttcataattttatttgcctaaactgtactttatctgatataatatagccacaactttttttctgattagtatgtgcatggtatatgcatttctattctttaacttttaaccttcttgtattattatacttgaaattagtttcttgaaggcagcatatacttgggtcttttttttcattctggcaatctctgtcttttaattggtgaatgtagactatttatatttaatgtaattattgacatattaagatttgtctaccattttattatttattttgtttttcctgttttttatgcctctgttttccttttcctatcttcctgtgaattacttgaacatattaaaaataattttattcttatttatctgaggtgttttttagcagctctgtttgtattatgttttacaagtgattgctctaaggattacgatatgcagatgtagctgattgcagtctattagtgtaaaaattttactacctcaagtgaaatatagatatcttgcaaccatttaggttcctttaccctctctacttcataattgttgtaagtgttatctctatatacattgagaactacatcagataatattataattttgcttttgaatgttaaatgcaattttgaaaactcaagagaataatagtctattgtatttactcatttatttacccttttcatttatcttttttcatttctgatgttacaagcttatcatatcctttcagatctgaagaactatctttagatattcttttagtgcaggtgtactggcaagaaattctcttagctttccttcatctaagaatgtatttatttcaccttcatttctgaagtatatttacactggacatagaattctaggttgacaattcctttcattcaacattttaaaagtttatgcttcttctttttggcctctgtggtttctgttaagaaatctactgtcatctgaattgttatcccccatatgtaatgaactttttctcactgccttccttcaagaaattttctttgtttttgtttttgtttaattttcagaggtttagttatgatagatcttggtgctactttctttgggtttatcctgtttgggtttctgaaaatatagatttctcttttgccagtttgagggagcttctgccactctttcttcaaatatttttcaactacacattctttttcctctctttcttggactcttggatactgatggcacaaatgttaggtctcttgttgtgccacgagttcttgaaactctgtttttgttgtttccaatgtagtttctctgtgttgtttagtttgaatatgttcttctgagctgtcttcaaattcacagattctgctatcattaccattctgctattgagctattttactgaattttaaaatttattctattgtattttcagttctaaaactttcacttggttcttctttatcttttatttctttgttaaaatgtcctaattttttgtttgttttgagactattcatagttattggaaaagctttataacagctgcttttaaatatttaattattctatatttctaacatctgtgtcatctcactgttggtgtcaactcactcaattgatgttctcttgattcttggtaaggtgagtaattatggactatatcctggacattttatatatttgttataagacttaccctggatactatacagatcttttattttagcatatagcctatttagattctgaatgctcacttttgtgggtggcagttcaaatatcaatgcaggttataaagcctctgcagtgctattctggtctactccacttttattacccactcccacaggagcccatctcacattctcatcagtgcaagctggggaaaaggaagatggaacagaagacagggatccctctggcatagtagcttatgctttactacggagggaagagagtcagagatctgcctatatctcctccaaggggaagtgcacctccttattactgtagaagaaggctggaaagcctaatttgccctctgactcctgcagggagtttctttacttcagcttaggaatagaagtcgcaattcagctcacagactcagcagagaagggtactacctcattattgcaaagtaggctgaaagacaaggtactatccatgtactccagtgctataggaccttttagagttgggaagggtcaaatgtttttcatggtatttgcctccacaacaaagaagtaaaaaggctaaatggtttctgtcctgttgggttttccttttcctggtcctttggctagagagagtagacttttcttaaagatatttttgtctgtgttaattggtgtcatgattaatagaagtaaaatggaatgctttttttcaaccttatctggaataagaagcttgatctgcacctttgttgtattcctaagataggtgttaaaagaggggttaaatgacttgcctaatgtcacaaaactagccagtgacaaaactgagactgggatctcatccttggccctgtgattttcttatcacactgtcatcatttatttttattttatataggtttgcatttttatgtttctgggtgtaaaacaaatggagttaaattatgaaatttagttataattaaatttacattcttgcaattgggaaacattaagtactaactaatagatcttacataagtatttttatgtcagttttcatttcatcttcatgatgggcacacaagttaggtatgatctggtggtgcttccattttaccatggagcaaaatgactgagaacgaacagtgaactgcccgggttattcagctaaataataacaaataaggatttgagcccgagactatttgatttgtatacctattgtgggatctggccagcagcctgcagtgcaacagggctctttctttgttcccaggtggatcggcaggtcgagaaataaaagatacacacaagatagtgaaagctgggtccaggggggtcacgaccttctggacctgcgatgccgccagtgcgctggatataccagcatttattattaagtttagtgaggatgggggtaggttagtgagggatttagggttgtttgattatgaggtgagatggtcacatggggatgaagtaattctttaacatcagtatgcagaagtacagtatacagagataagaatttacaatatagtgtgtgcatcagcaatttctaacagagnnnnnnnnnnnnnnnnnnnntgctcgtttgcaaccagcttttgctagacaaccggttagaccaaaaattctcagagggagtatgccttaaccctaaagagacctaggaagagccgtggcaagataagggcgtttataaccctatcttatccatgtgaacaggtgcccctcatgggtccatttataggctctccacaagggttgcattccattcccagagctatgatcatctgcttttctgggataggaatcttggtgatgtgaaacctccctgactgcatgtccatttataggctctctacagggggaagcacatcaggcactgttggctcattctggcagcccaacctggcattgtctttacacaatcctgcatgcaattttgcatttacaataatcaggagcatttcatcttttattccgtaacaatagtttcagggggtctccctacatatacccattatctactttatgttgcctgacttttcatgacatggttagaggacaattgatgtactcacatgtttattcactcaacagacatttattaagtgcttatcatatgccaggcaaaatacaaggctgtatatgactaaatgtatactgtacactcttggtaaccaaatgagatataaggagattggatcactgaatggaaaccctggggataaccttttgtagaatgttggaagaaattgggctaaattttaaaggaaattttgatttttggcaagtggctaaatggagtaaagggacagaagatttttaataggggaaaatggtctgagccataataattttattattaattttagtattatgattacttatcacaacaatactaaacatgggaactaataaagtctataaaatttggaaactaagacagagaaaagttaaataactttctcccaaatcacacagaaactaagaagcagaacctggattcaaacaagtttgtataatttcaaaatccaaactcttaagcactcccttacatcacctcccctactcaaacatcttagaattctgattgaaaaccaaacaagatccaaaatattatacctgatattaagactctcctcagcctagctcagattaccttgtcagccttgtctcccatctcccttatcaactgagaagatgcttttcccaggagccttcctcaaccctggtcctcttatgtggttcttaacttcctcccatcaaatattttattgtaaagaatgataataatgagaagtgattatttatctatatgctccattagattgttagcttcttgaagtgaaggacttgttgcactccccagcacctggcattgacctgccacatggtcagtgctctttaaataatgaaccctatgcttcagtcagacaaggtagctctcttgctcccaaacaccttctgcatttcccctttacatctgtatatggtgttctcaccatctagaatgcctttgatttcttactacatgttttttattatcattgtggtttgggggttgttggtttttgtttgtctgttttttggtggcatcctgactttcatttaagatctggctcagataccatctactctttaaaaagatatttttcttatatctgtggtggaaaatcatctcttcttgcgatagctttatgtccctctctatcagcataataacacatgtcatctgctgtgcattccattttttttctgcacagtcagtctctcccaagagactttgacactttaggaacacatcatatcatattgatctttgtattacctccatgtatgatatgccagtgccagaaggtgcctggcaactcttaagcatctcataaaagcctgttaaattgaacatgaatttaatctccacagcctgttctcagaaaccagcgcagccccaagaactacctgtgagaccattattcttggaaggagttcatgggccccagaggactggtaactcctgaaactgcatgcaaagctctttatgtgtatagctgtgtatgtgtttactagagatcaggtctatcatatacattatattttcaaaggattctataactcaaaaaagtaaagaaccactgttttaaagctttatttcccatttccttgtttatttttttttctttattggataaaaaagctttttgactgtaaaggcaacaatacatacacagtgagacaacatattaaaatacagtttaaggagagagagaatcttacctgtctttgtgcctatcctgccaccactgtgcatgcgtgcacacgtgcacatgtgcacacacacacatacactcagcggtacctctataggaccttggtggatatctttccagatttgtatgtaagtgaaaataaaattatatttccaactttttattagaaattccacgttatcaatgagaaaaaagttgaataccttgatacagaaatgtttgaaagacataaacatacgactttaaaaatacaacatccagattgagggacagatgttaaacctcagagaaatatagaaacagcatgcatttttgtgcctcttaggatctctctctctctctcgctgtcacacacactcacagaggcacagctcaggggaacagaccctctgacctactgctggtaggagtgtgaattagtacactctttttctgtttttcttttcctcttttcatgtctttgttctgttggttattaaatttaagaacttagattcagtggaatctctgtaaactttatatctcttggtagccatggttcaatagttcagtctcttctcccactaatcctttacttcttcctctttactgtaaacatttattttgttccacccttttttaaatgcttatgctacatttggaatttttattcctagcattacatttcctgtctcctattgcttttgtttgacttttatagattctgtttcagttcttttctttttctattttcatttctgattttaagactgtttttgcctttcaaaaggcatcttatttttatctccttttgttttattctgttaaggttttttttttttcgtggctcatttaatgatatacaattgaaaagtgtgccctgccttacaaagtcttctcagaggccctctgggtcatttaatctttctaaagaaatggataaaatgactgacagggtgcacgtaagaattgttagacatcgccatcctcatcccagggctcctaccccgtgtttaaacagttgataataccatacaagttttttatctagttctgtttaattcgaaatatgcagtggcagagagttggtagagataaaattcttaggaagtttatttcagtaaatagtaatggagttctgaatccctcccaagtacaagctaagattctaggctgtatactttgctagttagaagtcatttttaacctgagatttttcagctcttccaaaaacatccttatttaatgtcctaaattagtcaagaaatccttcttgtcaggcctaagaagttcatccaggaattcagcaagggtacattaaaaaaattgcttaatgtgtatggtcccattactgccatttcttagaagcaaagatgcttactttaggagcaaactgacttgagattgaatctcagctctgcttttcctagcaagacaggacatgctgtgtaggagataaggactgatggaggactctgggccaaaagaatacaaggactgagttcaggcttggactttaatgtgggagcaaggtggtgggataagactgaatccactgtatttgctccgatggggaccattaggaacaggactctaagaggaatatggtggagtgtaagtgcaaaggcatctggattgtggagaagaggccacaaacacctaaaggaaatgaagcccttcggattgttaccactgcctgcagctagacacaacccaggcagaaaaaaggcaggggcagggtctacctgggaccctctgttgaacagatacattaggaaggattttgattcgtgaccatacactgtcctccaacctacatttgcagatatttgcacacttgtgcacattcatgaacatacacatccccattctccctctctcccaccccaactctctcactctcactcattcttactttcactctgtcactcccactaaactctgtcactcaggttctggagccatcttgggctcacgtctttgtcctcaaatcttacataatgcctgggaaattccctgcaccactcaatagctttgtcacctttgctgtgttgtttcagctataattcattttctgtcttgaaagataagaactattactactgtaaggtggttgtgagattaatgagataaaatatgaaaggtgcttagcaatggctgcctatgaccatgagtgccttcttcccacacaccagtgggttcctgtcccctttgccaccataagaatgcatccacggccctctgcacacagagctctttcattcctcggagactcgctgggtggctgtgcgcctggaacaagaaaacaaagtgcctttcacattgctgctctcattcttcctcacagaaccttaagagagaggaataattttctcccttttatagctggggagttgaggctcaaaaaataaagcaacttccgcaagagccgaaaacgattgaactatacagcccagattgtcacataactccagagctcgagggctttcctccatgcctggcacctgccctaaaatgcacctcgtattatctagcatacgtttctattatctatgcccagtctaggaagggggcattctcatttggttaaacagatagttatgatttactaagaagtccatacttggtacaccagattaacactaatcatgtctcagccttcttaagtggctgagacatgattagtgttcaggtgagaattcagatgtgctgaattctctctattcactagactctaggatgcttggggttagaaatcttgtttactatgtctatatattgagacaggctttcactctgtcacccaagttggagtgccatggcacgatcatggctcattgcaggctcaaactctcaggctcaagtgaccttcccacctcagcctcctgagtagctgggtccacaggcatgtaccaccatacccagctaatttttatttttttgtaaagacagggtctcactatgttgcccagactggtctcgaactccttggctcaagcaatttgcctacctcggccccccaacgtgttgggattacaggcgtaagccactgcacatggccagaacttatttattttattacagttttatcctcatgccttgctctagggacacatgatagatgctcactcagttcatgttggttgaatacataaatagatatttataaagaaacattcacattctgaagtgaattgaatctgagccttgttgagagaaggagaaaaggaaataaaagcattcccatgagaccaatgtacactcactcacacacacacacacacacacgtacacacacagacacagacacacgcactcctctcaatatgatcccctccagctacacacatcctccatttctgaacacatggacatgtgcatattcaactgttacgatttaactatttttcagtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggtaagtttcttggccaacgaaaggtgagtgtttgatgttgatagtcctataatctgttaaaggcaccttggtgactgtaattttccaacactcctagaaaccagccccataataaacttcctgccactaaagaaagctggatattcacatttcctgattgaagtcactccctgagaagatttgataagatcatccctcactgggatttgggagaaaccacatgccctgcccaaacctactctggatgcttttataatgaagtaaccatgttacccatttatagcagaggaacgtgttctctctgttttcctcttccaaccctctctccttaggaaaatggatgtggatcttcctcctcctgctgctgcttcttcctgtctctatttccttattctctttcattaaggttgtgtcacacagaggatcttgagccttctggtctatgatagaacagattggcatgaacagattggcatgaacacttaaaattaccattaaatataatgaaacatttaaaaattgaaatgaaaatctcaaatctattattctattaaatcaccacttttaggtatgaagggggccagcccttccacacctatgggtatttctcctcaagtgggacaagagactgagaaaagaaataagacacagagacaaagtatagagaaagaaaagtgggcccaggggactggcgctcagcataccaaggacctgcactggcaccggtctctgacttccctcagtatttattaattactattttcagtatctcagcaggaggaatgcggcaggagagcagagtgatagtggggagaaggtcagcaagaaaacatgtgagcaaaggaatctgtgtcacaaataagttcaagggaaggtactatgcctggacatgcacgtaggccagatttatgcttttctccacccaaacatcccagtagagtaaagagtaacagagcagcgttgctgccaacatgtctcacctcctgccatagggtggtttttctcctatctcagcattgaacaaatgtacaatcgggttttataccgaaacattccattcccaagagtaggcaggagacagtggccttcctctatctcaactgcaagaggctttcctcttttattaatcctccccagcacagacccttcacgggtgtcaggctgggggtcggtcaggtctttctcatcccatgaggccatatttcagactatcacatggggagaaaccttggacaatacccggcttccaggggagaggtccctgcagcttttcacagtgcattgcgcccctggtttatcaagactagagaatggcaatgattttaccaagaatactgcttgtaaacattttgttaacaaggcacatcctgcacagccctagatcccttaaacattgattccatacaacatatgtttttgtgagctcaaagttggggcaaagagattggggcaaagaggttggggaaaagttacaaattaacagcatctcagggcaaagtgattgttcagggtacaggtcaaaatggaatttcttatgtcttccctttctacatagacacagtaacagtctgatctctctttctttaccctacaaggtgcttttcaattcttagaaatatttcatcagttaattctatatccattcactgtattatctgccttgtgaagcatggtactaggcatgagtgatggaacagtcagaagaatagataaaatccatatcctatgtagtttatattctatgcagaaagaaaaatagtatcagttaactataatagaagcctacagtgttatgaagtcaagttcaggatgtacttattaatgcagtcctgggatgcagaaaaagtaaataaatattcatttaataaactggtgaaacaatctggcagacagaatagaaaatgaaaagcccctgaaatgaaaaggacagggaacttgaagaaatgaaaggtggccaacatgacaagcatggggattaaaaggagataattaaagggagatgaagctactgagcttggctaggaatagttcatgcaggttcctgttaaggacactagttgttatcctaacattaatggaagctcttgaatggctttaagtagagaagggaattatatttacactgtatatttttaggttttatttaggctgccattcagagaatagaagaaaaggagcaagggacttttgtagcattttaggttacagacagtggtagctcaggctaggaaggtccaatagcagtagggaaataacagtaggttagtccaagatagtagcagtgaagacctggatttgagatatccaggaaggtacacctcttaagacatgatgatgtaggtgcagggagaaggaggtgttgaggtgacactcaaatgggtagatgatggaaagaaggaacacttagaagagtataaggtatttggtttagttgggcatgggtgaaaagtcatatggagaaaactgtgagttcaatcatggatatgccgaattcaaaatacctttaagtcagcaaagtgaggcaggcagcgttgtatatatgcttctggagctcagggacagaaatagatggtcactatcaatagatgttatttaaaattttaggagttgataagatttcccagaaatagagtatagggtgagaaaaagaagaggttttagatgaagaagaagttcctgaagaactccaccatttcaagatttaatagaagatgaaccagcaaaatatataggaagttgctggcagagaattaggacgaaaatctggagacagtggtatcctgagcaccactggaaggcagtatttcaagaaagaagtgtctactgctgctgcaagtaagacgaggtcaaaaggtatccggaccaattcagtgggtgagcaggccatagtcagatattaaaaggtgttgaggagtgctctggaattgaagaaattgaaaggagtatggcattacctgtgttataaaacaaatgatggtctgtcaaacacaccaaaatttttttttctttgcttgtactcttctttctgtatggaactttcactcctccttgatctcttgattccttacatcatcttttaatgtccaggttagataggacctctcctataaagcctttcttagccttagcctctttaagagtatgggcattgtcttaaccattagtgcattcctagtgtttagcataacataaatacttaactttacttatgtaactaataatcaaagcatgggctttggaataaggcagacctgaaattgaatacctgtttagttgcttacttactgtgagaccctgtaaaatgcattttatcctttatcccttgttcctcagttttttcattagtaaaatgtgtggggtggtaataattgtacctatcccagagagtttctatgagtactaaattatataatgcacaacaaaatgcatattaaagtgcctgccattgcaagcaatcagtaaatattagccattatatccattgctttgggattatttctctgggcagttttcaagtgccttaatgatcttctcctgtccttcatctgatacacattcccatatcatttgctggatattcatattatggaatcagaatactgtaatgttgactttctttttcccaggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggtgagcattgcatatgacagaggtgagagactgtggcccatttgttcattggacagatacttactaagtgagtaagtgcttgttctatgcccagcactgtgctaggaatggaagatagaacagtgaacaactctgtcctcaaagagttttagaagtaaatacacaaagatgggcactaaacacattactgaatttaagccctggtccgcagtttgacttccctggagttgactgaatacttgttgtatgtcagatgcagtgtaaggtcatgtggccagctcctcatatatggttctgcactaggtatgtcttatgccatgtaaagtagactctcagtaggaaatggagacaaatccatcagaaggatccatcttgcccttcctccaccttcaggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccaggtaaggcagctgtctctccatatctttgttcagtaaattggggccgatgtcagccacagatgggtttttccttttagttttttttgggtttttgaagttaaaatataacctttcaaaactaatttcaacacaaacttatttgaaataaatctattgactttagttttttaactaatatggaatatttatatgcaaaaaccatttctaacatgcatgtaaagtacaacatgttatatgacatacgcctatccacctatgttgttctttttaaaaagaaaaacaatattgctgttgcccttgagtctctcctctctgtgtccttccccaactcgtccatttccctcctccctcagaggttctcttctgtatcctctttcttcctcagcaagttgctttgagagtcatctgtgctggttgctcttttttaatgcagattagtatttcattgtatgaatgtgccactttttgtcaatctgttctgtactgacggacatttgtttccaagttttggatgctatgaataaagctgccatgaacattcttgtacaagtgttcttgtggttacatccactcatattttttatatctgtatctggagataaaagaagtttaaagattgccaagctcattgcattatttgcctgcccaccagcacttaatatcatcaatcttctaattccatagagtgtagccgtttggagttcaaactcacttctcccttggtgggccctgcaccacaatttttgtccctctaagcctttgagtctttgtcaaaaactctgctcggtttcttggttcctcagacactttttggaatttggaagacatttctgggagctggggggaggggggagaagttgaccccaagtattgagttcataccctgggctttcttcttcccctaagccttatcctggaaactacctcactaccttgatttgtatgtatgtgtgcttaaatgtttacacatgtatctttttcatcttttcttggtgttctcagtagaaagagtgcccttgaattacacagtatgccattatcaaaatttttaaaaatttccttggtttaagaaaatgactttatttttgaaaattacaaatgtgtataaaagaatacaatcatgaatcactgtgtatactcatcagtgagctctaacaattatcaacacatggccattttcactgtatctgcatctatgccctactaccacattcccactgtccctgaattattttggagcaaattacagacctcaattatttgatacataaatatttcagcatatatttctaaaaagacccattttaacaaaaataaaataccattgtgcctgaaaaatatgaacaatagttatttaatgccttcaaacactcaaccagtgctcagatgtccccagatgtctcataagtatttttttttggtggcaagctgttgcggtggtgagaaatggtccaaggctggatatatttttgacagagagctgaactgttttgctagagaggtgagagagaaaagaggggtcaaggataaccaaggtttaagtgtgagcaaataaaagagacggaaagagaagatggtttctgttgtcttaaaaagaaaaaaatggcaccatgttatctgcatgattgttttgtttttctcaattagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaaggtgagaaaaccaaagtcattttgtattttgttcttagagcacaaatagaggtatattagtttccaactgctgctgtaaaatatgatcacaaacttggtgcctaaaatagcacagattgattctctcacagttctagatatcagaagtatgaaatcagcttcactgggttacagataaggttttggctaggctggatctctttggaggtgctggaggagaatctgtttctattactttcccagcttctaggagccgcctatgtcccttggcctgtggtcccctccttcatcttcaaagccagaagcacagcatcttctcttctctctggtatctgcttccatcctgacatactttctctctgactttgaccctcttatttacctctaataaagactattatgataacactgggcccactggaatgttccaggataatctgcccatctcaaaatccttaaccacatctgcaaagttcctttttccctataaagtaacatccctaggttccagacattaggatgtgaatggatatctttgcgggtcattactcagcctgctacaggagtaaaaataggggcaatatttcagaaaatgtagggtagcattaactcaggattgatgatgcaattagagataaagacaagggttaatagcatttggtttgaggtcctgtgaatgcccaaatacagccctttcatcccccatcccctaccctttactgttatttggaggtatacacaaagggggaacatagcagttaatcctcaaagctctgttctatcattagttgggcctagacccaatgacctaccattttcgcagccctcatagagaacacaagtaaagctgagttggatgccagagtttaaaggccaactttattaaggcctgagttggactttgccttcccttctgttttgtacctttcactttccaacattataggccagaggtgaggaagaaaccaaatgggatgcgtgacctttaacacagttacccctctggttaacacatatcactgcatcaatactgtcatctttacacatcaggaattgggtcctacttctggagtggaaagaatggtggatttctttccctcttatttcaccttattggtatgacatttatagaagtattgttttctcctcagaggaggagactcgctatatgttgtgcaggtaaggaagggatcattaacattaagagcaacattggacaaattgaagtttccagaagatgatggtaaagatgacagagtatcatgaggaatggttggtagaatcagtgagtttcaaattggaaagaaaaaggtgaatgaagagatatgagaattgttgttcataagagaaattccatttgccttttctgttatcagtacaaatgtttgttgagtatttgctctgcgtccttgcattcatataattcataatgccctcttaagaggtgtgcactcctatttccagtatataaaacaggaaactgaagaacagagaggttaagtgacttgccctaggtcacacagctgctaattgaagtggttaatattggaagccaaatctgtctcgttcacatcccattctcctttcactgtactaaaagcttccccaaaattataggcataagaaaataattgtcttgattttcatccatccaaaggtgtccagcacttggggcaggacagtgctaatgatattgctgtaataagagtctgccttctgaagaggccaaagggaaaattgtttcttttggggaccttttcttccaaatgtcctcctaggatgaagcccctttgtgttacggcaatcaggaatcctctgaataaaccaataaataacatcaaacattgtgttttctagcacacaggcaatcctacttcaagtttccatgaagaaaacctcatctgcagcaccctggacctcttctttgccggaaccgagacaacttccacaactctgcgatgggctctgctttatatggccctctacccagaaatccaaggtgagcatgtcagtgagtaagcctgaaccaggacagaatagtgcctcctgggatgtgctgcctgaagtcggggccagaagatagcattgtaggatgaaaagagaggcagaacagtcatgagtgatgaggacttggaaactgcacattcttcatattttctgtctgaattgtgatgggcccaggtaatacaaatgtaagagagaatccttgtcctcaagaagctcagaggcaagagggaaatcaacgaagtcagtcgacattgagatagttccaggaaacagttaactttctgatgtgaaagtctagttgtgtccttcccttcttttaagtgatgccttccaatttcctccagaataatgttcaagcactttagtctggtatatgttaacctccgatatgccccttctgcctgtctagccttggccgcacctaccctccatggtggcctcactaagtgacacgtcactttctttgcagtctatatttatgcctctatgtcgtgatagatgcttttccctctacttgcccagttttcctacatagtaaactcctagctcttcttgaagaatctgttcaagtactacctctctaagatgtttctgtgctcccctaggaaattattagcattttctccctccagagatgatgtaatgtgcctttattactaggcttatcatgtattatctatatatagcttccccacagactatagtccactcaagaatgatgttctcattatttttcttcctccagcttccagaaaagtttgaacatatgggggtgggaactcttaacaatacagtttttcaaattgtgggtaactgtttattaatgaggcataaaatcaatttagtgaatcaagaccaacatttttttcttaagataaaaatagaaaagatcagagtgcttcccatgtactaaggtaagtttgtttacagaactttatttttttcatctgtagttgcataatgtatgctttatatgtatatttaggtatatgcatccaggttcatgctcagttaaaaaggctagtaacaaacagataagcactgtatgattccacttacatgagttatcaagaatagtgaaattcctagagacacaaagtagaatggtggtggccagaggctgagggaggggatatagagcctcagttctgcaagatgaaaaagttctggagagtgattgcctaacaatgtgaatatatttaatactactgaactgttcatttaaaaatgctaacatagtaaattttatgttatgggtattttacccccaaataagatgttttacaaaaatgataatttatttcgctttcaggtaaaaaaaaaaaaatccaaactaggctttgcaaagccattagggttcccagctccttccaacttgttgctctgttgtgattagaatgatgcccttgttagcactctgtaagacggctcaccaataggctttccaccagtaggaagcaaaagggggaaggaagtgcatatcctttctttaggaacctgttccaaggattaaacatcacttctgcttacattctattagccagaattgagtaatatggtcacacttagttacaataggacctggaaaatatattcttttttctcgctctgtcacccaggctggagtgcagtggcaccatctcggctcactgcaagctctgcctcctgggttcatgccattctcctgcctcagcctcccgagtagctgggactacaggcgcccgccaccacgcccggctaattttttgtatttttagtagagatgggatttcaccgtgttagccaggatggtctcgatctcctgacctcgtgatccgcctgcgttggcctcccaaagtgctgggattacaagcgtgaggaaaatatattctttagctgggcagtcaggtctccagctaaaatctctattactctagagaaagagaaaagagataaggctgctacagtttctctctttggctaggtgagcactcaaccaatgaaagaaactgggagcagtcctatctggtcacacaaatctcaaaacatcagttcatgtgaatgtcaaaacatccttaagatgaaggtagatttatcctcactaatcaaataaggaactgaggtttaaagagtgtaagtaacttgcagcatcaatgttgtagagcaagagtttgcaacctgatgggtcttacctcagggcccactttccactcttacatatctacctgagaaattagagtctgtagatctgctatgggttgaatacttgggcccaccccagcccaaatttatatgttgaaaccttattaccagtgtgatgatattaggaggtggggcctttgggaggtaattagccttcaggaatgggagtagtactgttataaaagagactccagagagctgcctcactccttctactatgtaaggacacactgagaaagtgccatttgtataccagaaagtgggtcttcaccagacaccaagtccgctggggtctgatgtaatgaagtttagccatattaatcctggtcattccatcccatagcctaaccaggctcaaggagatttacagaggtggtagttttctgaataagcctttcaaaaggttaagaaccattttatttcttgcaacctggtcactaattgaaatacaacagatgacatcttggagaccactcatacctctttataataaagcataaaagtttaaaaaataatagaacccttccctctttaccagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaaggtaattaagcagatcttcaagcccatcttttaggggggtagaaacttgaacttgagaagtgacatttattcttgtcctaaggaatcatttaaatggaagaaaaagatatcttatacctgatataatactagattttctccatgtgtagtcttcaactagataaataggtattgtggggaggggagcaggaaggattcctacgttaaatatgtttagataaagactggcttttctttcctgtggggcctctcagtgtttttactatgctaatgtgcattgtgagtctgtgggcacgtggcaggcagcagttctaggtcagactttatcacagaacacttttctttgttttggtagaacatctcaccagactagggatctgccaaactttgggaaattctgcttcatgaacctggggttctagaatgctaaaatgtgaaaggacatttaagaccacctgggacaacatcatattaatgctggtgtttttaacataatatccccacaggtatttttccagttatttcttatagtcccgtgatgtataatttattaattaatgtatgtatttatttatttgagatggagtctcgctctgttgcttccaagtagctgggactacaagcatgcgccactatgcccagctaatttttgtatttttagtagagacggggtttcaccatgttggttggccaggatggtctggatctcttgacctcgtgatccacccacctcggcctcccaaagtgctgggattacaggtgtgagccactgcttctgacagatgtataatttattatcttataaggaagccaatctaagcgtgtgcaatattcattattgggaagggaaagaaaggagtgaacatgtattaagcaatgattatgggttgtggacaatgtggtctctttcaaaatgtcttattcaattctcagagtaagtttactcagaagaagcttgttatttccatgttatggattgcgaagtcaaggctcagaaaaattaggtttgcatgagatctctcaactatgaagagttgggatctggaagcagatctgttctgtttctttgtgagacaccatgctcccttcacaggacttgctttacattgattttaaaggcatctccctattattttttcaattggtctaagttaaattccctgtactcacaagtggaactctttctttttctttcaacttttgttttagattcagggagtacatgtgtaggctcgttacaagggtatattgcacgatgctgaagtttggagtatgattgaaccattacccaggtgactggcatagtatccaattagtagtttttcaacccttgccccactctctcctccagtaatccccagtgtctattgttcctatctttatgtcgatgtctatccgatgtttacctcccattataagtaagaacatgcagtatttcattttctgtttctgcgacaaacagaattctgatgtcactccattcgccactcttaggatctctgcagacaactatcctgtgccctctagtgccctctccccacattgcacattttcagttcctttccttgctttctaaccactttggtcagcctccgtggatcgattccagtctgtctaagtacctctgagtgtgtcatacctggggaaaatctcgagaagtagaatcagaagagcttacccattgggcactacttggttactatccctgcagagccaggaaaagcagctgttacatttactatttccttactgattgaccatttagtggataaaggctgaggtctaaattccccaggtgctgtttgcatttttctagcaatttatttaactcaaggaaaccagcttgacttctgctgctgctgatttttgtcagctttaaaaatcatcttgggaactgacaagttgaaataattgtgtgttacacagtctacgagctatgactttgacgtcaaatagacctaattcaaatcatggctctgcctcctcccactctctgactctgggcccattattttacctctcaaagcttcaatttcttcatctgaaaaatgcatttaaacctacttaacaagatccacatggaggtaaaatgagatcatgcatgtagggcatttaacccagtacttagtacagaaagtgcttaaaatagcaattattggccgggcatggtggctcacacccgtaatctcagcactttgggaggctgaggcgggtggatcacctgaggtcaggagttcgagatcagcctggccaacatggtgaaaaccgtctctactaaaaatataaaaactagccaggcgtggtggtgggcacctgtaatcctagctacttgggaggctgaggcaggagaattgcttgaacccaggagatggaggttgcagtgagccgacacactgcactccagcctcagtgacagagtgagagtctgtattaaaaaaaaaagttattactaatattggcaatcattgatattaattccttgaagtaatattatattaatatgttaatatttgaatgaattcaacaaacactacatacctgaaatgctcaggtctggcaaaacaaccctgagaaaagtaatcatgcaagtacatatttagaaacgtgataactgcccaaaggaaaaaactcactgtggtctgtaaaaacagactagcaggagtggtcagggaaggcttccaaaaggaagtgatgtttgagctgaggattagcttcaagagttagcttgatgacaaagtggggaggaggaacattcctggcaaggcaaatagcatttaaaaaggatgctgaattaagtaggaaaatggcatgtttgagaaactgaaagaagagccctgtagtgggagtgcaggcagagggggagagtagtgcagaccaggaccaggtgaagagtctttgccctgagagcaatgggtaactattgaagtgtgtcaagtcctaggtatgagcagtgggggctgtggaggtggggaatgacatgactaaatcatgctagaagctcactctcttccagagtgtgaagcagattgaaaggggtgacaggatttggggcacagttaggaaactataacagtggtccaggcaagccaggaagaagtctggactaagtgagcattggtggacatggaatggaggtgaaagtaaaattgaccagtctcactgatgggttggataacgacagagtaaaggaaaagctccctctgggaactcctgtgtttcttagcatgtacctggatggacaggggctccttgcatgggtctacctgattctattactaaacctaccatggggagtggggtgccatgtactagacattggaggaaagagaatggtgaaaccaagatgaatgagatgtcttttacctttgtagagctgccatcgttatagcttcactgagcagctgggctggttttggtacagtgcagactgactgttggattattctctcatcagtgcattcatgccccctccttccaagccctactgaaactgacctgtccctgtaaggaagctcgatcctgcagtcaagagtagccagacatccttgttaaaattcccagcagggaaatccaatctaatttgaaagctgtcccagacaaagagaagggtcctgggttgggggacacaggagactgtgtaccacaattggggagggtggggcagtatgttcaggcccccggcaaggaagccggaggatgaccacccctctgcataggtgtgctttttcatgggtcaagccttgcctgagtctctgctgctttctctagggtaccatgatcctgaccaatttgacggcgctgcacagggaccccacagagtgggccacccctgacacattcaatccggaccattttctggagaatggacagtttaagaaaagggaagcctttatgcctttctcaataggtaagttgtagtaaacaggtgtgtgggagtccagggcccctctcccagccctcccctgctctctcctgttttcccttgttttcattggaatgtctccagacagcctggccagtgcgactcactccatcttgctgtagggggcagccctgggatttccaaggctgggcattgcttcagcctgcccttacttcctaagccctccattcattgcctctgctagagatttcagctttcctgtgttctgtcctctggaaaactggtgacagagatccagactccaccaccagctcacaaagaggattaggtgcttccattttttttctttttttgatacgaagtttcactcttattgcacaaggctggaatgcaatgccatgatctcagctcactgcaacctccacctcccaggttcaagcgattctcctgcctcagcctccctagtagctgggattacaggcatgcaccaccatgccaggctaattttttgtatgtttagtagagacgaggtttcaccatgttggccaggctggtctcgaactcctgacctcaggtgatccacccgcctcggcctcccaaagccaaagtgctgggatacaggtgtgagccaccacacccggtcgggtgctgccatccttactaaatgttaaaatgtcctcagttctttttaagggctgcccactcacacagaaatagagctgatttataatgagatagagagggacaaggggaaggagaaacttatttgccacatgggcatcagtcagtggcttaacttgattggattctactctctaagtactcccttgaaaaggttctttggcctttgtaaattttaattcattttttaaaatctaattaatacatttatataatatgtaacttgaaaattaagaaagaagaggcagtgaaaactctctttttttctcttgtttttaagatagccaggtccaaaaatatatttttaactcacgacattgaacaatcaataacaaaacttcttaatatgttccaggttttgagttagatatgttgcatagattatttcaaataatttcacaattctttaattccatcaatatttattgagcatctattatgtgtcaagcattcagccctggtgatatgacaatgaatgagtgaaacagaaaccaaaacaaaacaaaactgctcccatggtgcatatgttctagtgtaatcatataaagtttatattactataaccactttagtgatgaggaaactgaggcttaaccaagtatagaaactaaagtcataaaactcatctggcagaggtaggatcaatgtcaaccagattaatcaaaaactaaagtgggtgttcttgctaacactatctactgaaaataactaaatactacacagacccacactgtggaatgcacgatagtttgcttattgttaatttaaaatatgtattgatgttccgagacaagatcattttgctgagaatgacactgaggctcagaaagggcagaaacggaatgacccatgttggtgtgactccaaagcccatgctctccccctgtgctgtgttgccttaggtgtctctgggctgattctgatgatcgatgctgtctttgtctttcttcatctaattctgtcacctccgctcacactggacaattcacttagaatatgaaagctgatataagacataggactatcttccagtcttcctgtctacaagagtttgaaattttgtattatagcacaaagtttcggctgttatgttccagttattataattaattattcctgttctttggctcttgcacaacatccatgtggaaatgctagaaatgtgacctctgcattccacaaaaaatgcttcacctaatgccagctgcaaccgtgatgagaggaatcttattagaagtccgtggttttaaaaggaaaagggatcctctgggctaagtgatgcctggataccttttcttcacatcacagaagcctctttctcatagttccttcatgtctcctgttttaaa

SEQ ID NO: 13443 - DNA, 18679 bp, Human
ccagcatcttggctgacctttccgctggtacttttctttttttgagacagagttttgctctggttgcccaggctggagtgcagtgaggcgatctcggctcaccgcaacctccgcctcctgggttcaagcgattctcctgcctcagcctccggagtagctgggattacaggcctgcgccaccacgcccggctaattttgtatttttagtagggacggggtttctccatgttggtcaggctggtctcgaattcccgacctcaagagatcagcccgccttggcctcccaacgtgctgggattacaagcgtgagccaccacgcccgaccctgcttgtactcttgaaggtcaacgtgtaatcccgccactccccagctcagaatcatctaacgactcccatctccttactcggcttacccagggtcctgcctttctcactcatctcatctcctcccatcttatttcccaaattgactgcgctctaagcgccctggcctccttgcttcttttcaaaacaccaaccacattaagcttcaggacgtttgtaacttgctgttctctctgcccgcaccattcttccctcagattcctccaagctttttcattcagctctgctcaaatgtcaactcaaagaggtctttccaggctatcgtatctatcacttatcttagcgtcacttgtatctccctctccagaatgtaatgctcctttatgacagggaatgcctttacatccctcgcgccttgaaaaatgcctggcacatagtaggcaccttaaaaatacttgattaaatggatttgggctgaacgtatcctgcttaactgcagcacttgagctgaggtcacctcaccaaagcaggcacacaaacacaaaaggaagcacacaaccagatgaggcctgcctgccgctcctgaaccctttgggagggctcgcgcgggaaccctgggaagctcccgcggccggagctgggcctgaaactgttctttcgtttcctcctgcggccgagaaagggaagaggtaaacaggcgaaaatgaggcgagcaggggctgaggaccgggcctcagctctacagcattcgcctgagcatgtattgttatccgtggcagcgccttgtctcattggatggccctaggcctagtgtggccgcgactccgaactgaaagcccaagcgcggcggcgtccagccgggcagccattttccgaagctgctctcttggtaaccccgcccgggcgcgtacgcacgaacggaggcggggcttaccgcgagggcctcgctccggaagccgcaccctccgcggcgtcccaccgtcgaggattaacaaaacgccaaacaagattttaacagtcggcagcgaaagcgcgcactcgagcgccaatgagagcggaaggaggggcaccgcgcctgaggaacactccgtatgtcgaacaatgattggctggagcccacctttcttcttttttgctattagatgggcttgctgctcccgcccatctaattggctttggtctaggtacttctgattggcttcccccgggcggtgggaggcgcggttttggggattgttcatcatggattggtgaatttgggctccttctcgaggtggtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaagacgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccaggtaaggagggcctgggaggaggggccggctcccgggcgcgggggcaagttcggccggcgcgggagaggagctgccggggagaccccgggaccgtgttggcctcgcaccctggtcgacctgccagggggagccgtgtgtgcctcgggcgtggcgcctgtcttgccgccgccgggacgcgagaaggcaggtgcgggctgggcgtaaataggccaactccgcggcgagggcgcccggcgcgggggtgtgggccgaggacgccgccgccagcctcccccgaccgggcagcccggtggctgctcgtccttccagctttctttccgttcccgagagcggtgaaggatggggagaaagaaacgtttccacgcaggttgccctgtgtcggtaattgcgaaattttaccgcgcattttctttcacttacactttttcaagaagtgtttagaacgccgcgtgtcttaaaccttggcgaagatgtctttgtagatttttgttgaaaaatcggaatcgagtcgtgtcatcttataaagaatttaaaactattgggactgagtgttcacgctgtcaacagataatggtcgattcgtcgtgctttctgcgaaagttgatttagttacaggagaaatattttggatgtaacagccccccagttacaaggaaagccaggagcaagaaatagcaaggaagatactgcatctggcaaaatgttacattctcggtgtgagctttgctttgaggggctaggaggtttggttttttgattaagctgacgatccgctatttcacctgcctaatcattcttcccttctgtgtagtctggttactctgtcggtttgagatccagtttctgtcatccattaaattggctctcgagaaaaaccttttatcagaatcattaatgcttggcgatccctgagaacttagcgcaggttggtttatcattcagaagacagcgcttcctcagaagcattaggtagacaggagagtaagtgaagttggagacagaatggagagatggatcagctttccagtgcttcctgatttgggtctcagaaatggtttcagtgtgctgagttcagtatgaattcctagatcagtgtcagccatgtgaaatgcttattaaggatgaaatttgagtgagtcttgtgtagttcattttattactctgcattttaaatttgaaactcgttgctgaagttttgggctttaagtaattttatggtaatattctagtcagataatttttcctcccatgtcctgaaaaataggcctgatgtagaaaatattaactcctacactcctacaaatgttgccattttttttcacgtgcaagttttactttaaaacagggtgggaaagttgcaaatggcaaaccaaatcatctttttttcctactcaaagcactatttttaaaatccaaagttttttaaaaagtttggaaaacgagtattgtggtttctagtgcattaagaattggatttacacaaagtgcatcgaacagttttttgtatcacggtctcaactttgcttgtgttttatctttcacttacggttttaggtataacttaacaccatctctatgccttgaatgcaaattattctttaataagctttttaggtactttattttcatatatccatgttaataactagaaaaggcattggaagagaggactcatcgtccagcactactttgattttccattcatcctttcctaccttgtacttgagaattagaggtggtagtgctcagtcaatattttctgaatgaatcattataatgaaatattaagttgttttttttttgagactaagtcttgctctatggcccaggctggagtgcaatggcacgatctcggctcactgcaacctccgcctcccggattcaagggattctcctgtctcagcctcctgagtagctgggattacaggcgcccgccagcacgcccggctaatttttgtatttttagtagagatggggtttcaccatgttggtcaggctggtctcgaactcctgacctcgtgatccactcgcttcggcctcccaaagtgctgggattacaggcgtgagctatcgcttccggcccttgaaataataagtttttactacttatactattttactgtaggtctactaaataggatattttgtaatgcgacccttaatccatagcaggctgattttaaaaattcagtagcttctgttttttgttctttaagaacagtgtggtatgcttcttcatttaagcaataaatattgagtgcttattggcaggcattaggttttcaaatgttaatttctaatttgtaccattcccttggtaaatttgttttcaaaattgatgattttgttgccaaaactgataaccaaaaactaatgaaactttctctgtgattaacagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaatgtatgtatcttacatttctgtactttaaaaattctacagtaaagcagcagtgaacttggttgacaactccagtctgacttgatagtctgtagcggcacaaaaaagtacgcttcagtgtacttcttagtcaaatctagcagtttatagtaggaacagcaaaactggtggttccccgtaggaatcacatcgataatgtttaactcatgttaacactgtgctcagccatttagactaacttggagaaatatttgttgactaaaattgtctttctgagtttaaatttgattatttgtagtgcaaaacatctgtgtaggggtaaaaggttttatatatatatatatatatttgtttggttcagaagacttgacagttataagacattttaaactctagtcatgtaactagtcatacctgttggaggcatatgattgcaaattataaaaataaactttaagtaatgcttttgatgcaaataaattatttagctacagaaaataaatcagaacaaagtggaatactttattccaccaccagcagctctagctggagtctgtactactccctgtttaacatataggcactctgctgggtgactaaggtggatttggtcccatgtgttaatttcctaatagctatcaataaccagttgaggagatttgtgagagtgaagcttttgtttatcagcattcatacttctgaatactttgaggtgctagagtaataatagctagcaatcgtaaaataaatgaaaatattggaaggacctagtggtttttttgttgttgttgttaaagaagtaaaagaatagtaaacttaaagcatttgtgttttgagatggggtctccttgtgttgcccaggctggtcttgaattcctgggctcgagcagtcctcccaagtagctggaattacatgtcaatgcccccacacccacattctgaacattttatttttaagtgagggatagctacatattttttttttttttaccagcaggaagtcatatataattctcttcacagactttctttcctctgaattcttattaatagaatcttacttagtgcagcctctcccaaatattgtcatggttagtttattcccaggtttctgttcagttaaactatttgattaaaatgtcaaagtagatgaaacaaatcatagtctctcagttcctcaattttctactctgtaaaataggattaacatccttttaagggaattgttctgtggcttgttatgtgtaataatgtttttaaatgcttttaaaacttttattctgggcatatagcaatttttgagcctgtatttcttaaaatgtcatctgaacaagattcacatacttttcagattatacaacttttgggaaaagactaaatctacagaagtaatattttcaccttgtttctttaagataactacttatcgttctcccttctatatttcatagtgatcaagttgttcctgcagcacagtcttcacctataaactgtgagaagagagaaaacttgttaccatttgtgggactgaataatctcggcaatacttgctatcttaatagtatacttcaggtaaattgacaattttgctatatcataaagctttagtaggcaaagattgatgtagcatttaatgtttttgagttattggaggactttaatgtccatactgtctttgcctttgattgttaataaaccagaataggctaaaataataagttacatgttattaaacttcctttggggtaagagaaaatgatagactaaataaaggtgggatagcaaaattgagtagaccttaagtggaaggtcaaacctttaatttctttctctgattcctggtgctacagtgtgatatatgtcttatcccttggaagtaacgttggcattgtgttgtgtgtccgttggcgctgtgttgtgtgtccttgtaaccttaaagtcttagcaatatctgcccaggtgcagtgctttgtgctaatgagggaagacactgggctactactgatgaagtggagaacaaattttgacacaaaacttaatctcagaattttagggtaatacatgttaaaagtgctctatagaaagcatgatgttgttttaatgattttacgtgtattgtttgttcagtaaacacttaagacaatctcactttttataggtattatatttttgtcccggttttaaatctggagtaaagcacttatttaatattatttcaaggaagaaagaagctctaaaggatgaagccaatcaaaaagacaaggtaagaaaaataaagaacagaaaataatgtaaaaagcaaaagtaaattaatggaaatttacttgcctggaaatgaagaggactgggggggtggatgacaaagattatttctctgttagcgagctattgtcaggcaattatttttcattctttcaaggtggctaactagataattcccttttacaatgtttgctcctgtaatctgtgtatcaaacttttgttacttgtatactatatattactgtatactataatcacaatatgttatacccatgtacaacttatttacccattgtgttttcaaattgagttaaaatttaaatacagtgtatttaaagaaatctttaacttccataattaaaaaaccattgtaattcacataaatagtaattcataattcctcttaaaattacaaaaaagaccagacgtggtggctcatgcctgtaatcccagcagtttgggaggtcaaggtgggtggtggattgcttgagcgcaagagtttgagaccagcctgggtaacatggcaagaccctgtctttactaaaaatacaaaaactagtagggcgtcatggtgtgagcctgtagttccagctaattgggaggctgaggtggaggattgcttgagcccaggaggttgaggctccagtgagccgcgatcaagccactgcactccagcctgggcgacagagaccctgtctcaaaataaaaaaataaaaaataaggcttatttgtacatcccttaaaattagtgctattatgcaacttagaaaatctagtattcttaagtgagacaaagacaaagggggaaggtacttaatttgttcataaaattattggtttgtgtgtttctttcttgacagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgaggtatagcctataatataattttagggtttcaatttagctacttgtttatatccttggaggagaatgacatgcgaagaaacaggaataaagggcaaggaaagtagaaactctaggtccacagtcctttatatcccagagactctgaatactggaaatttttttcataaatttggtgctaaattcgttagatctgaacatattatatgaggctttttatagtcattcatatttatctctaacgtgaatattcatacatgcttctatagaagtagtaatgtgtttagttatagagtactcccatatcaagtcggtgataaatattttacttatatgccatataatcattgaatctgaaaatgtctgaatttctaaatgcgtggtcctaaggatttcacattaagaattataggactatattcaaaatatgtgtaagaactgtaaattccaaatattctatttttatatgtgattagaggagaactgttggctaactggattagattgctttttggtattttcttaaaaatgaaactttacatataaaatagccttattcaaatacaattatagggcaagtctttaaaacaatcacttaagcatttagtttaaaaatagaactaggtgcaatatattgctataccttagttaagaggtattgtaggccggtcacagctcacacttgtaatcccagcactttgggaggtgaaggtaggtgggtcatttgaggtcaggagttcaagaccagtgtggccaacatggtgaaaccctgcccctactaaaaatacaaaaattagctgggtgtggtggtttgcacctgtagtcccacctactcgggagactgaggcaggagaatcgcttgaacccgggaggcggcggttgcagtgagccaagattgcgccattgcagtccagtctgggcaacagatcaagacccttgtctccaaaaaaaaaaaaaaaaaaaaggccattgtagcgtggtggccaagagcgggtttgaatactggcttttcatcctaagtagttctgtgaccttgggcaagttatttaacctgtctgtgccttagtgcttgtatctgtcagtaatggtgataatagtacctcatagggttattgtgaagataatgtatacataggagataaaaaacattttgactaaaacctggtgtatggtaagcattatctaagtattagttattaatatatttagaagaggatcaaagtattataatgaaaatagggtacaatttactcttacttttagttacagataagaaattccaaattagtgctgaataaatgtcttgacatttaaaaaatgaaataatttatgattttccttacatgaattaatttctatataggctttatgtactgtatcttcaaaactagaatagatgaaatggaaatttttatttatagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggttagtataattcttagactttgataggtagaagcattagcagctacagaattagaattttctcttcctagatacatgtacaatataatctctggctaaaattgtttcaagagaaggaaatttaacactgaatgtgaactatggtgttttaagtgctatgcttagattagtgtgtgtgtatatattgtatgcatatatatgtgtgtgtgtgtgtgtgtaatgtcattaaagtaattttaatttatagcttataaagtagggaagttcggccaggtatgttagctcgcacctgcaatcccagtactttgggaggcctaggcgggcagatcacctgcggtcaggagttcaagagcagcctggtcaacatggtgaaaccccgtctctactaaaaatgcaaaaattagccaggcatggtggcgcacgcctgtagtcccagctacttgagaggctgaggcaggagaatcgcctgaacccgggaggtggaggttgcagtgagccaatattatgccactgcactccagcctggggcgacagagcaagactccgtctcaaaaaaaaacaaataataataaagtagggaagttcagtatattttaatgtacatttaagagtacatttccctttatgcagtgtttgacataaactgatgaaggacattgcatttagtgaaattttaaaagtaaagactaagtacagtcatgtgttgcttaacaacagggatatgttctgagaaatgtgctgtttcattgtgtgaatttcacggtgtacttacacaactagatgctagagcgtactacacaactagcctatatggtatagaccagggtatctaatcttttggcttccttgggccacactggaagaagtgtcttgggccacaccacacagaatacactaatgatagctgatgagccaaaaaaaaaaaaatcaaaaaagtctcataatgttttaagaaagtttatgaatttgttacgggctacaggcaagctttgcatggcctattgctcctaggcaacaaacctgtatagcatataactactgaatactgtaggcaactgtagcacaatggtatttgtgtatctaagacgtatctaagcatagatatgtaaacataggtacagtaaaaataatcatagactactgtcatatgcggtccattgttaaataattgaaacgttggtaggtggtgcataactgtaagttacacgatacttgaactagatttttacctagttttgtccagatctacagatatcagggaaaatgtgtaatattgatatagtgaatagttttaccaaaaatgtcatccttattctgggtttattctatggggaggtgtctgtaggaagggagttacaatacaactgacttttttttattttttattttttttatttttttggagacagagttttgctcttgttgcccaggctagagtgcaatggcatgatcttggctcactgcaacctccacctcccgggttcaagcgatcctcctgcctcagcctcccgagtagctgtgattacaggcatgcaccaccacacccggctaattttgtatttttactggagacagggtttctccatgttggtcaggctggtcttgaactccgacctcaggtgatctgcccgcctcagcctcccaaagtcttgggattacaggcttaagccactgtgcccggcctacaactgacttcttttaaagacagtaatttcatagtcagttttatctttacagggaccttaaatttcattaatagggtacctctaataagctaataatgctaataagctgatctatgaaaatggaactgttattcatgatatactttatttaaatggaaaattggttatttggactataatgagaaactaatctgtatagacttacattttcctattttcattttaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaagtaagcaaaattggagtcttgtgtggaccatgatggaatatttataattctttaacaacacaaagtttaatagtagctggtgtaattagggaggggaaaaaagctagcttttagtgtctaatgtaacctttctgcttatctggcttcacttataaatggttagcatttgggaaattgtgacatcttgattttgatgtagagtgtgttagaatggaaaactgaaatgctttaataagtgtacttttgggaacctgagtctttcagagctactgagggttttttttaatttttttgagatggagtcttgctcggttgcccaggctggagtgcagtggcgtgatctcggctcactgcaagctccgccttctgggttcatgccattctcctgcctcagcctcctgagtagctgggactgcaggtgcccaccaccacgcccggctaattttttgtatttttagtagagacggggtttcaccatgttagccaggatggtctcaatctcctgacctcgtgatccgcccgccttggcctcccaaagtgctgggattacaggcgtgagccaccgcgcctggcctactgaggttgtttttaacacaataattgagccactgttgtgtctagagcataccacaaaatatggaaataccataggaaataatcatgagacaggtttacctatcacatattgaaagttggcaattaaatgtaaacagactaggcttattttgtttttgctgtctatcatattttttggccgatcaaatatatttaaaaggtatgtatactgttgaggatgcacttatgaaagtagtttctgaaagtaaaaatctctttagttatttaggaatgggtcggtcaattgaaattaaatgctaattttgaacctgaaactttgtggtttattttttgaatgcctgagagaagtatttgagtgaaaggattctcttttttagtttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtaagtattgtaaataagaactatatgaagaaaatgagctgctgtagaagataagtcttgttcaaaatgctgtaatagtaggaatataaagtactgaaatgaagtagattgtaaagattgcttcagtaaagttttgttcttattaacagtttccctgtaaaaatgaaacaacttaaatccttttgatatgaatacatattctattaagtatgatttcttctccttttttttttgaaacagggtctcattccagttgtccaggctggagtgtagtggcacagcctcagctcactgcagtcttgacctcccaggctcaggtggttctcccacctcagccttctgagtagctgggactacaggtgcatgccaccatgcccagctaattttttgtatttttagtagagacaggatttcaccatgttgcccagtctgatcttgaacttctggactcaagcaatccacctgccttagcctcacaaagtgctgggattacaggcgtgagccaccatgcccggccagtttctttattcatcttttcatattcattccctcttagatgttagtagcagaattcagtagaactgactaaagcagggaacaaattttgtatacatcaagatttttttgaaggggcgggaaaggctaaattcttcctagttttaaggtaagccaggaaatcaaactagtctttcaacagtttgaaaaaaaatgctgattgttttggatagtctgtttttttctgacatgtgtaatgtcattgtatgtgtgactcctttgtacattagttgcttgtttgaaattaccacgagggcttcacagtagctctctcacacttgattatgtcaaaagataacatatagccccttattcagtggaccttccctttgctaatagtataaaatactattttatttactttcccaaattttggtagagaaaaacttcacactaaaaatgactaaaatgggctgggcgtgggtggctcacacctgtaatcctagcactttgggaggctgagatggatggcttgcacccaggagttcaagaccagcctgggcaacatgacaaaaccctatctctacaaaaaatacacaaactagtttggcgtggtggcgggcacttgtggtcccaactactcaggaggctgaggaggaggagcctgaggtgggaggatcacttgagtccagaaggagccatgattgcaccactgcagtcagcctgggtgacagaccctgccttaaaaaaaaaaaaacccaaaacgtaacatttttggttccggttcagtctatttaaaataccatttattttcttaactgcacaaaattaggaaaataaaggaaaaaatacaattatttcttccacagaaatgcctgaatattagcagttatttatttttttgtttctgcatatattataaatattattcaaagttggggtcttgttttgattctgcttttctgatatatgaacactggatattaagggttcattcagatttttacttggtttcagattggggtataacattttgaatttaaaatagaactgcaggaaaccttttctttttttcctcccaaaggtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaataagtgtgtgtatatatatatgtatatatatgagagaataagcatgcataattacctttattactgaatactttctgacagtgcaggagtttttcaaagaggagaaattgtgcttagtccagccaagctgtcatacttaaaagaggtttataatgaaatctgttgcatctaattgtcctttaaagtagacatgatttaatggaatccaaaactggaaaagttaagatgatgctttgggcacacataaaaacttggttaaaatttcattttaaactagtatactgaagtggtaagtgatgaatgatttcatgacttgttaatggacattcttggtactaagtttttcctagaaatgattctaaatatgtaaatgctattggggtaacactttaataccccatttcaacaaggagtaccttctcaattaaaaaaaaatcgcagtaggctgggcgcggtggctcacgcctgtaatcccagcacattgggaggctgaggctggtggatcacgaggtcaggagatcgagatcatcctggctaacacatgaaatcccgtctctactaaaaatacaaaaaattagccgggcgtggtggcaggcatctgtagtcccagctactcaggaggcggaggcaggagaatggcatgaacccaggaggcggagcttgcagtgagccgagattgcgccactgcactccagcctgggcaacagagtgagactccgtctcaaaaaaaaaaaaacacagttacataatgtcttatattctttcataggatgatgagatggtaataaagtcatggttctccccacctttcagaatcactaatggaaatccttaaacagtcctgagcgctacctgtaagttttgaatggaatgggtctaagatagacactgggcctcttaatactcgagagacagccagttctaagaactaacacaaattcctgatgtgagaaagttccattttaagaaaaatgaagtttgtaagaggtttgtatcatacgaatgtttaagaggaagcctctgttctgaaggatgtcagaaaataattggttttgcataattatataaatcataaagtccttgatattactgagatttctgagatttttgtccaaactgttatataaatgtaacctaatgagaagtgacccttcagtggttccttattctctcccttatgtttatacccaccactgacccccaaagaagaagggaaaatgtcactttttttggaggggagggatttccattcttgactccttacctttccttattgttcatttggctcctcaaatagagttttgaggttatgcccttctgactcagatttggtctaacaatgtagactcatctgaaaaatgtttttgtgattcagtctttgaattgatatagataagaggaatttgagatgatactgcccattaaagtacatggagtgtgggatatcaaccatcacttaggctctcagaagtagatattttttagtatattttgaatatttactacattgactatagaatgaaggcaatacgttaaatctgaccagtttttgttttttttttttgaaacggagtctagctctgtcacccaggctggagtgcagtggcgtgatctcagctcactgcaagctccgcctcccgggttcacgccattctcctgcctcagcctcccgagtagctgggactacaggctcctgccccctcgcctggctaattttttgtatttttagtagagacggggtttgactgttagccaggatggtctcaatctcctgacctcgtgatctgtctgcctcggcctcccaaagtgctggtttttgtttttgacttaagagtcttgctctgtcgcccaggctgaagtgcagtggcgccattttggctcgctgcaacctccactttccaggttccagtgattctcatgcctcagccacc

SEQ ID NO: 13444 - DNA, 172677 bp, Human
gccttatagctaatgaccctgggtcctctaaggtcctgtccagccctaatattctctagtaatgttctgagtgtgtgtgtgtgtgtgtgtgtgtgtgtgtgtgtgtgtagacatagcctgaggggaggttagtataaccccattacaatatattagtagcgtggcttaaattttcaaaaaacaagaacaacaaccaagattatttgtatattacagtctattattaaagagttttaacagcccgtaagtacttctaacagtccataagtacttcatagtgtattatgtcctttagattattgattcgtatgtttgctttgattcatgatggctttgaaaattatattttaagttatttaccacaaatgactctctatattcaaatacttagctttcatttgtcttgacctaaaattccaatgtagagaaacgaatttctctattcacagaaatggtaacaattccaaacacgaccagtgaaattagttacaggagcaatgttgttcttccttaggaaggctattaaatttattagtctaagactggtctttcaacaagaaaaggagtttatgtttgattatgtgtggtcatttctgcagatttgttttcttgttaatgtagtattttaggggcgaggtgtattttgcccttgttctttttttttttttgcaatttccatttttattttagattcagagggtacatgtacaggcttgttgtgagagtatattgcatgatcctgaggtttgggcttccattgatcccatcacccagatagtgaacatactacccaataggtagtttttcaacccttgccccactccctctatccttttgtaattccagtgtctattgctcctatccatggtacctatgattttactcccacttataagtgagaacacatgatatttggttttctgcttctctgttaattcacttaggctaatggcctccatctgcatccatgttgctacaaaggacatgatttcattatttttatggctacatagtattccatggtatatatgtaccacattctctttatccagtcctctgttgatgggcacctaggttgattccatgtcttcgctattatgaatagtgctgtgatgaacatatgatgcaggtgtctttttggtagaataatttattttctttggggtatataccttgtaatgtgattgctgggttgaatggtaggtctatttttagctctttgagaaatctcccaactgttttccacagtggcggaactaatttacattcccccaacagtgtattagcattccgttttctctgcatccttgccagcatctgttattttttgactttttttgttttttttgagatggagtcttgctatgtcagccaggctggatttcagtggcaccatttcagctcactgcaacctccgcctcccaggttcaagcgattctcctgcctcagcctcctgagtagctgggattacaggtgcatgccaccaggcagggctaatttttgtatttttagtagagacgaggtttcatcatgttggtcaggctggtctcgaactcctgaccttgtgatccacctgcctcggcctcccaaagtgctggtattacaggtgtgagccactgtgcccagcgtgactttttaatgatagccattctgactagtatgagatggcatctcattgtggttttgatttgcatttctctggtggtaagtgatgttgagagggttaatgtaatattttacattttaattttcaagccagtgttttgaagtaaaaatcttcaaatctggccaatagattgttcatttggatggcatctaaaatgcaggtgcctctactggcatctagagccaccattccagtctaataagctatgggattgccgtggtctctctccaaaggcaggccctttggaaatctcctctaatgcttctaacagcctataaattactatatttaatattgcccttgtctttctcccttcccttctttttcttttcagaaacagagctgtcagtcagtgctgaattagtgcctacctcatcatggaacatctcaagtgaactcaacaaaggtacacagtgggggcacacaggggaggcgaggaaagaggtgtggaactgtttttaatcctggcatgaccttctttgaaatcaactgtttttcagatcactgcaaggaggtgggggccaaaataaatccccagcttactttgtgatcatttaacattgaattacttgggattctattatttctggagagtttctttccccccctcgttcctttttcttcttcctctaaaatgttccacatggtaaaaatgcttcaagatgtgaaatagggtcatttctgacctttctgacactacatctagtggatcttatttaggggatttgattcagcccaagccaggattcatcagagctgtttgctcggtgacctttcacgatgagcatttgatgtgcttgcagggttcaggaccgagtatctggaatgtttgtaattgcctgtgcataaggatggcagcttcctttgtgcacgtggggaacaggtttctgctaggagattgttgtttagcattaattaagccccgccatatgttaagcattgggtattttataaagaccctatgtcctggagtggtacatcaggacacattcaaaacctctgcagtctggctcaatctacctttctagccttagttatctttattcccctttatgcatttccagccaaatttcgatttcttcttatacatcctgtgcttttctgcctctctgctctcaccttttcacctggattgccttctcttctttgccaatactcattctcccccttttgcaaggcaacaaattacttctccctcaagaccaagcataaaatttacattatccagtcttgtctaatccctccagctggaagtggcctttccctctttgaaactcccatagctctcttctctgttcttctcttcacattttctatatgatgttatggtgatttatatacttatctcacccttaagcttagaagttccttgtaggagggtttctatcttacttttttttttttttggtctccatcacaaaatctagcacaaactcttatttgtaggaaattctcaataaatgtgtgtggaatgatgagtcacatcttacctggtgagaagccatagccatacatatttgtgtgcaaatacattcagcaaacttactgagtttctactttagttcaggcatgattcaaggttctgagattacagtggtaaagggagctcaaaagtcattgtcataaatggtcttttatgattagctctctattgtctactgacatagtttggttgtgtccccacccaaatctcatcttgaattgtagttcccataatccctacgtgttgtgagagggaccaggtggagataattgaatcatgagggtggtttcccccatcctgttctcataataatgagttagttctcatgagatctgatggttttataaggggcttcctccttcgctgggcactcattctctcccctgccgccctgtgaagaggtgccttctgtcatgattgtaactttcctgagacctccccagccatgtagaactgtgagtcaattaaacctctttcctttataaattacccagtcttgggcagttctttatagcagcatgagaacaaactaatacatctactaatacattcactgtaagttgtatttcctctctgagaagagataagtttattttataaaacagcaatgggtgaagttattttgctggttatactttactaggcactttaggatggtggaatgaagtgagatgtcttttcaccttaaatcaaaggacatttagaatattttttctattgccaaatttgacctgacattatttttctattaaatattaaatcaggcactccatgttactcctctccacctccagcatcaaccacaatgcctagaaagcagattttcaacaaatatttatagaatatgtttaatggaaaagaagaaataaaagaccctgaacattaacttagtacctgctctgtgccaggcactgtgctgggtgcttttttgtgaacttattctgcaagttccttatggtgccaacagaaaaattatatcattgcacactgcatgttattgatcagattccagttatggcaatagaaaagcatcaatgtgtgctaagaaaggcagcagagccagcagtctagaacccagcctgccagacttggaatttctaccagaccagcactgtaattagtagtagttgcccattaagaaagtagtggtgtcaatagtatgaacctgctggctgaagggaaggataaaggcaggccccagactcctttatttgttcaacacagacttccagagagtatggatggctttctggaggtacgaggatgcttggcatcatctttctctagaaggtaattagtgtatattctttaatttccattttgaatgagagaggaagatcatttgttgatcaaaaccttatcaattcctactctggtctaggaactctatgaaaattaggatataaagataaaccaggcaaaggcccctgtcctccatgaactcagagactatttggaaagactgatagctaaatgcataatcaaagccttctggtcaatttggtagattgagctttcaagagacacttcttccaatcacagagagatactagtgaaatatacaatgaagaaaataatccattgccaagctggtacacaaagaggtgaaatccctaggttccagaaatgaagaacaagttcaatactagtacaatgatctttgaggaggaattaagcaaaagagtccatgataatttgaaaactatgggtactctctaaggcctagagttttggtatcccatggggataagagttggagccacaggaaacaaactccctgcgttaggatatgaatgaagaatgactggcctaagtatgaaataaggaaaattctgctgaggatgtgatacagaaatctatgaagcaccttgggccattgggatcacccaggagaaatcaaaacctcagcctgtactacatgtgggagtggggttgaggttcttctcaggtattgcacaagccacaaaccaagatggtaacataaaaacttggcctggaattgattaaactaggagacactgacagcagcaaacctaaaaccagctcttaaaaatgtctcaacatcctcatgcatgaaggttttccaccaaagacaaaattttaaaaatgaaaaccacaaaacaacaatggcaaactcctgctgatgttgagcttactttaaaaaattataatgcatacaagggaggggaagaaagccaccattagtaagggttagcagacaaaacacatggaaaagctcataccttagaaactaaacacagtggaccaatttgagagagtatatatgtttaaaacgtttcatggtgaaaaagtagaaaccatggggcaaatgcaagataatatgacaaaaaaggcatatttcaaaataactaaatcaaaattatataattgaagaatagagctatggaaattagaagtttatcaaatggtcttaaagtgatacactcaggtcaagaatagtagtgatctgggagacagatttgagataatacggtggtttagaaaatggacttgagccagggtgactgactaggtttgaatcttgactccactatgcgtttcctgtgtgacttttagcaagcctctcaacctatctgctttggtcttctcatttgtaagatgaggtaagaaaagcacctactgcatagggctgttgtgaaaattcacctggccagcaaatctgataaactcattggagagtaagaagtgatagctgttttgggttaatatggttattactttgggcttgatattaaaatatcatgcgtacttcaacagtctggtaaggcaggcatattttagggttggggtagacatcttagattctgataaatcatccctttctggccttccacactttagtgttcattcatacaagtgacatacttcttagcttggcaacacaagattctccatggtcttacccctactgactcttcttatcttacctcctgtccccatactcaatattcaatttatttcaataatctgcctccaattccctaaacataccattctctttccagcctctatacctttgttcatgcagcttcctctgactgggtttgttcttcacttggctaacccctcttttacttaagcacaccttgaacattccctccttccccatttccccgcagtgcccctaatggacatacttctgaataacacaggtggtattccttccttgttggaacctcctggaggaagagacagatgattaacaaatccttccatcaacccctttgaccatgacatcaacagtgctccaaattatggggtaccgtattagcctatgtctatcttgatcagaatccttacctcggtgtattgaaattatctatttcgtgcctgcctctttaaagtcagggtttgccttatctattgtctaacaccatgcagtaggtaacatgcagtaggaaacatggcattaaattatttgggttcaaatcccagttatggtgtgtaaatgcctaccaggcgtgaggcacctgctaagcaggttgcacgcatcatttgaattcacaccaccctttgcaatagaacagataggcaacagaggctcatttgggctaaaggatttgatggaggggaagtgccaggattcccaccaaggcctcagggccaggtccaaggaccatgtctgttgtgacaactgagtgcattcatatcccctcctcctgtggggcaagttccctcacgtggagaagcagtaaaatacaatccatctcttggtgggctttaatgccttcctcttcacccagctgctgtgttccacctgtcagtcccacagcagctccccagccacactcaggtcccagtgttctgttacatgagtccagtcactggcattaaccagttacctgtctatcctttccaacaggaaatgaaatttaaaagagacaaggccaccctggaagagccgctgaaagctactattgatgggtcaagggggtaatttctgaaacaactgcttcagaaccaaatactgcctaaaataaatggatctacaggggctcaacctcagcttccccataagagtgttggggtgggtgtgataagggcctatttccccttctaccatactcagtcacaagaggtttcagaggttctctatagaaagccaaatgtttcttttggagaaggggctggaaattgctcccataggcagcagaaatggagggaacctactacttaaaaaaaaaaaaatactgaggcctgtttccaactgcaaatagttctctgtgctgacagactatatatatatatatatatatatatatatatatgtatatatatacacacacattttgtcctggtttgccttttcaaatggctttctttaccaggttggagctttagcagggaagtgtgcagtgtgggtcttataaacatgggctctaaagttactatgactctgagcttccttttgctcacctgtggatggagatatatgtatctgttactgtattaatccattttcatgctacagataaagacatacccgagactgggaagaaaaagaggtttaatggacttacattcccacatggctgaggaggcctcacaatcataggagaaggcaaggaggaacaagtcaagtcctacatggatggtggcaggcaaagagagagcttgtgcagagaaactcctgtttttaaaaccatcagatctcatgaaactcattcactatcacgtgaacaacacaagaaagacctgcccccatagttcaatcagctcccaccaggttcctcccacgtcacataggaattgtgggagacacaattcaagatgagatttgggttaagacactcaaaccatatcaattacctaaggtggttttcctagccaactagcatgtctatgggattcatgcccatgttgtgataggatagctgcttgctcggtcacaacatacagatacatcttagactcagccccctggcctgcctcttccctcgaagcttcaccatcaaggcctatgaccaggttctctagctcaggagtggtttgctccctcttgtccccactctgttacttgatttgtccttggcacatggtctatttaaatggtattgactggcctatagcttagagcttgatgcttagctagtcagaatggggtgactgagtcattttcttgtgctttaattgtatatatttggagctatgggttgaaggtggtattgtaaggatagactggatcttgccttggctcttggcacgtggcaagctgatgaacagtcttcctaggactggggtgtctgagagcttatccatccttgtgttccagcttcaaaactggtagctggttggggtcgtaagcaacatctttctaatattgatagcaccattttctttaaaggttgtcaccttgccattatcaactactaaaacacttagagcctctctaacctcatatggaaaatagaggagtgatatgtacttgaaagggctggtgtatgaattaaataaaatataaatctcatcacagtctctagcatatataggtgctcactactggtagttctcttgaccgccccctccccaccaactcccttctgtttcccaaggggagggcagcatgatttgaggaaacagcactttaacaaggaatctaggttctagttccagctcagctccatcaccaggtcaatgacctatttaagctctgggcctcagggttttcacctgttgaaagggaggcatcaatccttgttctggctgcattacccattttgagactccaatgctgcgtgaaccagtatagtagccactacccacctatgtctattgagaatgtgaaatgtggacagtccaaagtgaggggtagcatcagtgtaaaacacactggatctcaaggccttaatatagaaaagaaaatatcttactaataatttttacattgattacatgttgaaatgatattttcatatattgaattagtaaaatacattaaaattaatttatagtacctgatcccttttaatgtggctagcagacagtttaaaattacacttctcacttacatttgtggttcacagtttatttctattagataatgctgctctcaggaaacaattgctggaaccttaggtaaatgtaacctgtttcctccttgcagcaaaaggaaatgctctcatatccattccagctttaaaattctaggaactactttttataaaaagaaatgtttctaaacactgattttgtttgtgtgtgtgtatataatgctttatgtaccctagaacttaaaatataattatatatatatatatatatatatatatatataaagattttatgtgtaagggattatcattactgattatagtctgatcattattataactagattacaaattgaccactaatatgattagagacaagcaatatctggagtaatttctcatctgtggagaaaaatattgtgggttaaaaggcgaaaaacacatagggattattattttttttttcttttgagacaagatcttattctgtcgcccaggctggagtccagtgatgtgatcatggctcgttgcagcctccatctctcagtctcaagcaatcctcccacttcagcctccaagtcgctgggaccacaggtgcaccatgtccagctaatttttgtatttagagacggggtctcaccatgtttcccaggcttgtcttgaacttttaggctcaagcaatctgccccctcggccccccaaagtgctgggattacaagcatgagccaccacactcagccaggaacaccttcctgataggagagcagggatttggatatatgcggggagcttcttgcctgctgtatatctcctgtatccctttgctggcaaccagctcttattccctttgcttacacccagtatagaagcatgcaacatgaaaatcagttccctttgaccaagcagctctctctctctaagaccggtattaatcctttttgacaagtctattcactttagggaaaggcattggcaagatgagggatatggaattctatccggaaatagagggaaaatgaccgtttatggtccatcttgattcttcaaaacctgctcaaaggggagagatttgccatcagcccccctgccatccagccatcaatggagcagaaagggtcttcctcaccatgtaggggtctttccagccggttattccagctcttggcacccaagccctcccatcattcctcatctccccatctgtgctgttaggggggcattcagcctagaggaacgaggccctgtgggtgctctgcagatggctgtgtgagcagcatagaaccccacctccatcctcccagcaaccgctgccccagcccaggcaggtgagcaaccgagcaagcttggaagtgtttgtgctcctgtttttaccatttagaatgaggagagagcttatctaccttatatcttgagtctcagattccttactcccttggtactattttcagtaattactggctaagacgaggcacatttctggactcataaataataaggcagtcacagagaaagagtgtctggctttttcccaggctgttttttccttgcctgtgtgtcttttagtttggatttaagcctatctcctcctgttgcacccacttcaaaaatggctttacagtttggcctcaaggtacttccagaaacctatggactagggtcctgctcacagggatcatggaagtctttcctagccctgggcccacagctttggttaaccttatctaaagacttgctgggactttcggacttaaaaggtctgcttggctaaagggaggggaaacggagattatacaaagtgctttaccatggggctcctccctcagtttcctgcttctccttctccacctttgcttgttgtgctctaaaacacaacatcctatttcaagcatctgtgcaaaccttactatttgctctgatgagaacaccctcccccaaccttttgtcattgttaaagacccagctcacacttcaccacttccaagaagacttccctgactccaccttctcccactgatgatcacaccttgttcctccccatgccaggtgatgcttgtttgcatgtatgttcttcctcttcttctccccattcttcttctttcctcatgcaagaaattttattgaagatcttcgtcatttcaagcaaggccctcatgtgtctcccattcaaagagaggttgaccaggaaaagcagtatggagagggctttgagagagaaaagaacagcgtgtcaagctgtgaacttcttgagatcagaagtcatgtcttctttatgcatccttatctctccaacatctagtgcagttgtttgaataaagagagaaatgaatgagtggtgaaaatcagaatatgggagccgaaagttactttagagtagctgtcctcaagctttggtgggtgttagagtcacttggagagacccgggttcgttgaatcaggctagaccctattcccctccattgttaccatcttccaggtgactctgatgcccactaaagtttgaggaccagtgatagagcagtaattcttaacctcagctgtaattggtatcacctggggaattttaaaaattactaatgcctgggtctgttctcctcctcccctcattcttattttattggtctggtgtatagcctgtgatttgagaggtttaaaaggtctccaggtgattctagtgtgcaacaaagtttgagaatcactgctttagagttcttctaggctaacctgccttgtagtttgactcttcatgatattctaacaagtgattaatacaagtataggtgcttggcactttgtcaatttctgtcctcaattttctgaggtaatgtagacaagacctgggcttggagtgagaagtccttggtttatatttaagctctgtggctaactccagattcttgaatattaagatctggattttttcccccatctgtaaaatggggagaataccagccttcaagtgttgttgtaagtacagaatgtaatgacatatgtgagacggctaagcacaagccccagaactcataaaataaatacagaaaagggtagattgatagtgatattgatatatttttaaaatatctgaatgtgttggcataactccatcacttgttccttatggacatcgggagtaacacctccctttctcatgaaataataccaattattaatagctaccatctatcgagggcttatgatatgccaagaaccatgttaagtgatttacatggattgtcacatttaatcctcataaaaattctgagatactgtgacagatttacagatgaaaaactgagccttagggaaaagtcgtattttgaatagtgacatcctgcctgcaaaagatgtgtccatgtcctaaactctggaacctgtgaatttttctttatttggaaaaggggttttgcacatgtaattaaattaaggatcttgagatgagattatccgtcattatccccagaagcctaaatgcctacaagtgtccttataagacagagacagagggagtttttagatggacccacagaggaggaagcaatgtgaaaatgaaagcagagatcacgtgatgcagccacaagctcaagaatgccagggccctcagaaactaagagacaaggaatgaattccactccagggccaccagaaagagtgtggctctgctggattttgtacttctagcctccagaaatgtgaaagaataaattgctgatgctttaagccactaagtttgtgataatttgttaaagtaacatcaggaaactaagagagatttaagcaacttgccctacgtcacaaagcagtgaacccagaattcaaacccatgttcttaatcaatatattatgttgcctttaagctgaattgaactttgtaataaaatgtcttaggttcatttattcaacaaatgtttattcagtgcctaccatggacgaggcctgtactggctgaagatacaaaaatgaaaaaggcagaaacattcttccctttggatactctacaatttagtggaagagaaaaactttagacaaggtttttcacatacacagaaatactgaaaatcatttaattccagcagtgataggtgctgcaaaggagatgaatgaaaaaataagacttatcctggaatataggatcagatccatcctaggtaggcccagctaatggctgaggtagaggtcagctcttcattccctctggcctgtttactgagggtttgagggcttacagctccactttagccctcctgagcttgcagaagttggtccacaaacagattatttggggataaagacccacaaaagaagaaaggcagtaaagaattcagcagacggcgagctctgcaacccgttgcagacattattatgaggcagtggagtgtgtgaaaacttcttttagacaaacttcgaaaatgttgtgttcctgtaccaagcaagatttcctgtagggtcatgagaagctcactaatcatctctttagttccaagctatattacttcagggaagtttctgtcaaggcttcatgcttaagtatctctttgtctgggtttattctgtcaaatgcttatttgcttaaaaaaaaaaaatgccccaagccttagttgatctagcagcttaggaagttcaaatccccgcatacctcagaggcctcctagcctctgccctaattgctgcaaataactcatgatttcattatctgtgggcccaaagtcagaccagacgaactctggccgttggactatggttgtatagaattaaaactgacttacaagatttttctatccatggtctttacttgtcttctgaactcagagacctgaattcttcccaaagatccttcctaggactctaatttcaaccccaatgtcctcaatagttacattcacttatacattcaacaggtatttatggagtaccagtcatgtggcaggcactgtgctgatacagaggtgaaaatacaaaattcctgtctcatgaacctcactttctggtggagttagcaaatccctgtgtgggaagtactattatacctgacacttcctgagcaccatttaatgtgccataaaaactctgcaaggtaggtactattatgttcatttcacaggcaggaaaacaagttcaaggtaaagtgacgcagctagtaaatggcagagccagaattcaaatccaggctttcctggctaccaagtccatgttctcagtgactatttatttctaaaataataatctgtgtgtatagggaggaaagaaggaacaggcttagaaggctttttgctggtaggatatcctttctggaaggggatattcttgattacccttaggtggtttttcttatttgtcttttttctttgattttcatactttctttaataaatatcctatactcttatagtcagataaaaaataagtagaagacataaaaattgtaaaactcatatatacccccaaagaattgaaaacaggtattcaaacaaatgcaggtacgcacatattcatagctgtattactcacaatagccaaaagatggaagcagcctaaatgtccatcagtgggatgactggtaaacaaagagtggtacagacatacaatggaatattatttggccataaaaaggaatgaagttctgatacatgccataacatggataaatctcaaaaacactatgctgagtgaaagaagccagacctaaaaggtcacgtgtatgatttcattcatgtgaaatattcagaagaggtaaatgcatagaggcagaagttgaattggttgccaggggctggctagagtgggagaagggagcaattgctttataggtacacactttccttttgggctgccagatctgttttccaattagatagaaatggtggttgtacaacattgtcagtatattaaatgccactaaattgttcactttaaaacagttaattttgtgttaagtgacttttgccaaaataaaacaaaaataagaaaactctaaataaacaaaacagtcacaatgaagagctttggtcttgctattcttctgtactgccaggtctctgagggctacaaaaatgaatttaacattgcaacgctaactgtttttacttagtgctacagccccatttccccataagagccctggcatgtccactaataaggtaaccccaggccattcactaaacctctctggacttcttgtgtcctcagttgtcacacaagggtaaaaatgtctacacgaagtcattcccagatcctaatatgataatgttgtgctttgtaaaatgtaaattgacttgaatatatgtctctttatttttacatcaagaaacagtaggtgatctgaaattatctctgcttaccaagcatctgtgttaaaagaactgtgagcataaggggtgaaatcttggtaaagtgtctatttagaggccatgctttctgttgatgttgacattgctgttttttgtttgtgggggttttgtttttgtttttactttataataacatttatttatataaaaaggaatgtttgggctggggctaggagaaatgttgaggtaatggaaaactctaataatgcgatcatctattgaagacacgagctcagggaaagcctttctactggtgacaggcatttttctgctaaggattcccaataggaatcaaatactgctgaagatagtagaatcagacttttgtgctggatcgcaggtaaaccctgggtagaccttgagatactgcccttgcaatggtgctgagtaacagaaggatgctagcatcctgcatcgagtcagaggagctcactgtagcccatccctccagtccacccagactagctagacagtgccttcttagctctcagcagccctcatcctactgagagaggaatttggagaagacctggggaaaccttgaaagaccacctcagaatccagctaaacagcttgggtcctctttcccagggccagttgaggcaggagactaatagcaggaagagagatggctcccagctgttcagctcttttaaggtaaggtgggcctgatgtgtcacctgtactgtttattgcccttatccttaaataattttcttcctttaaaaacaaaacaaaacaaaacaaaaaactagctcttgcaatatctaaacatatttatttattgtagaaaatctagaaagtaaaatgaagccaaaattatgttactgctaacagatactgtttgtctttttaatgcatatatttttacagatatatttactgaaaaggaatcatattgagccattctcttttgtaaacaacatttgtcccttagaaacaaattcgcaagcatctttctgtgtcattaaatatttttaacatcatttttattggccatattaaatgttgatatggtttggctctgtgtccccacccaaatcttatcttgaattgtaatccaaattgtaatccccacgtgtcaagggagggacatggtaggaggtgattggatcatgggcgcggttttccccatgctgttcttgtgatagtgagtgagttctcatgagatgtgttggtttaaaagtgtgtggcagttcctctctctctttctctcctgtcaccttgtaaagaaagtgcttgcttctccttcaccttctgccatgattctaagtttcctgaggtttccccggccatgtggaaatgtgagtcaattaaatctcttttctttataaattatccagtctcaggtaattctttatagcagtgtgaaaatggactaatacaaatgggagctgggcgcagtggctcatgcctgtaatcccagcactttgagaggctgaggcaaatggatcacctaaggtcaggatttcgagaccaacctggccaacatggtgaaaccctgtctgtactaaaaatacaaaaattagtagggcatggtggcatgcacctgtaatcccagctacttgggaggctgaggcaggagaatcactggaacctgggagacggaggttgcagtgagccgagattgcaccactgcactccagcctgggagacagagtgagactccatctcaaaaacaaaaaacaaaaaacaaaaaaaacaaaaacaaatgtgttccattgtagaggtattcagtaatttactgaacctattatcacctattgttgaaaagttagaattattctagctttgtgttataaatagtagggtgatgataaatgccttaaagggcccaggacagtacctggcctcatggaggtacctactacacagtgttctcttaaatctctctgcatatttacatccctagcaacagtgcaggagaatgtcctattctactactacttaccttcactcaaactaagtattgtcattttcttggttgttgtcaattttaaaagcaaaaaaatggtatgtcattgttattttaaattccatttctttgataactaaggttgaattttttatgtttagtagccagtttatctctaacatattaatttttctcattctactattaagatactgatcttttgtttgaaatctgcattttttctagtttaacttttaattttgtttgcatgtatattttaacatggaaaaattttatttttatgaaattgaatctatcaatctttggtgtcatgcttagaaaagccttccattctccaagatgatcaaaacagtcacttatattttctttaaggtgttataagtaatcacttccttttcagtctgaatcaaattgagcaatatttccacccctaggaagggcagcagattagtctggtgccagagacaacttttctccacaacctagactcagggaatctccaagttgaatgacctctagaagtcgtataatgtgagctcctggctgataacgtgattcccgtcttccagaagcctgataagtggtggttcctcgcttctgtactactggtgggagtataaactagtacaaccactatggaaaaaacagcatggagattccttaaaaaactaaaaatagaactaccatttgatccagcaatcccattacccagaggaaaagaagtcattatacaaaaaggatacttacacacacatatttatagcagcacaatttgctattgcaaaaaatgtggtatcagtccaaatgcccatcaatcaatgagtgtataaagaaattgtgagatatatatatatgtatatatacatacacatatacacacatatgtacatatatatatacacacatatacacatatatatatgatagaatacttctcagccataaaaaggaatgaattaatgacatttgaagcaacctggatggaaatggggactgttattcaaagtgaagtaacacaggaatggaaaactaaaccttgtatgttctcactcataagtgggagctaagctatgaggatgcaaaggcataagaatgatacaatggactctggagacttgggggaaagggtgggaggtgggtgagggataaaagactactaattgggttcaatgtttactgcttaggtgatgggtgcaccaaaatatctcaaatcaccactaaagcacttactcatgtaaccaaataccacctgttcccccaaaaggtatggaaataattttttaagtggcgtttccttctagctcaacactttcttaagtgacattacacaagaataacctattcttctttttgagaaactctaaaattaggtaggcctttcttatgttgagccaacttgtcttcattctcactcttctgtgttttattccctcttctgctcagaaagtggctgggggctgttctctggactttgcagtaagattggcctgagtttctaatcttatactcagtagctgtatggctttgggtaaattacttgatcactttgagctatagttttatcatctatgaaatgggggttcaaaaattactattattacacattctaactttgagacagacaaagctaaatgctggagcaagtgggcatcaatgctattttatttagcagttatgtgtggtcattttagacttgattatgactcaagttttcctttagttctatgcttctaaactgtgtatgctgtattcaaagcagtatcttgtagtataatttatgcttaataaagaaagccaaaatatatctgtactagtccattttcacgctgctataaagaactgccctgggcttggtaatttataaagaaaggaggtttaattgactcacggttccacatggctgcggaggcctcagaaagtttacaatcatggctgaaggggaagcaggcatgtcttacatggcggcatgtgagagagagtgtgtgaacgggaaactgtcaaacacttataaaaccatcagatctcatgagaactccttcattatcagaagaacagcatggggaacctctcccatgatccaatcacctgccactgggtccctccctcaacacatggggattatggggattacaattccagatgacatttgggtggggaccccaaccatatcaatatctctagataaaattgtaaatactttgaaaagaagcaagaaggatcaaaatcagtgtcataatatattaataccaacaatctgttatgaaacttattgttacatagatgtgtcctcattagttccagtgttcctttgaactttggataaaatgacaaatagcctttcagaccttgtctgtttttaggtagaggacctggtatatggacacctaaacctcatgaggttgatttgagaattacaggagatcatgcagagctctgatagtgcattttcattatgatgttattgcccacagaatctcttctttctctgactaaagtttccattcatttcattatccccttcctagcttgttttccagatccttccctcataaaaggtgggctcctggagtgagcacagaatactttgtgctgccacttcattttgcactttttttctgctaattcattttatgcttttatttctcaacctaaattatctgctgctccataacatcaacttattaacttattgttgacttttaatcaatggcaattaactaaatctcctgtgagtttcttgcggtttttaccattcacttgcatctcccttttctcatactcattgtttaattctcatctctcattgtataatcggtgttttgtgtcccagcactcactagaagctattcctattatatttcaacatgttagatttgtcatattatttgatgctatcattttgcatgctcataacatcccaactttgtgtatgatattaatttcgttctttttctttttttttttttgaaagagtctcactctgttgccaggctggaatgcagtggcttggtctcagctcactgcaatctctgcctcccaggttcaagtgattctcctgcctcagcctcctgagtatctgggattacaggcacctgccaccacatccagctaatttttgtatttttagtagagatagggtttcaccatgttggccaggatagtcttgatctcctgacctcatgatcttcctgcctcggcctcccaaaatgctgggattacaggtgtgagccactgcgcctggccttaatttagttcctatctaagatgttgatatggctgttggcaggaaaacaatgtagacagagcctctatcatgattataccttgtcttgttgccagtgtggagaactgcctctcttctcttacaaatgcatgtagtttagattttttaaaaaaattcttttcactgatttcagcatcttcctgtttctctgaactttaaggtcagcattcccattttgtcacattaattcactcaacaagcatttgatgagctatgtgccagttactgtggtaggtgcataaataagtaatatgcatctgtcctcaagatgctcacagtctagtggaagaaacagatcaaatgaattgggcacataataggtttggggaagtttgggtaagactttgtggaggtgacatttgagttgggtattacaggatgcatgggcgtttgctaaataggaagcagatcaaggacacatctggccatgacccacatctcctctctttagcccacatgaatgccaatattgcatgcatattttctctcacagttgctgctgtttttctgaaagcagtgttttctcattcacaattagatttttgttcttggcattctagaagatgcaattgccatccagaaatgctaagaagaaaaaatatgcaccattctaagaggacttaaaaaaaattttttagatacatagtaggtgtatatatttatggagtttttgagatattttggtacaggtgtgcaatgcataataatcataccatggaaaattggttatctattcccttaagcatttatcctttgtgttacaaataatccagttatactcttttagttatttaaaatgtacagttaaattattattgcctataatacccctgttgtgctatcaatactaagtcttattcattgttttaaaaatatggaacacttcatgaatttgcctgtcatctttgcccaggggccatgctaatcttctctttattgttctgattttagtatatgtgctgccaaaacaagccccagaggaatttttaaggtgtattcagatcattgaacatcctatatcactcttatgtcttgtttcagtactagttttatgatcattaattatcgtatatttatattaataaaaataatatttgttaacatttatagagtaccttccacatgctgggtggaaggtacttaacctaccatccttctgtgaatagtacctgtgaatcatacctgtgaatggtaccttgcatatattatctccttctaccattaacaaagaagaaatctgagctcagagaggttgagtaacctcaggtcatgtaactaatcaagcagcaaaacagatttgaacattggtttctctgtctcctaagcctgaccatttacattttcttattctaccccattggtcaatataccctctgactctcttccttggtctttacccattgattctcctcgtaattgcccttcgtattagtctgctagggctgccataacaaagtaccacatgctgtgtgacttaaacaacagaaatgtattgtattacagttctggaggctggaaagtccaagatcaaggtccagcaggaatcagtttctggtaagggctctctttctgccttacagatggccactggcgtcttgctctgcccttacatggcagagagagacagactgacagagagagaggtccttatatttttatgaggccaccaatcttatcagattaagaccccaccctgattacctcattaaatgtcatctcctaaaaaccctgtctccaaatacagtcacatcggggttagggcttcaaccctaactccaatataaattttggaggaacacagttcagtccattgtacctttcttaaaacatcacatgtattttcatttctccatggttttgcttatgctgttttcccagcataagctttctgtcttttaaaatctttccaattattcattacccaactcaaatgtcatttcccatgaagccttctctggttttccagtcaaatttagttgccctttcacctactcaataatgatttttttgactgtattttgattgagcccctattttacccaaactacattatatacttaagctccttgaagttagggactctgccttaatatgctcccagtttgctcccaattttattggtactccataacatttatgacttgagtttttcattagctctaaagaatgatggaggcaattgggtgggtgtaggctagataagagaaatgcttgtgcccatctccaagtgttggaagtgatgccttacagaagacagaaaaaatgttgcttgaggggtttagactgagaccaccaggtaaaagttacaaagaagcacacttctgcccagtttatggaagaactttttaataaataacaaaaaggtgaaggaaactaacactcattgataatcagttgctaaactgctgctttacaatttccacttccacatggtcctataaaatagttcccatcttttatagatgagaaaaccacatttccaaaaagtgtaaagatctgatataagatcatgtagcctacctccgtcactcattccttcatggagaagtaatctccctttctctagaggaattgaagccatctgcatgaccagttttcaggaatgctatatcgagaatgctctgggggtgttggtataactaatattttagttttctttcatctctaaagtcttctgactcaggaattctctatccctgacatagacttaatggaaatagacctataaaacctaacttctcccatccctttgtgggtaatatatattagaaaacttatatttagattattacaaattatctttacattgtttcatgtatgttggtccagtgaattaggggtgtgtgtgtgtatgtatgtgtgtgtacatatgtatgtgtgttttgagacaggatctcactcttcgcccagacatgatcacagctcactgcagcctcaatttcctggcctcaatcgatcttcccacttcagcctcctgagtagctgggattccaggcacacaccaccatgcctgcctaatttttgtagagacagagttttgccatgtttcccaggctggtcctgaactcttggacttgagcaacccgcccgcctctgcctcccaaaatgctgggattataggcatgagccaccacgcccagcttctgtcagttagtatttatgaagctgtttggaggacacagcttggaaatatccatactaacaaaattgacttggttctgaccagtagaggctgtatttttcaaccaaaggctacactgtctggggaagaaaatggtaatatgcatgagttgtccacgactgtagaagtcagatggatgaggtacttagccttgctatcctgagtacattccatgctgaaggtgggtcccagcagcctgagccccccagggtcagcttctggggcaggcagccaatgttctgatgtagctgccatttttcttggatgattcatgtgtgaaaatgtctcccccaaaagaatttgggtcatcttgttctttttcccaaagccaggctcttatcagaccagaagagtctcttcatacaaatggatcccagttgggaagtttatgaatgttaaggatagttgctcattccaaaatacataaccctttttgtctgtggcatcttatatttgactatattgctttttctactcaacagaattggatcttagaatcctggagctggtgtatgtgtgacttcagagataacttaaaaatgatcacgtatttctgtcttctaaattcagatggtttaactcattatttcttttttcttgtgaaggcatagccttgaatttgaacacagcttttgcttttgtgtgtgtgtgtttgtgtgtgcgtgtgcatgcactataacattttggcttgtgctatgaaactctttttttttttctggtcagaagaaagatgacaacactgaatcaactgccagtaacatccaaaaccagttcaatattaccccctggtttcttttcctaggaaaaatatcacaggtatcttcctcctcttccattttcattatacaaaatatggccgggcgcggtggctcatgcctgtaatcccagcactttgggaggctgaggcgggcggatcatgaggtcaggagatcgagaccatcctggctaccacagtgaaaccccgtctctactaaacataaaaaaattagccgggcatggtggtgggtgcctgtagtcccagctactcaggaggctgaggcaggagaatggtgtgaacccgggaggaggagcttgcagtgagccgagattgtgccactgcagtccagcccagttggcaaagtgagactccgtctcaaaaaaaaaaaaaaaaaaaaaatgcaaaaagcaaaatatgttgttcctgcatggagattgggggaggaagagaattatattttgcagtgtcttgcaaggaataaataccatcaaaacacttgaatatgaagttgacactactttggaataatgtagcccattgtgcctgaagcttaacagacatgacccaaagaaaagaatggttcacacaatatcaagagtactttgtggcagaggtgggaccagactccatcccctggtcctcactgcacagccttataacgtcatagcttctcaaaagtatcctaagattgcaatggagaccagaccaagcagtcagccccatcagagcttggaggatgctatcagggaagtgtatgtttgtttcttcttaatcacagtcctattgtaagcctcaaggatttaggacccacaaaaggaaattctcaatttccactgctttttgtactcaacttttaaagtcaaagatggaaaaggtaagaaaataaacaagagactttttttaaaaaacaatattctgtatgacaccacttatatgaggtacctagagtagtgaaattgatagacagaaagtaagatggtggttgccagggattgggaggaaaggagaatggggagttagtctttagtgggcacgaggtttcagtttgagaagatgaaaaaagttttgggatggatggtggtgatggttgcataacaatatgattgtacttaatgccactgagctaaacacttaaaaataattaaaattgtacgttttgtcacgtatattttaccacagttttcagaaagtgcaacgtccttggtataatctggaatctccatacccctatgcacatgcatccccagaaacaggatatcgtattctaaagaatgataataacaaatttatgctatttttaattcaccttaattttgttgttttcaaaataattgcatatacgtggttgcatctgacagtcaccaaaactgggagaaaagcataactgatcttttatttcacagatgagtaaactgaggctcagagttacactgctgacaagtaacagagtggtactagaacccaggacttctgacatgtattcctggagccatgcatgatcctgtgtaaaagttctaagttgatacttaacatattttacttactaatcttagaaaagagactaacacattttaaaaggattttcaaaaacttgaagtggtttagaggttttaagcatgaaaataagttaacttagttacctcattgtctagacatcctgattaatggaggttttactatatagtaataataatgacaaacccttatatagaacttcactgtgcaccaggtactgttctaagtaccttaagaacactaactcatttatcaaaatgtactatttgtatttaaaatgtataatgaaatttattgagacttgcatgtgccaaacactttcctaagtgctttatacactttatctcatttaatccgtgtaacagtctgaagcaacaggtaatactagagcttggagatgtgaaataatttgctcaaggatacatgagaacaagtgacacagccaggactcaaacccaggtccacccatctctttactgtgattcagatggtgtcgtgtgtgtctttctattcactgttatctctaaatgttagttacgtcattcaggcagctggagcagtgtccaagtagggatgctggttggctcatagtttacttcttgaagacttctaattttaccctgaaattctggctggaaatttgattccattgctgaaaatggaagaaatacagctttcatgttcatgcacaatttgctttttcatttttttttttttttattatcctgagacttactgtaaatcacactttcccatcagtcctgggggttctgattatgttcatggggtctagctaagagcaagggcagtaaattactgccactttgtttgaaaatttttttagccacagtacattagctgcttttgtttgcttttccactggtggtgtgcccatttttatttcagaatttttgtttcttgaatgtctcatttgtgaataatgtagcttccaaaatggaatgattggagaaaaaatatgaacgagggtgtcttgtttggcacctgtaagttttttaagcatttatagcaaaaatgaattattgagtcccccctctttctctctcatactctctctcactcactcatctgcattctctttccttcctattctctccattctactccatttcccaaaaaacaattgctagataatgaccattatggtggctaatatcaggtaactaccaagaagtgccttcttccaggcttctctaagtattcttgtttatttgaaagattgatagatcagagggtcaggggatgtgttttattgtaagtttctgttccaaatttcctgacattttccattaaaatatataaataaataagccttttaaaaggaagaaatggaactaataagaaccagaccctaaagtgatggtcaaaatgtcaaaaataactgcttttcctttattcagtatcattaatctcgaggtagatacctacctttccatagactctccctaatagcttgacctgattctcttgctgggctattcacaaatagagtgacttctaaagtgacaccaaaatcctcagtagctcttcaggaattggtgtgggagttcagtggcaatattttcatatgtttttcaaatcacatcttttggtaaagtgatgagaaaggaggctgtggcacacactagcagtccagagcacaaggccccctcatgagtctccatcatcataatgtttgtgagatcatcctaaaggtgctagaaaatagtgatgcttgtgtgcaacctagatgaatttgaaaattaactgattttcctcaagtttgtcagagtttctaaagtggctttggaaagggttccagtgcacacgaagaggaagcttaagttagacaatgtttgtccttatcaataatccatacaaaaattgtttatttcattttcttggactttatatgcgatacctttcagggaggctgcctacctcataatagccctctgttgtctgatagctgctttcacgacccatcatgaggggccttcagcagccatgtttgaatttataaccctgtccttctggtgagagttgattggaccagggagaggacacctggcccaggttacgccagatctctttcccaggaatttgcaattggaactcagaggtagcctgttagtgtttgtcagttgctgttagtgccaagagatcaatctgggggccgtagagtgttgatcttctactgtgtgcatagaaaagccaagaaagctggttttcaaagagagatttaagcagattcataaagagaattagagtctgggggtggagggagattcctgatctggttcccggcagctttccagttcttggttctcgttcctcccgaaacctggccagacatcttgccagagtttcacaagaaacccttgcatcctgtgttaaattccccatccacctcgtctgcttttcctcaccctcttacactggcttgagttagttcctgttgcatgtaatcaaagagtcttaacaaagacagattgatacctctctggtgtgtatttgattatagagatggccaagtaaacacatagatggatgttcatacttgccctttggtaccctagaaggtttgagttgggaacaaacctcagagatctcctagccttatcctcacattagacagatatggaaactgaagactatagacaggtaaaataagtgatttacccagggtcacacagctaggactcgatccctagccttctggtcctcaggccagccaatgttctttctaggctggctccctagtgccatccatccatccatccacccatccatccagtaaatataaactgagcaagattctgctacatgacaggtactggggtacatgttttttgtcctcaacaaactcacagtgtggaaggaccaaagttctttaagtttatttttacttcattccctggggtttcccatctggagggcactttgctaactttgctagcccacgatcacagcgagttcatccaggagtctcccagaatatactcccatcatgtattctctgtgcctcttgggtctattctttcctaatatttgtgataatccatgttcatattgaatctcccctgggagatccttgaaaccagggactgtgtgtaagtcattgcttttacttcctagcacggaatccatcacaaggtacttctccaataaatgtctgcttttctagagaatttacttcactccttagaatctcaagtgagagctgtgtatcagttagctcctgctaggtaacaaaccacaacaaacatagtagcttccagcaacaatcatgtattattattctctctcctggttctgagagttgactgggatcagctagatgattcttgtgcagagtctctcatgtggttgcagtcagatggtggctgggtctagggtcatcttaaagactttgtcattcacatgtctggtgtctcgactgagaggacaaaaacagctggagtctggaacagctggggctgtttcacacacaagtgttgtttgcacaagagatgtccaagagcttctctttattctctccaagcactctccatgtggtggcctcagggtaactggtgactgaaggctcccagagggattgcctcaagtttttttaaacctgactctgaagtctctcacacagtgtcacttctgcaacattctgttctcagaggtcctgccacatgcaagaaagacacgatcacagaggtcctgccaggtgcaaggaaagggcacacagactccaccttctcatagaaggagcatcaaacaatttgcagataggtttctacatctctgcttgatatgtcttcctgcatgagaaatatgaaaaaatgaacacttttcagggagctttcatttcagctggaagccatgattttcagacaactgatagtttctggcttcactgacagctacatccattgcaactagtttgctagcccgagctgcagttactcacagaatttgctaactatggactttagtggcctaggagttagcatgggcaggcaaggtggatcagggccttgttttatcatgcaattcttgtgtgctgggaactggctaggctctatggttaataagaccgtgatgaaaagatgccttggggttcctcaatgtagtcatatatgagtggttctgtttttagttgtcaccatgatgagggtgtgcagttgacatttattgaataggggtttaggatgttaaacacgctaccatgtgctagcaatcctgctggagaaggaactttcctaccaaaaatgctaataatttctgacctaatgtcagaaacacagtgaagtggggaagctgtgagaagtgcactgtggagtcctcagcagatacgcatggtacatgtcaccaagggtggcatctggtttgagtgccacactctccccaaaacaactgcacagcttctgcccttcctctcccctctgcagccttgctctccatcaaggcccaatgcaagcaccccctactctctcacaccttccctgatttctagagctggacaggttcaccccctcctgagcataaaacagccctttccttacctctttccttgttctgattattttcatatgtttcttttgtatcactgttttgcgaggccagggagagatgggacaggtcccccctccatgtccgcacaagtgtttaataagtatttgcttatttatcttctgtttcccctctcctgtctactcctcgcctcccctaaatgcctgcacattccagcaagaggacaggaagtctggggtttctccgcctctccactccacactgggtcttgcccactctgcctgataaaagtcagggaaccatctggcctctctgccaccacctcagtaaccttggccagcctgttttgatctcagcctccctttctccaccctatcttgtgaatgccttcaacactcagcatcttgaccacacacttggcttttgctctcactctgacttgtacttccaaattagatccctagaatagctctgctttccttccagatcttaaggggctcctgaaggacagaggccgcatcacctctttttaaaaaaattccaccgattgcaaggtgttacctcctttggaaacccttctctgacacctctggcctggaaaatgggttaagtttcccctttctagggttctttaccaccctgaacatacccagatcacactttatcatgattatctctttacctgcatgactgtgtagccaggatgagtgatctttgagtgcaggctcttaggtttttgtttatctatttataatagatagcaaaataaaaatagatccgttcatctcttcatctagcattttacacgtctatctttagcaagcctgtgatcagtttaaggagccacagcaaatgaaaaaggcatggtcccatcctcaaagttcacggccttgtgtgttgaattgatttttgtctcttgctacaaagaaaatagtagctccttcagtcttcatctccagatttctcagtgcttttctgttttcttgaaaagcagtagagcagataatttctaattgttgaggaatctggttcaaaatttcaaggcaaaaccgccccattcatgagagagaacattcaagtgacagggccttcaccattgcactgccctgctaacaggagaccttgagttgtggtcaagtcagcagattcttttaaattttgaaatacagatcttgcataatgaatggagaaagggagaaagaatggcttgtgtgcccttttgtgctccttgaagtttacattctgggaaaacatgaaactggagtgtcagccttggtggaactgagttggaatgctgactggcacacaaagggattctggtcctgtttaaccaagatgtgactttagaatactgagattgtatgactttatggatccccagaggaatagaaattcatgggccagaatgacaaacttttattttgaaagccacctaggctccacttagagccatcaaatgcttgagaatttattatgactgggcaagccactgcctaagagtcaggccagggtagtgaaaatacacacggactttgtctttgaatgacctgaatgtggcctagttcttcctagcacagggctctctaccagagctgaaagcacaactgttgcatttgcatgacatagaagcagccaaaagcttccacagtgaggatcatgtgtcgtgttgatgctgaggcatctcctgtgcatggtactgaaatcacagagatgacttatgatgtgttctgtttgtgttggcccaaagcccaaaccagaaatgtatttcaggcttggctttctagattctatctccagtcatgtaaaagttcattacgtggacccactcatcctgtcctgctatagttaaggtctgtcagcatttttcaaaggtttataattcaaccacaaaggagaatgcagtctttaggctgcaatgtgacctataaagcttaagccccggggtcagaaactttgcttttttgttgttgtttttaagttaggcccttactaagttatagtgaagcaaagtaatagctggtggttttgttattattatttggtttggttttacagggatgggaaaagcttcaagtgacttcttggaatgtagatgtaccctaaacctaaagagttgttaggactatagatttacttatcatcctagcattcagctaaagatgggggtttagtttttaaaaatttagcattttaaaattgggatggatgaggctgagaaagttagaaacaagattgggaatatttcaccaaaactcaaggaccaattctcaagccagaaactttgtattcaaaattctagttaaaagactttggtcatattatataaaaatcaagtcatttccctgatggttaagtttgtttctgctcataaattctaagtattcccacttagaaatttaagtgaaaagtgcacatatgataaatataaagtaacaaaatgataccttctcataataaaaacacttgaaaatttgaggtaaaatagatacaaaaatacactttctatgtctgttcagctgctataataaactaccatagactgggtggcttataaaacaacagaaacttatttcttacagttctggaggctggaagttcaagatcaggacaccagcatggtcaggttctccctgttgagggctcatttcctggttcacagacagctgtcttctcattgtgtcctcacatggtaggagaggcaggggatgtccctggggtctattttataaggggactaatcccattcgtgaaggtaccatcctcatgacctaatcacttcccaaggccccacctcttcaccctgagcattcaacatatacattttagggggccacaaacattcagaccatatatccacaaaagcttataatcagcaaaaggtctcttagagtaacctaatttgtggttactaaggatcccattaaataacctgctcctggggtaaaaataaagactggtaaaaatcatagcacctttggtgtgggaaggaggttttatctggatggtctcaagtcaattaatagtgggaaaagttcttaatgacagtatgttataaaatgcagattggcagtagggacaggagaagagtgtcaatggaactgagttccagtccaacctgtgtacagtctagctatgctaagacctctataaaccttggtatcttccttaaaatggggctggaaaatcctatgtatatatacagggttctggtgatgacaaaatgcaataatacatgtaaaatgcctgatagaatcagtgcctaatatatgtttttcccttcttctcccacctttattaattatacctgagacataaaacaatctaaatgctggagaccagccactctaatttggtagagatcttttcttaaaaggaaaaagtagtttccctgagcttttaagagtgcatttacatacaatttgtctatttgtaaaaaagacctattcattaaaataagcctctaagtagcaaagtgcaagttttcttaaactcctttgagtggcaccacatgctaactgggcttcctaaggaaagaactataaaggtggctgtctttccccattaaccctgatttatagggggttttgctctaagtgcatatttgcagaaccattcttaatgtgtgtgtgttctctccccaaaaaggaggcacattattggccatttgttgtctttggtccagtggatactctttaaacccactcttactactctgtagtcaatagcccaagctcagcttgatgcattagtccttgtgttttcaagaaaatgtgttcggccagcacccagcccagcacagcacttcttttcttttcacttttaaccatcatatcccctggtttccagcaggttcattcacccagaaaatgtttatcttcattgtgccacctcggtacttaacctggggcagaggtttggatactggggagtgcaagaggaagggttgggttggaggtgcggtttcactctttatcagttatgtgaccttaggcaacacacttaatgtctcagcattggtttcttcttgtaaacaagggattgtagtggagaatactcctgaggatttttgaggaataagttaattacagggtttaacaggaagccaggcaagaatcaggggtcaggaaatggtagtgatagttactgtagccaggtgttctcttattcactacacaggagaatcatttggagaagggcttttaaaaatgctcatgtctggattccatcctcgaacaattaaattagaatctctaagggtgggacccaggtatcagtatttttttctggaatacttttgatattccagagatggattaaatcctttaacccccacaacatccctaatgggtaggtatcattattagcccatttcacatttgaggaaactgaggcttagagaggttaaatcacagcaagtaaaaggtgatgctcagatatgaagccaagcagtctggctccagagcccatgctcttggttggtgtgacgcagtctattattataagcagtgcctccagtgagatgtccggtgagaactaagatccagcaggtggggtcatccgatggtttcggtcccttcataccttcaggttacccacctcctgcttttaccttcagctctgtgtgttcaggacttcccagcagccctgtatcagataatgaactgtggttattcagaagtcccccgctattttcggctgattttattaaactcagcttgtggcttgaactcaagaatgtgcaagctgatttagattatgctttgcattgagtttattaagataaaaaatatttcccgagatagtgagtcagaagtatttatggtgaagtgtgctgaaagtgaatgcaggttgatagcgtgaacagaatgttctctccaagtcaaatgcgatgacctaactgtgtttggcagccttcctttatgtttagctaagcatttcatttcatgttgggaacctcctccctcttctgaaaagcatcagtcatgtgggaggctaggattttggcatgtgcctcttttgataccaagacccaggccctaaacctaattgtgactggctccttggctgactggctgggttgccatggcaatggactgctcaactctttatatctcagtttctctcacctgtcaaaatgggaatataacacttggccccaccttcctccctgaggagagatgggggcactttgaaaattaagtaataaatgttgggaaggatttgtggatttgtggatgtgacatcttgtcaagtgggtaaataataaatggggtgtctccaaagctaatttgcctaaaattcacttgagccttccatttacttcatcaaccagcgtttattaaatgcctatgaagttcacaataacacatgaagtgctgaggggaatacaaaaaatgtaaaaaggaggaaatagagtctcaattcccagagaggtcataaactaacttttttcttgcagtttgctttttctggttcattaagcctcagtacagaccatgcctgcactgtatttaaaaagctcattctcaatgatgacttccagttacgtcataagcaactagtggtgatttagttgttttcagtaccagtgggtattgtcacatgcttgatggactcataaaaaggcaagaatattttttagttcaggttatgagtggtgcaaaggacaatgaaagactacaggttggattgattgggaatctgattgcatcagaacataatatggtctctgctgttcaaaggcgtgggtttgggtcctggctctgccgctttctggctgtgtgactttgggaaattccttaacttctctgtgtctcagtttccttatctctaaaatgtggtcagttttagagtctacctcataggattgttgtcaagtttaaattaaagtgtgtaagatgctcagaatagtgcctggcattttgtaaatgctcagaaaaatgttagctatgatcatcactttccattgttaatgggagaagatggtggcactaaaaggatactggcatttcattttcctacattgtaaaggtaacaaatcctttttaattcagagtcctaaacttttgcccagatctgacacaatcgcttgggattgccccaaagccccaaactgcttgttcggaaatagaaaacatgccatccaagccactctgctctctgactcataccgttcagggcctgagctaacccattttgttctgaaagccttacaccagtctaggaccctgagggctgggaaagggcagctatggagtgtgatggaaacagcgctgggcttggtgtccaaatcctggctttgccttttattagctgtgaactctgggataggctgttaagtcctctgaactgcggtttacccatcctaattgtgcaaaagcaatggtgggtgaaactgctcaaacaaattcagacaatggcaccaacggtaccaaactagtggtcactgtacattccactgccatatacttgtagttgaaaagaaaaaaaaagccaattgcacttaagaatatcttccatggagcagtaaaaattattaattgtattaaatcttgacccttgaatacatagatttttaatatttcatatggcagatgggcagtatacgtaaagtactcctgccaagtactatgactgtctcaaagaaaagcatttgagttctgagctgaactagccacttttactttaaagaatgaccgacagaaaaattatggttagttattcttgaatattctttaaaatgaggaaaatgaacctgccgcttgaaggaaacagtagtattaattgccaataataaaatttgaactttccagaaaaagttagaattttgcgaaacttttagccaccatcacgagcttgacaacttcttcccaatcataactgatggcactggtggtgatattaatgcatttgaattttctatattagataagtaagggtgtccacattttgaaaacgaacgtaactcagtaaaccagtgttctctaaacaggcaatgcatgatgttacaaaatcgtatgtaggtagaataaccattcaaagtacaagataaatcaatccattataatttaatagattatgaaaagtttattgatatgatttcagatttcacattgcaaccaacgtttaagaaactaccacctatcgaattttggtgtagtatcaaagaagaatatcctaaattatctgaaagactattaaaaacccttcccttttccaactgtgcgaagccagattttcttcaactaaaacaacatacctcaacagattgaatgctgaaacaggaggcttcagctgtctggttttaagacaataatagatattcaataataaaaaaaaatgccacttttctcactatttttggtatatgcgtgtggaaaatattattttactaaatattttattaaaatatttatgttaagcaatgggattgtttttatttttaaataggttaataaacaaatattttaaaactttctcccctcagtggcatcaatattttaaggattatctaggagtcctgagaccaaagaatttgagaacttctatcctacagcatggactctggagccaaaataatttgtttaaaatctcacttctacttactgtctgtgtgatcttggacaactttcttaccctctctgtgccttaccctctctgttttccatgtgtaaaatgttcataacaataactgtcatgatgataaataccatttaggtgttaggtattaccaccatcattatgaaatcattattgttgtcagtgtcatcatcatcattattactagtattagcactggaaggcatcatttgttcagggacacagagctagaggtggattcagtgggactggaacttttcccttaagccagactataccctacctcccacttaccatctgccatcttgacatttgcagtctagggaagaagggaaaaaaagatgagaaatcttccatagctcaagcacatatcatcagagctactgaatcaaaccattgaaaaaggtacaaacagccaggtttacacataaaagccagattgctttgtctggcattcaagctcactggacacctgctgcctgtcatccagttgttctgcagctgcccatatagaaacacaaactgtctcagaagaagcagacccaaccccaaaggcccagattatgaatccaaagcccggggaggtgaagtgatggtctgacacacatcgctagagagtggcagaactgctacttgagtctagtgtgaattccctctggactggacacctttgctgggatgcccaggtgttctcgttctgcttactaagtaagcagctacagatggccaacaaatttgaaacttcttcttcgtcagtgaaaaggtaaaaccaaattccctgtttgtggcaaggctcctttgttcagtaaacacaaagatctatttacatttcttttgttctctctggaaacacactgcttgggtcatctactacactgatttcaaggtgccctgcaaccctcatgttgtttttagatagatattttatagagcagatcaggtgaggtgcctggcctctggagggaaaccagaaagaacatcagccagcacccatggctaaagcttaggcccattaaccagacagtcttggctgaagttaggggaagagcacaaccctgtgggtatatgtgtgtccacggcccaccttggtttagggagatattccaactctccatgggtctcatggtaccaaatctcagccctcaatgggtctcatggtaccaaagcagactggtggagtgaaaagatttgggcttggcagccagagagatgtaaattggacctcagttctgccacaaggcctccggcaagtcactaaaccactctgatcctaggtttcctcattgtaaaacagtgataatgacttctcccttgcaaagttagcatacaggtgaatactaaagtaaagccctagcatatagtaggatttcaaaatagtccattattggtccagaactggccagctgcctcaaatggactttctttaggtgcttggctgagcctgaggattaaaggccattagtgatggaagctttgggcagtttcctgagtaaccatggggcaagtctgctaatctctgagacatgacttcctcatctgcactggaaatcatagtaattaatgtgcctttcttacttctctagattgttagaggataacaggagacagaggctgtgaaaacattttgtcatgtgaaaagtggtatacagaagttattgttataaaaacaatagtaacaacattaattaacatttttgagtgcttactttttgccaaacactggttgaagtgcttcccagatgtcactcactttcattttaatcctcttctaacagttccctcagatggagccctgtttattattttggtttttccgttggttaaactgaggtacaaagaggttaagtaacttgcccaaagtcacacagataggcaaggggctgacctgaattcaaacccagccaatcaaattccagaacctgtccaatgcagtattaatcactatgcttatagtggcattgttatgtgattgctatctctaagtttctctccacaaagggtacatagttatctattctcaatgaatgatatggggctataaaggcatgataatggctccatagagccatctgctaattagtctccctcctttctgggcatacctcaaacatcttaggaacatatgtgcttatatccatgagcaaacacattcgtggattgagtatagatgtatatagattggagaaacatgcccaaagatagagatcaaaatataaatgttaggaagcaaagcattagcaagatcatttatgggctcatgaatctgttgtgaaggataattattcattggcttaagtgagatggaaagtgtcattatggtaatgcagtagtcatgcttaatctgtttcctactgcacatgtgataaatgccattcatatgtgagacacactcctgtgaggctgcccagacattaacaatgttccttctgaatttggggggacggaaattaaagcaaataatgaatcaattatttttagcatttatgaactcattttacagacatttgggcaattaaattacccggttaaatagctcagaaaaatgttacttttcaataaacttccattaaattcaacaaatttgtggcgttctacctgtgctgtccagtacagtagccactagccacatgtggctatttaaatttaaaaattcagttttcagttgctccagccatgtttcatgcattcagtaagccctgtgtgactagtggctatcaatcagacagtgcagattatagaacatttccatcattgcagaaagttctggtggataacactgctagacagtagtatacactgaggatgcagtgatgaccagaacattcccatccctgcccttatggggctgatagctctgctgaacaagttaccccagacttggacctacggaaggacataggacaatgagaaagtatggcaggggatctatccaagaaggggtgcttaggaaaaatgaaaccaaagaaagctccctacccatgaataacagagcacgtttttaaaagaaatcaaacttaattaaaaataaataaataattttatctgcaattggattctacaactaatattaatattgatgtttaaatacttgattgaagaataagcttaaataaaacttattttgttattaaaattcatagtgcaataaatcttaagaggagccaaagcaaaatatacatgcagcatgattccatttatatgaagttctgaaacaggcaaaattaacctatggtaatagaaattagaaccttagttgcttcaaggtggggtgggagggagtggttgggagcagggaccaactacaaaagattgtgggggtactttctgggttgttgatgttctatcaagatagggacatttgttacatgagtatatgcatttgcctgtactcatagaactgtataactaagatctgtatattgcacagtattgtatatgaattaatctatatatatgtgatcaaaataattacatattgtaacatgttatggttgatatcagtaatattatggaaatgtccattgctttattactctgtctgcctctgacctggccttcataaccttatattgtcagtaacatgaaagtttcaggcatcctttctgatcttgtgccatgtggatatgaatgtgttgctcctacttttccaatttttgatgctttctttcttatcaaaagtgagcaaactggaaggatgtttgccaggatgttaaaaatggtgttatttttgggtggggagatttgaggtgaactttattttctctcttttgctatgctggaatttggaacaaggagtgtatatgattttttgatctgaagcacaaaagcttatccatgtagtcttttggagactttgggttctatactctgattagtgacaaattttcttccaagcagcaggctctatgggtggttatttagcagtcctctggtcttaatcaatgtgattgtttctttccttgtctgtctcacctgcctctcctgctcagcctctctgtgatcccaagggtacactggaggggatttggctgcttggaagccctctcaagctgtctgcccctctcacctgcctcctctctgtgctcacagattcttacctgaccctcgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggtaagcagacccctactggggatggactttggccctcagcccaatgtggtaggatggctagagtccacagggacaggaaggaaggaatgcacacttagtgagaatgtactctgtgcccacaaccctaaacctggtatggttgtacccattttacaaataagtaaactaaggcccagcagttagttaccatgttacccagctagtaaacagcagagcaggaatgaggtccggatctttctgacctcagagcccctaattgaaaccatcgtgccgttgagctcttttcaacaaggatgcttcttgtccaagaagttggaaatgttcgcagcgtgcatggcccttttcctgccatcaaggactagaaggaagccccactcactgttgcaatcaacaccttcatgcaaccactcagcccattggaaactccctgcatagtttgaagatgcttactcgattaactctttttttagcacttgtcttagcattttcaggccctgaattgtgagacatagacacgttctcactggtattttttttttttttcatagagatggttgggggaatagagcaaaacaataaattccagaaaaataaatactacctctgggtggttgagaactttaatttgtaatgatttgactgtatccatactcaccctccaataacctagactgactgtttcttttgtttttctttcatttcttcaggcccccctcccactgcaagtccaggatactcgtaagtacttttatctcctttcttgtcatttctaagtgtttctccgtggttttctagggcaaaagcaatgttgtcctcttcttaagccaaaatactggcttccagatgtcattccattttgccctgccctcattccattttgcttgttctctgctctaaagattcacaggagaccaccattggcagaattctcaagtgtagtaatgttgattctgaatgatcaaagcaaaaatcttccatttactgttttagaaggaatctaacatttagtggcaacaatggattgatttggtaaaatcaaacaaaaaatgatatagtgctggcataggaacctttactctcagggtctatgtttctgcaagcatttttgatgaattcattattgatcagggcaacaattaggtaatcactttattttttattccctttaaagaactcaaaagcagaagttctggctgggcgcggtggctcatgcctgtaatcccagcactttgggaggccgaggtgggtggatcacgaggtcaggagattgagaccatcctggctaacatggtgaaacccgtctctactaaaaatacaaaaaattagccgtgcgtcgtggtgggcgcctgtagtcccagctactcgggaggctgaggcaggagaatggcgtgaacccgggaggcggagcttgcagtgagcccagatggcgccactgcactccagcctgggcagcagagtgagactccgtctcaaaaataaaaaaaaaaaataaaataaaataaaataaaataaaataaaaaagctgaagttctaacttacactgggaaagaaagtcccaagcttggactgagagttgcatggaagtttgattcattttgagtccctcgttaatggagtctaaaggtccaatttctttcactaatgctattgttgatgcgtttgtcatttgttctggctaaaggattctcatctttcactttaagagtatctacttggggcatttttctttatctatatttttattttgggggaaggacccacttattaaaactcttactctacaaaaaaaaatcctcaatactctgtagacttttgaaataaaatttttgtggctctgccacaagagcatcaaaatgtttgatctagactacacctatggcaaatataacagccacttaatttgctccaatcccctctgtgccacttaattacagtgtggggtattttaatacatttgtgtgtgcctggaggcccagtggcccacaatcccattaatgaaataggtaatgggtaaaaataaacattggccttcagccacacagttctgctatttcatcagccagttaaaggcaactgtaaaagagtctttaaaatcactcaagtgctaattgcattctacttgcccaggtagaaaatgctgattgatcttaaaacaggtcagaaatttggtcactctgccttgcatttcttgatgctaatctgctttttttttttttttttcaatggtctcaccattggttatatgtggaatccttttgaagtcttagttaaacaaagatgaaaacttttgttacttgtaaaaatgtctcccaccctggtaccttatttgttcctgttaatctgtgtttcaaatgtggctgataatctatatcccaggctgattaatgtggttcactaatctgcctttactattaagtactgtgttgttgactttcagcctgttgtatttgcattagagttctttttattatcaaaattatgattatatccttctatgttcttcttgaagttttcattcttcactgctgtccttctgatgaacccagtctaggtctctcgtggtttttaatattatacaaagattttatacccctgttgtgaaccgatatctatggagagggtattgaagttccttaaagatgctcaaccacagctaaaaagtatcctttgatatcacgcatctctgttttatattagctgtcagattatctattacattagtcggtaatagcatgaaatgtatagttaccatgtttgcttgcagggagttacaataaaatacaattcaaattggaaatcccatggggccttttgcagttacatctccattctgtttttggcattcctagttggcattttggtaccttttttttttctttcccagtgatgcatcctgctctttatctcttctcttaattgccaccacttcccctgtctctaggagttcttcacttcctgagactaactcccagaaagaatgctggttcccatgcctagcttcggagtagccctcaataggcagccaaccttctctccaaggggacaggcagaagataacaaaatgatagccatggggaatatcataacattgaggtccctctaaaggttgtttgtcaaattgtacactactatttccaaaagaggaatgaaatacagttataaattgctctgtttatttgaaagtggcacagagttactgcaaaagaaataaaaggagcatctatgacccaactctaacattcagaacgtaaggactgtgaaatacattagacatatgaaacctggtgagagctgaggtccactgaggcaacagggctacacaactcctgcctgggaagggcttgtagggacccttgggactatggcccagaaaggcacttgtcacttcctctgagggactgcatcaggtttccacatgaagctttcagaatgatattttagtttacagtaggaacaagcttgatattttcgtttggtttccgttcatagatttaggcttcatttcttctgtcattgctgggtcctggctacccctaacacttataggacctggggcatgagtacaagcggaggttcacataccatatgtctaaatatttaaaagttataaatcaagctagcaacattgttgaataaaatatgttctatcttcccacagtgtcaaatatacctttttaacgttaaaattttaaaatacatagaaagttgtggtgtgttttaaatgattaagagccaggaactatgaaaaatggctattttaatcattgttatgcatgtctggatgttttgttcatgggccaaagatatcatatataattcatagattgttatatattagttccataaaaatttgtttgccttcctttcaggaaaatgactacctaagttgttttatgcaagatttttacagtgtatattctattgataacatcgctaaattagacaaatttgtttttctttttgttttattttattttattttattttgaaacaaggtctggctctatcacccaggctggagtgcagtggtgtatgatcttgggtcactgcaacctctgcctactgggctcaagccatcctctcacctcagccttctgagtacctgggaccacaggcacgcactaccgtgcctggcaaatttttgtatgttttacagagatggggtttctccatgttggccgggctggtctcgaactcctggcctcaagcaacccacctaccttggcctcccaaagtgctgggattgcaggcttgaagtactgcacctggcctgaacaaatttcttaagtccttgtcattcttgcttttttttttggacaggttctggctctgtcatccaggctggagttcagtggcatgaccttggctcactgcaacccctgcctctgcattcaagcaatcctcccacctcagcctcccgagtagctgggactacaggtgccagccaacatgcctggttgtaattcttacactgtaaaactaattttaatttggagaaacttcactccctggagccagtggcagctatagttatcaataaaattcctaaagtgatacttaaatttggaaatgaactaagaattatacatgccatgttcaaacacagaaatggaatcatatatgacaaataatcattattgtagaatatattacaaaatattacaatttaatcatataaatcagtatcatacttcatacattatcctaggtttgtacaaatttaagaataatatgacttgtttaatgtgttaattttcttgggctgctggaaagtatcacaaactgcatggcaaaaacaatagaaatttagtatctcatagttctggaggctagaagtatgagatcaatgtgttcatggggttggttctttcttatggctatgaggaaagatttctcctttccagaagtgtgtcagaatttttccgtattcattggcttatagatgcatctccccaacctctgccttggtgttcacatgatagtcttcctatatgtgtagcccttaatttccccttttcataaggacaccagtcatactgtattgggatccaccgtgacgacctcattttaacttgattacctctgtaaagacctatttccaaataagatcacattccaaggtacctggaaattaggacttcaagatacatatttgggaggacatggttcaacccataacacttgatattgcaaagtttttctcagccatgcaaaactcttgcaaatgttattctaatgtgtgagagctttcagaagcgctggttggaatataatgaaaatagatgtttggtaatattgggaatgatagtttgttgtgcaagaatattttgcattcaaactgagagaagaatttgacacattggttaatttatcttttctcctgctgaagtggctctgccactgtagtttctcctaggctctaagaagagtccatctcctccactggcagtgtcacaatacacaaaactttgacagtatgcagttgtggtcaccttctattccaaggacagagggcaagacatgtagagaaatgttccctgggccagaacagtgctggtcacaaaaatagatgtctaaggttttgattacattgtgcgagcactcattgccagatcccaagaggcaaagggttccatgcgtactctttactctcattacatatattccctgtgtattttttgtatgtaggcccagggccaggacctttctctctttttttaataacagttttattaagatacagttaaccataaaattcactgttttaaagtgtgcgactcagtctttttactatattcacaaaattttgcaactctcactactatcttattttagaacattttcatcatctcaaaaagaaacttctcccagctatagtagcttctaatttacttcctatccctatgaatttgcctattctagacatttcatataagtagaatccgacaatatttgtccttttgtgtttgccttctttcacttagcataaggatgttgaggttcatataaattatagcatgcatcggtgcttcatcctttttatggctgaataacagtccatgcatggctataccacatttcgtttatccatttttctgttgatggacatttgggttgcttctactttttgcttattctgaataatgctgccatgaccattcatgtgcattgtggggtatgtgttttcaattctcttgggtatatacctagaaatagaattcctgggttatatggtaattctatgtttaactttttgaggaactgcaaaactgttttccaaagaggctgcagcattttgtatttgcagaaggatagtatatgggttccaatttctccacatgctctccaacacttattttccttatttaaaaattatttatttatttatttatttatttaaaatttattatagccagccgggcgcagtggttcatgcctgtaattgcagcactttgggaggccaaggcgggtggatcacctgagatctggagtttgagaccagcctggccaacatggtgaaaccccgtatctactaaaaatacaaaaaattagccaggtgtggtggcgagcatctgtaatcccagctactcgagaggctgaggcaggagaatcacttgaacccaggaggcagaggttgcaatgagctgagatcatgccattgcagtccagcctggccaacagagcaagactctatctccaaaaaaaaaaaaaacaaacattattatagccatcctcgtgagtgtgaaatggtatctcattgtggttttgatttgcattttcctaatgactcatgatgttgagcatcttttcatgtgcatattggccatttatgttttctttggggaaatgtttgttcaaactttttacccattttttaaattgaattaattgtctttttattcttgaggtgtaagagttacttattttgggtatatacccttattagatatatgatttgcaaatattttcattctatggattgtcttttcattttcttgatagtgttctttgaaacacaaaagtttttcattttgatgacattcaatttattacccattctttggttggttgtgattttgaaaaccatcgcctgatgcaagcgtacaaagatttactcctctgtttttttcctaaaagtttttatttacagttttagctcttacatttaggtttttggtccatcttgaattaatttttgtatacagtgtgtgaggtgggagtccaggttcattcttttgcatgtggatatcctgttgttccaatatcatttgatgaaaagaccattctttacccattgaattgtcttggcactctgttaaaccaattaaacatgtgtctatgtgtctatccctattcagttctacatagtcttgattactataggtttgtagtaagttttgaaatcaggaaatatgagtactctgtattagtattccactggagaaacaaaaccagtaaaattgtgtgtgtatacatatataaagagatatattacaaagaatttgctaaaatccttagggcagggagccaggaggcacaggctgggaacttttgggcagttgctcatgccatagtccacaggtagaatttcttcttcctcagagatacctcttaaggcctttcatctgattggatcaggcccacccaaactattgaggatgacctcctacaaccagtcagttgattgtagatgttaataaaatttataaagtactttcacagcaacacctagactagtgtttgaataactcaggactgtaccttgccagttgatatgtaaaactagtcatcacctctttctatattgttctttttcaagacttttgttgttgttgttattctgagtgctttgcatttccatatgaattttagggtcagcttattaatttatgccaccaaaaagtcagctggaatattgataaggatggcattaaatctgtagattaatttggggagtactgctgtctcaacagtattaagtcatctaatccatgaacatgggatgtctttccatttatttaacttctctaaatgatgttttgtagattttggtgtgcaagtcttgctctcttttcttaagtttattcttaagtatttgattatctttcatgctattggaaatggaattttttcttaatatcatctcagtttattcattgctactacatagagatacaattaatttttgtatattgatcttatatcctatacccttgctaacttgcttcttagctctagcagtttttttgtgaattctttaggattttctatctacaagcttgtgtcatctgcaaaaagagattgttttacttttttcttttcaatttgggtgccatttacttatttttcttgctttattgccctggctagaaccctcagtacaatgttgaatagaagtggtgagagtggacatcctgttttttttttaccttatctttagtgaaaagatttcagtctttcaccattgaatatgatgttagctgcgtttttccatagatgccacttattagattgagaaaattccctattattcctattttcttctatgttttttactatgaaaagctattggattttctcaagtgctctttgtgtgtccatttagatgatcgtggtgggtttttttttttgtcctttattatattaatgtgatatatcacattaattgatttttgcatgttaaaccaagcttgtattagaataattcctacttggccatggtatataatttcttcttatcttttgctggattcagcttgctggtattttgttgaggatttttgagtccatgtttataaaatatattggtctgtgctttgcatttcttgtgatagctttgtctagttctgatataagggtaatattggcctcagaatatattgggaagtattcctttttcttccattttttaagaagagtttgtaaaggatttttatttaaatgtttggtataatcaccagaaaagtaatctgggcctgaattttcatcatgggaagttttaaaattactaattcaactttcttacttgttataggtctatttaaattttctgtttcttcttgagtcagttttggtagtttatgtctttctagaaatttttccatttcattgagattatctaagttattttattcctttatcattcttttaatttctgtaacatcattaatgatagtcccttttttattcctaattttaataatttgtgtctttttttttcctttgtcagactagctagtctaactaaagatttgccaattttgttggcaaagaactaactttcgttgaaaactggatattgaaatagagtattgtgacaactgtggaaatcagattgcctctcctctgatgttgctgtgtgttgtttttgccgtttgtttggtgaatttcctgaattaattctgtatagtctgtattttctgtcatgtactccctttaaagagagaagtctcagccaggtgcggtggctcatgcctataatcccagcactttgggaagccagggcagctggatcatgaagtcaggagttcgaggccagcctgaccaacatggtgaaaccctgtctctactaaaaatacaaaaattagccaggcatggtggcatgcgcctgtaatcccagctactcaggaggctgaggcaggagaatatcttgaacctgggagccagaggttgcagtgaaccgagatcattccactacattccagcctgggtgacacagcgagactccatcttaaaaaaaaaaaaaaaaaaagagatgtctctactcagttagcctagtaactagttaatgattggacagaaatttccttaaaccagtaagtctcctaccctttgccaagaggtttaaggaaacctctgtccagtcattaactgatcactaggttaactgaggaggtccaaattcatcctgcctcctctagtgactgctggggtgctagttttcacggttaccacagaacttgagagaggaaaatgagaacggcaaattaaaatgccataaaattccattcttaacaagcgttagtttttttttcctatatatccactccctcacctatcttatgacatatgagaaatcctaacatgggacttggtgtataattagcattgaatgaatttaagttttctttctttctttcttttcttttatcttctgtggtctcctgcagaatcagtctataaaaagggcatggtaaaaaaaaatctatctcatagcattgttgaaaagattaaatgacataataagatgatgcatatatagtagctagcactgtacctgatgcatattaggagcttgataatattactaacattatcatcatcaatgctatctgagcaaagaggctgttccttctttccagccagagttcttctgttggataatatttccagctgtgaaccccaaccagagaccttgaagcctttatttccttttctctcattggcctttggctgaagtctcctttctgcagagaacaaagtgaccagcttttgatgaactattttcctcttttatccatttccaagtgttagccatagtgaagaagtgtagctgggtgctagcccaactcaagaagtgataatgtaatatccaacccaagataaactcaaggataactttcaacacggctactcaagcagttcaggggggaggcatcttgtagagaggagaccaggaagtcacttggcagctgggccagcacacagagggccattgctccagtaaagcagctaacctccatctcttcatcaaaccatcctagactcagcactctgcagagaaggagcagatggagggaatgtgtggagagattagataagaaggatttctaatctagtgggggagcgagtaaaatgtacagaagtttgagaagccaagctcttatgtaccaatccacccccatcactcaacaatccccactgtatgaataaagcctggaaagtttccaattaaaacagtgcttgtgaatattggcaaggggtatctttgtgtgcagggtacatttaaagggagaagggtgaagatacacccttgccttctaggagtacactttctgagagcttgttcaccaggctgtgagtttctcagtctatctgtttctcagtctgttagtaatgaatgtatctcccacttagcacagcagctagcacatagtagatgcctaacaaatgtgtgttaaattgaatgttggaagtctgtgtcctgaaagcttttcttcacatattacaaggctttttatttgttcaacacatttttaccaagtttttttctgtgttccaggtcttttgattagctgtttttaagtcacagaaatgggtgtcgggaacaaaaccagtcaaaagtcctcattctacatcatttacactttcccttcctatatttataagttttaatatcagcttctacaataggttccagaacaagtggtgctcaaggaatggagaaaatgactattccaaccctagctgtaggtgaaccaaaaaccccagagaaatcaaagtgtagtttaaagcagtgcttctcaagttgtaatgtgcatatagatcacctggggttgttattaaaatgcaaattctaaaagagcaggtctgggagtgggcctgggactgcatttcttacactttcccagggggtgctggtgctgctggttcacacacttagagaagcaggggtttagagaagaggtgcctggccagatgctagttctttctgtgtaatttgctagttcactagccagtgaccctgggcaaattgcttactttctctgggtcccaagtttctttatttgcaaagtgaagcacttgggcttaatgtcttttatgattttttttctatctacatttgatgactaactgaaactcaacatttcctctgttatagtaagatcttttcattgctgtgaatttcatgcaacttgctcctagattctctttctgtaccctgaggtgttaatcaccctcttttatctgtcaggcgcttctatcctgtgcattctaaacaagatcttatctagttactttcaaacagtgtgaaagatttttacagggaactctcacctggaaactctccctcaaattctgaagtggctgtgatattgtgcgctcctgggtgcagaggaagttactgctccttttgctggtcagtagcagactctacttgcctcctgttgaatagaacagaattttcttgccatatttcttcactaggctcctgctctgttgggtgactgcctgtgttttgaattgaatgaaaggattgtagcaggaggcagtgcagtggtggattcagcctcttaatgtcttcatgtgggtgttttttgttgtttttgttgttattgttgttgttgttgttttagatggagtcttgctctgttgcccaggctgtagtgcagtggcacaatcttggctcactgcaagctccacctcccgggttcatgccattctcctgcctcagcctcccgggtagctgggactacaggcgcccgccaccatgcctggctaattttttgtatttttagtagagatggggtttcaccgtgttagccaggatggtctcgaactcctgacctcgtaatctgcccacctcgacctcccaaagtgctgggattacaggcatgagccactgtgcccggcccatgtgggtgtttttaaagcactgacctttttgcctgactggtaggcccagaaggctgataagaaaaacaagatttctggctttgcatgtgtgacttgtgaatgcaggtccattattgattcatcacgtcttgtacactcatagagctttttgagggaaacaactgaacctcacaacaaacatagctaatgaaatgttatgaataatcttgatgatgttaaagggtggctaagcataatgatcagttcttcacataaatattgtatgtaattagccttcgactttgtagggtaggaaagacactcccctaccctcttaggttctgtggctggagcctatgaaatgaattttgaaaagacagattaacaaaagaaaaaacatacacattttatttgatgttaatatttttacatgacacagggggtttcttagaaagaagtgaaaccccaaagatatggttagacccaggggctcatataccattgtaaccaagaatgataaattgtggagacatgatcaggcaaaggaaaaagaggtttgggatagggtggtaaattgtgggaaagtgactagaaaatgcatggaggaaactaatggaaaaaaagtgttatgttagcaaggtttgtttgtacagattcctctcatcgtcaactcattatcttctgtggtatgaatgttttcttcttcgtggtttagggaggagatctttctcacaggaaatgtatgccctgacttttgatagaaaggaggaagacagcccttcctaaatcttttgtttctcagttgccttcagcccaaaatagtgaatatgccagtgaatcataatgtgggatggcatatcctaatcccctccaacttcttcagtggaatgtgcaggtttcttccttctttgttaagcctctggcttttttcagtgtcagtgttgacaattttatctaattgctctcctcttttttaaaaaattatttttaaaaattaaagatcatctgttgctgtcctctctatgtctctttctctgtctctctctctctctcccatacacacacaaacacactcattcacacagtcacacatgctccagaagcaacaacagctgggttctcattatctagggcagtgcttctcaactccatctccaccttagactcacccagggagctttataaattacctgtacctgggctacaccctagataagttaaatcagaatctctcagagtggtacccagtcatgatattttatcaaatcaccccaagtgatgtcatgtccatgcaaccagataggaccctctcccatcccccttctcacctgaaaggaacttgcattagcccagctctacctttctctctctctctctgccccagcaccatattgtagacaccaaaggagttgcagcagcagaaactgtgcctggatggcaacatgcctacagcatcatcaggatccaatcaggaaagcagaacaaattctggactatttaacacagagaatttaacatagggaattggttacacaggtgatgaagtttgccaaaaaagcaaacaagaaattgtgatgcagcatcagcaacagacagaagccccagctacacttaggttggagggaaaaatagaaggggtaatattaccagagcctaggtttggggtcatctttggaggctggaatggtggcatgtctgttctgtgggcactggagtcatgagaagatgcttccactgctggggttatcacccaaagcaaaaagaaatgggagaaacaacttggctgctgtcttccttcacactttcaaatgccagccagtttctcccattaggggaatgctgcaagaaactatatgacacagggagcctgagaatcacagcctgcagaggtcatctgccttgcagatgctgacccaagcaggaaacgggcaaggaacggatctgaagacaaataggtgcagcaacagcactcataccccagattgatttccatgccactagaaagccgagcctgcagacagccttgaagaaacaggctggggagaagacaaagcattcaaagctgcaattcctgcccaaccttcaggtagaacattcagtggacagtttggattgtggaactgaggcccggagcaaaggtcaaggctgagggggcagacatggtggtacatttggctaagttggtggacaaactttgaagggagtaaaactccccaagagaaactaaaaaggaacaagaataagcagacctcttttatttatagtactgtctgtaattttcagaatattttttcttttctcctttgatcttagagccatctaatagctttgactagataccctggtatttttgttttctatctagaaaaataaaaaattgataaatcatcatacccttgccctttatcataacaagcactttttaattgtgtagaggggtgctctgatctagacctcaatatttatgaacttttgaaggctgaaaatggagacagtaaacttctagatatttgcttcctgggcctccaaagacagaatttgctaactgtggcaaacacttactaagtgctactctgtgccaggcctttttataaaactttgcacaaaaactaatagactattacttccccatttactcacacaaggagactcagcaaaggatgaagctttgatttgagcccatgtaggtggactccagagctcagactttggccagtctgctataccagctgtccttattgtggggagatgatcagttgatgaactcttacctgaattacaaatttagtcaccttaagtgtttgattgctgaaaggactcacaacactcaaatggtttatcctcatggggtagttttattacagacaagggaaacagtacagcaacagcagaagacagataggtaatgcaggggtcccagagatatcagatacaggcttctttatcctcctaaaactgggttgcacagggcactctatctccaggtcttgaaggtttactggcatacatgtgcagaacctcagttccaagaagtccagtagtggaggtcacttatagtgagctgatcacatgggcacattccagctgtgtgacatacacttcagtgattgaagccccaggactccactgaaaccaggtgcaaatcataccatccagttattattactaaataatgctaactgactcatacatcctaccccaaacaacttgaagactcatagtttcagagcatcatttatctttagtaaatacatttcatagtgattgccgatagttagtggttctgaagattagtctggggtcaattcaggccagctgggatcaccctgtgcctttcaacccgcttggccttgcttagtatgtaagtcaggaacccactcctagaacttgaacaatggtaaagtcatccaggtataaatacttgccactgggatgggacgtgttccatagataacagaaaagttatcatggttcagtcattacaaatgtctattacttcagtggatggcctggtatttttgtggccagcttctgatgtccttgtcttctactcattattctaagactgctgggtagctgtcctatgtgcttacatgaaaccccaactttctctcaaggccgttaaaatataacatgatgagtgctgtgatacttatctgtgtctctagagcagcaatgctgtccactagaaacatcatacagggcacatatgtaattttaaactcactttttttttttttttttgatatggaatctccctctgtcgccctggctggagtgcagtggcgccatcttggctcactgcaagctccacctcccaagttcacgccattctcctgcctcagcctcccaagtagctgggactacaggcgcccaccaccatgcctgactaattttttgtatttttagtagagacggggtttcaccgtgttagccgggatggtctcgatctgacctcgtgatccacctacctcggcctcccaaagtgctgggattacaggcgagagccaccacgcccagcctaaactcacttttaagccacattttttaaaggctagtcaaatgaagcagtgagagtggagaaggaacaaagaaatttgcaattgcttgtgatcaatcagttgtaaacacgatggcacttgacttagccttaagttttactttaaaaagttaaaagaaacataaaattaattttaatatatattttatttaacccaacatatccaaaatattatttcaacatgaaatcaatataaaattattacccgctttattcagatataattgacaagtaacaattatatataattcaggtatacaatgtagtattttgatatacatgtacattgtataataattattataatggaatatctcatatttttttttctaagtcttcaaactccagtgtgtacctgtagtttatatttacaggacatcttaattcagatgctaaattttcatggaaatacttgaggccaggcgcagtggctcacgcctgttatcccagcactttgggagactgaggtgggtggatcacttgagcccaggagttggagaccagcctgggcaatgtggcgaaacctagtctctaataaaaatacaaaaattagcctggcatggtggcacatgcccgtagtcccagctatttgggaggctgatgtgggaggatcatgagcccaggaggcagaggttcagtgagccaaaattgcactactgtactccagcctgggcaacagagggagaccctgtctcacaaaaaaataaaataaaataaaaaggaggcctgtcgcggtggctcacacctgtaatcccagcactccagcctgggcgacagagcgagcctccgtctcaaaaaaaaaaaaaaaaaaaaaaaagccatacttgatctgtacttatattttataaaatgaataattaaaaacataggttcacattcccaagttatttcaaatatactcaattttctagtaactgaatcaaataccaaaacattatttttctttcatttttgcatccacattgacaaaattggttcatcatttttagaataattgaattgactttgaaccacaatgtatcatttttcaaactatttctatccaagttaaataaattcttttttttttttttttttttgagacggagtctcgctctgtcaccgaggctagagtgcagtggtgtgacctcggctcactgcaagctccgcctcccgggttcaaaccattctcctgcctcagcctcctgagtagctgggactacaggcgcctgccaccgcgcccgggtaattttttgtatttttagtagagacggggtttcactgtgttagccaggatggtctcgatctcctgacctcgtgacctgcccaccttggcctcccaaagtgattcactatatcttgtatcaactcagtattatttatatcaaattcaaagggatattgcataaattgaaaagcaacactgaatttatcaatgtcaacaaaacatttaaatttttcttgcagtttatgcaggcaatttacaaaatgctgtcaattacaattaaaatcttcagcatattgatccgtgttaaatgtctaaaaacgtcatgattgtttatttgtattgtgaaaagcctcagttccaacatacattcttatatctgtctagctaggttacaataagcttttccttttcctggagctgcatattaagtttgttcatatgcaacatagtatcagtgcaaaaatgtaaatcatattgccatttttttttactttgattattatttggcaaccatccttccatttcaagaaagtcttgaggtggagttagcagtgcagtaaatctttgtaaaactattctacagtcaatcagcaagcactggcaaagaatataagatcattaaatccattgcctttgatttttttcaacatctctgcaaactgtcaatgattctatttgcacatatatatgaaatgattttaacgactgtatccatgataccttaatttataaagtctgtctcagaaaactgagcacatatattttcagtttgtatcacaaagtacaacaaagcaataagggaaccatcagtattgttttacaattccactaagtctagttttttgacctaatggctagagtaccatccattgtgatagaaatttttttttcatacctaactgaaattctttgacagatgtaggagattataaagtactccacaagttccgttttacaggctgcaaattgacatttctttgtgaatttggaagtcctttaaagtaaacatacccaaaatatatcttttcaagtttctcttgtatgtcatgcctcatcaaaaactgaagaaaagtttctgcaatttttcaaaattttaatcaattgattttatttttatattctataagctaaataatagctaaaataattatttcttttaccatctctgtatctgaaagtggttttatagctgtacaaagttgcaagcacagattctgttaaaattgtgtagacttttttttgtaggacatttatttaattctaatttcaggtgaccaatttcatcaattttttttaactggtggcggggggaactttaaaaaaaaaatcaaaatcactgtgtatttgctgaaaagggtctctttattattgtccactttattatctttaaagttctttttgcacaacaaacttttttgtgatgatccattatgaaatttgtggcatatcttcttcccgtctcttttttccattacttttttgtttcggagagactttccttgcctcaaacactacagaactcgtaacttctccacaatagtacatgtttgaatcaattttctgtttagggctaaaaatagaaattcagaaaacaggagcagcagtctgataggatttcaaagcagcattcagcagactacatttcctcttgggttaaatgtgtgtgtgtgtgtgtgtgtgtacacgtgttcatgtgtgtgattgggtgatcatcgtgattaaagagaaagggtaaattgcaaaaagaaacaccacgaagttgcaaagtaaaatgttattcttttagattagggttaattttgaaacagcccaccactctagcaggcagatccctgcagaggttcatgacaatgggagaaggcagccagcgctgcagaggagccagggaggccacaactcctggcccagtctccaagtaggtgtgggtacctggctttcctgggaaatctccctttatttttattattattattgtggtaaactatacatgacataaaatatacaattttagccgttttaaagtgcacagttcagtggcacttagtacattcacagtgtggtatgatccttaccactgtctagttgtagaacatttttattactccaaaaattcctcctgtacccattaagtggtcactccccatcttttcccactcccagcccctagcaaccactaatctactttctgtctctacggttttgtctactctggacatttcatataggcaaatgatcctgcctatgtccaggatccaaatgacaattcatataaatggaatcatacacagtatgtggccttttgtgtttggcttctttcacttagcataatgtgttcaaggttcatccatgttgtgacctgtgtcttccttgtgttttgatgaccttgagagacttcctggcatagcaatgaggcctggcattgaagccatgcatacctggatttgaatcttgtcccacctttaagcttcagttttttgttttgttttttgagagagggtctcattctgtcacctaggctggagtgcagtggtgcaatcatggcttactgcagcctgaccctcctgggctcaagtaattgtcccaagtagctaggtctacaggcgtgcaccaccacacccagttaaaatttttttttattttttatagagatgggatcccaccatattgcccaggctggtctcgaattccttgcctcaaaccatcctcgcacctcagcctcccaaagtgctgggattataggtgtgagccaccacacctggcctatgctttagttttttcatctgcaaaatggaaatgatattcatctcaggaatccttgtgggggttcatttgctcattcaaaaaatagtgatggagcagccactgtgtgccaggccaaggcttcacggatatagtggtgaacaataccaggcaaactctttgtgctcatagaacttggttctatcaggagaaatggacgataaacatggagaccaataaataagataggaagaagaaagtctaatgtgtcagagagtaatgtctgggggtaggaaatgggcaactttaacagcttggtgagtaaaggttttctgccaaggggctgacatttgagctgacctctgaggaacagagtgagccaggcttgcagagagcaagggaaagaaagattattctaggcaaaataacagcaagaacaaagaccatgacatggaaaatggttttgtcacgatcatggaacagaaagaaggccagcgtggccaaattggatgagcgagttgtgggaagtatgacttcaggttagaaaggcgagcaggagctacgcgttacttagctgtgcaagccagtgtttgggcttcattccaagagccatggaagccatgggagggtttcagctaaagaggtgatgtgtcctcatttacaatgggaagagcactctggcatctgtgcggagggtggacgagagtatgagcaggagctggaagagcaataaggaagtttttgcactagtctagatgtgaaaataggtggtttgatgacttggaccaggtcggggtaggtgagttgtaaagaagtaagaggatttgagatggcttgaagaggaggcaggtgtgaaggtttaaattatataaataaacaggataaatggaatctgcatccaaaatgcctaactgcttagaacagaggcggtgatcaactcatgtcccgttctggtccactcccccccgccccaccacccacacagacacacacacacacacagacacacacacacacacaaaccttggtggcttttgaagaagtatttatgggtttcatcctcatctggattttcccatcatcaggaatgagtggcaactgcggggagaaggatgtggatgtgtctctgattttcacagcatgaagacagaataagtctaccattttctattcctctataatcttggtctcttagaatagctatagccttcagcaatgatggagaagcagggttctgtgggatgaagcaattagccatgttctaggagagagggaagagccaataaggagggtgttctctcctctctctcagttgccagagctcagcctgaaagggattcccttcctctgctctcccgccaccgtggtgcttccctatgttacactatgttgtggtccatggtttagttctccaaacaggagaactacccctggcacaaagagggccttgattaatatctaaacactgaatgagcaacggaaaacaccagtgcttcttgtcttagagccgagaaacttctgaggttgcagaataacctgtgaagttttttcttttataaagataggaataacaatagcatctatgcaaagaattgcaaggatcatgagagataatttgtgtcattcactttgcatgatgcctggcatatgacaagtccttgatagaagtttgctattactaagggcctgcttcctatggcttctttaagagctgctgtgtgtaaatggccctcagagcctctttgagggctctggactaagaggaaagaagaactctggtgcagggacccaaataagctctatcagttctcactgcagtaggggcttgacggtggaattaacaaagtgccttaggtttactgccagttccctgacagcctgatttcccatgtattgtgtaccagatgagacataagggattgtgaaggcaaatgaaaagcaggatattgtttactggggccaatataaatatgtttgtggggagaggagaacaaagacctcaaagcctgttgttgacagaaaccacgctagtgtttaatacatgacgtcatcctagtaaaaataatagttcccacaggtctgccagggaatgggagagccggggttatctgtacccacacatgccaggaacctcaggggtgctggcaactggtatatgatcctgacccagcttccaactagctccatggcatgtctgagggaggggcttcgtggatagtatcctactctgagttccaaacacacagatcccaacgtctggattccacctctgctagacaccagcttgtagcagagaccttagctgggagcctggtttttcccaaatgtaaattcagataagaattcaacccctactagagtagttgtgatgaaaaaacaagataaataaaataaacaagatttaaaggaaatgctaactgcaagagagcctttggtattcatggtagcctcacccacttctgtgtgctcctctctcacctatgcagaagcattgaaattccaggcttcatctccagtctcaccaccctgaacccctactttgcttagcttccctcctctatgtaaatttgttttatttatttaggccttttgtaaggtgtgtgaaggtatctgggctaagagagtggaaggtcagtgaacccctgagaaaatactagccacttgggggtcctcattcttgcccaatcagtccgaagatccaactactcctctgtgtgccccttcctgctccatgtgctcctttattttacccatttttctccatggtaaatgcaagtgtaaggctttgaaggcacaggggagcctctacaagccctgagtggaaattcgcagccagtatgtgaaagcatgacttcaattttttgaagactgggccctaagaactggacatgatgaagcttaccagtttgccaatcttcaccttctgttttcttcccctgagagtttccactagaaattccccagctttggtttgagtgcttggctctgtaatcttggagacactctgcatacaccccacaattaagacatcgcaactccatgcaatgtttcttcagagaaagttagatgcaattagatcatttgaagatggattagcctgccatctgcacaatattaagaaaaatcatgttggcaaatgatggggcctctttgaagagctctgaaggaaagccactaatgggctctacactgggtttcccccctgttcccgaagggttaacacaatgtgtgggaaaggaaaaaaaaatcccctgtggcattaaaatgctgtgtcagagatttgtaagctcccctttgtagctctgccctggggcctggctcacttcagtggagatgaggttaataagacctctgttgctgcttggcagttcttaacggggttacagtctggtgcctgaccagtgaaggacagttattattaaagtgctgaggaatttaattcaataaggtcagggacatctgctgtgcttgcttgcccaatgtccatttattcttctttttacaagaactgcttgcttttcctttgcggaaaaccacctcatgcccattctgtctaggtggagctgacccttacctaaatcagggtggccacatgaccaagccagcccagttagtgtatttgggtatccaaccgtgccccaaagtcactggacttgtcagttacataagcctataaacacctttacccctcaaccctcatttttctttttcagcttctgcaaggtggagtagctacattaactatttaagggattaaatggcatgaagtataattagatagaaactaaactctgtgggaagtcaagagagggagaggttgatgtgggtgggtgggcttcctggcagaggctgaacttgaactggtcttaaaggatggagaggattaggtgagaccaagagaatgcagaactctgtgcaaggcacagagggagggagaactcagttaaaatgaagatctgtggacaagaaatgaaaagtgggttttgacaaatagaggcagggaaaatgccagaggacttggaatcccaggatgagaagtttgaacttacctggatagttccccagtgtggacttatgtatgggtggggaaaatccacaccagattgtgctaccagtttgggcaagtatatgactctatgccttacctgtgttagagactggcacaggtgcaggcagggcactaaccttggctccgccacttaataactgagcaacaatgggggagttacttaacctccaaatctcaatttttttccatctgcacaatgaagataaataataacctgacattcagtgtttgtgaggataaaatgagataacctacgtgggagcccttaggatagtacctggcacatgataataatagtagataatatctgttgagtgcttattagtgttcccgaggcactgtgctaagctcctgacataccttatctcatttaatcctcccaatagccagtgctttaaaaatgttggctgaatccgatttggggtaaccttgtcattcctgtgcttgatcaaacaataagcttatcagacatttactgtccaatgagagctgaatacataatctgaatattcaagttctaatttcttaatacacaccctaaaatgttttaaatttaataaaattacacttcagaacatctagagaatagagtaaaaaaaatgtacatataacttcactaaccacaacagaaccatgtttttctaatatagagggggttaagattatctgcttttaggcccaccagatcaccacagtgtgatctggggcaagttactttatcttctctcagccttagtttcctcatctgtccttatacgatgtttctagaagcttcttcataggggttttttgttttgtttttggcaaggtttaagagtgataattcatgctgtatggagcatctgacacataatacaccatcaatgttagctcctatgaatgcctccagtcactgtcctatacattttccctgtgattgcaataaccgtgtatatgcagttgcatccttattttttcacttaacactgtatctcaggcatctttataagtaacaagatctccctgtccctcattcctaatgtatatgttctcctaaaatcactttaagtgtatcaacttgctcttgcttcatcttttaaaaacatgtataagtaatgctacactccacacctttacgcttaatggctctaagagttcacgtttcagtgcaccatctctttgagttcaaattatggttctgcccacaccttttcagaatgtggtgagaatgaatgacacccaagtcaggaaaggcctttgacaaattgcagattatgctggcttgataagtgaccacaggaaagtatgattgtcacttttccagcagtgggtttcctccagtgtgatattctgtgcctcacctatcaagaggtgttactgtgggtcttcctgtcagctcagttctcctacccttcttgctgacagaggaagaagaatcccactaccttttagctggaggttattctcctgatctcactgaatcttatttcttggagtagcaaggaatctgcaaaacaatttgaggctgtctttctgttgcaaatcaaagccccaacctcttatttgggtcttagagcaagagttccccaagtactttgaaattggacccttctgtacacacctggagtcaccagtaagccttgcccatagattccctggtggatggacacacaaagctaagggcaaaggtgaccttttcatttcttcttcaggtcctacaatgcctttgaaatctttatgatctgcaccttcagggattatacaaacagcttgaggaaatcctaaaattgtgttttctccagataagcatccaggtcaaaggaaagacctctgcatgccttcctgatagaaagaaacttgcctcaatttagagaatgccaccaagaacaaaattggcatgcagccatttgtgcagtgcattaaaaaccagtttacaaatagtggtacaattctggaagtgtcagacctcatagtgtggtgtagtggaagtccacagactatttaccatatttcaaatgtcttactgtttttaaacagcagcacaggataaccagagtaacacatttctttgtttctgtctcgaataacatcaattaagtaaaaataaaatttattatcatgcaagttataagctttccttggcaattatattttgatatatttatatgctaattttaacaaattttggttaacatatcttacagcagtattttttatattaataatggtaagaggaacagttacttttttacttagctattagttaattgagattattttaaaagctgtgtgacgttggaaaactgattaactaatacaggtatttataagatgtttggtctaaaataaggtatttaaactacctgagcctcagtttcctcatatagaaaaaatataccctcctcatatggctgttataggggaaaaagacacaatatgcaaagcacatagtacggaggcaaagtatctggcacatagtatggttcaatagataaataattttcccatagaaactgcaaatttatatatgagacaaaaaacatttcaagtatatgttcttgagggcagggagatgtaaggtttttaaaggttctttgataaaaaggttggagcatggctctttggctctgatcactccattggatacttaaaacaatgttcaactctgtcatcagaatgaaatgtccactgattcatctccatttcttaactaccaagcaacgttcttttgagggctttcacaccctcacgtatcctttccacctgaacctcagtggctgactttaccccaggccctgaaggcagaggtggagctgagctctgtgtctgggaagagagaagcaggcacgtcctctgatccttgcccaagggcctgctttgtgagtggggcatcaatgccgcttttgttccacctttagcgtctggcccacagctgaactcaaagaggctggctgctcggggcaaccctggcccacaaaggacagacagcaccaagcccagccaagggttcactcaagaccccaagatccagcacggtggttctccccactggggaggcagcctcagggaacattctgtctgcctttggcattctaaaccatttctaatttcatgaagataagtcagaggttttaaatgtgatatcactgctgaaaaggccagagccatcagcgtagaaccagcatgtccttgctaattacaatacacaatcattgccttatgttgatgcagtcatttgctcattcatcagctattaattgagttcctactatgtgctcaatgtgatgctcaatgtgagggacatggaggtgaaaagatgatgtccctgcccttaactctctggtgtactggcaaataaactgtcacctgctaagacaaatagaacataatatctggacactataacaaaaacctggagaagcagaaacagtctacataaggggccaataataaccattgctacagttgatcaagcatttgctgtgtgccactcactgtgctaagcacttagtgtgtattatctcatttaattcttaaaacacagctataatagtagtttgattctcttcctatctctctgggaaaggccatgcaaagaaaatggcatgtgagggtcttggaaaaagaataggagtttgccaactagacaagcaggggagatcattgcgggcacaggaaacaaaaatgatctgtttggagaactgcagatctttggtatgtgtggagcaaagggaatatgcagggcctcgtgtgagaatagtgattgcagtgaagtgagaactaagtgggatgaagcttcaaatgtggaagactgtaagcagagctaagatgtcgaggaaggagactcggtaggatagtgcttcagttagaaggagggatggccacgtttgttggttcacttttgagatgcagagcctattcctagggtaggctatgagaagggaacaatgagagggagaaactaaaaatgccggacagagagtgactagtggagacaggacctcaccctcctctgattggaagaaagataagaagagaaccaaagacatagacacattctaagaataggtgttgggaggcagaacacaggtaagagggggcagaaggaaaagatacgatcttaagagttgtacctgcatgacgcctgatgtctctgaggttaaaggcaagtccaacaaggagagtgagaggtgacagagtattatagaggccttggtgaaaggagtaaaagtttggagtcattgttgagtacgatgatgaggtgctgataacacaaactcttgatttcgaggaaggagtgttcaaaggaggaggaggaaaatgactgctagagagaaaggtgatggatggcatgtgaaaatagttgagtgtgctgagaatcgttgattagagtggcgaaaggtaatgaagggaagacttaataggtgatttcaggttcagacatctgaatgagggcatggacctattccatgcagcttcaggagacagaacgaggtccaacaagtggtcattcctaggagacagattctctacccccaaacattaaacattaaaacatgtaagtaagtgtacattaaaaacattaaaatgtgtaagtaagtagcactatccagcaatggaataatctgcctcttgaaggatttcaatcatctgccaaggatgttgtgctggaaatttggtatgcttaattagatggcttcttctatcttttttaatactaacatatcatagatacttaatatatggagcattgaaatagatagcagccaattttggcattcttgcaggttgtcccactgtctgagcaagagaatcttgattgggattttttttttttcttttttggagacagagtctcgctctgttgccaggctggagtacagtggcgcagtctcggctcactgcaacctccacctcccaggttcaagcaattctcccacctcagccttccaagtagctgggattagctgggattacaggcacctgcaaccacgcccagctagtttttatatttttagtagaaacggggtttcaccatgttggccaggctggtcttgaactcctgacctcaagtgatctgccctcctcggcctcccaaagtgctgggattataagcatgagccaccgtatctggccttgattggaattttcagtaagatttatgcagtttaagaactgtggaaacaatcttgattttttttttttattccaggaggatttttgttaagattagcagaagccatgctctagtttgagaaaaatacacatggtattattgagttaacaggcatgatgtgtatataatacttactatggagagggcttctttctataattaaggcagaatgcccatcccttctcattgtggatctggagaggacccttagctgggatgactaaaggaggagcctctgttcttacctgatttggagtcctcttctcatcatgaaagatgtttgcgcatctttcatgccctgtacctttcttttcatttgccccctgcatttgggattggttgctttcttttttggaacctatgagactatttcagtggttctcaactgagggtgattttgaccctcagagggcatttgacaatatctagagatatttttgattgtcatgactggagagggatgctgctggcatctggtgggtagaaggcagggatgctgctcaaagccctacagcgcacaggacagccgctctcaacaaagaatcagccagcccaaaatgacaatagtgctgaggttaagagaccatggtctgtttttaagtcttccttctaaatcagctgccaccaatacactctgtaaaaccccagatgcctacttttattttctaatttaagaactgttgtgtggttgaatactctgtctctgtgaactctacccccacccatcccgttcttcatgctgtagcaataagaaggacattttaaactccctttgaccagaaaagtcacttttggttagggtccaaacaagaaacacatccctccctggataaaggcagagatgccacagcttgcagagaaaaaacatcagacatttcccaatggcagcaactctgggccaagagtacggatggaggacaagctacagatacagccacatggtgcccttcatttgcttttgagtaggagctcacactgtctttaaaagattggacagtagagctcagccatgaagggcccctgtagcctttccaagccaggataagaccaagacggtggtatgaaagcaactgtgactttggcacaaatacagactgagaaaatggtacctgactaggttactcttatgaccctctgagaatccccacacagcacatgctaacatgtacctacacctctgtgtcccaaattaggctgaagttttcagttagccagatcataaattaggcctttgtagctctaagatcccctacccctgaagaatcctaggaaagcctcccttactacacttcatgactcagcattgatagcctgctccaacagaaatagcccaaggctgagatttcccttctcatcccttatgtttttcaggctgagcagtcatagggaaatcattcaaactcttagaacctaggttttcttatctctgaaatgaagacatcgaccttccaatttctgggaacctgtattgaaaaagtactctcaaatacggacataattttatgtacaaagttacttattgcttcattatttaatgttagacatattgtgaaatagattaaatatgacacatttatagaatggaacattatgtacccatgaaaaaataatatacatgaagagtttcattggctgtgaaaaatgcttgtgctctaatgtcaagaataagaagcaggccgggcttggtggctcacacctataatcccagcactttaggaggctgaggtgggaggattgcttgggctcaggagttcgagaccagcctgagcaacatagggagactctacaaaaaataaaaaaattagccaggtttggtggcccatgcctgtggtgccagctactcagcaggttgagatggggggattgcttgagcctgggagatcgaggctgcagtgagccatgattgcaccgttgcactccagcctaggtgacagcgcgagacactgtcaaaaaaaaaaaaaaagcggcaaaatataacaccccccacacacatacacaaacacacatttatatgcttatagtatgatctcaattctataaaatatgtatagaaaaaagtctggagggaaaccaaactattaccaagagtttatactttgttttatgttagtatgtttataacgtttttaataaaaataaagctgaggtatacaataattcttttccctttaaaagcagagcatataactctcaagattgagaaacactgatttacagctgtagacagaactggggccagagataaaattttggagtcatagatgttttagtagagattgattactggataagatcacctaggatgagcctgtagagtgagaagagatgagagccaaggcttgaaccctgggaaatactgacatttagggaatggatgaggaagacaagccagagaagggaataagttcgtggcagtaatccatatgagataataacctatatggattaccatggtggcgttgggacatgcaagggaatgataaagctgataggcattttaaaataaattaagggttgtaaattacatgtacaagatgagggtaatggaaaagccaaatattacttaaacctctctagtttggaatatggaagaatgctgatatcaaggaaagcaatgggatagttgaaagagatgcatatatggtaggagtggggaagaggttaggcttagtcttgtatgagttgggtttgagatctctcttcaagaaaataactgctctaagaagtgcagttatctgaaagtccccagctgcagccccttggggatcggccataccatgcaagctgaggtcaccctctgcccaggcagctctcagccatgactaagcttagaagcagcattagagctgatcctctctgcccatgcgagcctcctctagtaagtaggcagtccttgcacgtgggctccccactaggctgacccagattctgagggctgaccttggtttaagctcttcccattcaatctcccttcttcccactcttctttctcagatatcaagtctgtatcatggtctgaatgctctccctgcctgctcttctctctctccctctttctcttccacaaacactgcccccagtaaatctcttgcactttgaattccatcttggtatctgctttccagaggaccagaaccaacacaagtgatggttacatatccaaaagaaattattgtggaaggaaaatagtacagttcttgaaagcaatcaggattgagggataactgaatctcaagagtctccctaatagcataattagagggaggagtggaggacaaggtttgaatcttatgttacagtcataattgggaaagagtacagttagtcttgtaattgggaagagaattcaggatggtggggggaagttattgaaaaagtagaaggaaactctgggaagtgtaggatcatagaacatgaaatagagagagagctttttaggaacaggtgataatcagcgcagatgtcatcaaagaaaatctgagtagggactgaggtcttgtatttagagactgacagtgtggctggctggccatcaagtgattatttcagggaaagaatgagaataggtgccaagtttacaggaatgaaaaagaaacatagtgggaaatagctggaggtaatgacagtagacctcacattgaaaatgtttgtccatgaatgagaggagggaaattgagctaattagagtaataatttccaagattgagtgtgtgtgttttaggaacacctaaccatttccagaagagggctttaaaggtgctagagagagagagagaaaaaaaaaaaaacaaccattgtagaattaaaatgctgaaagcagtgggaagagaaaagctactgaggccagagggaggggttagattttaaacggaagagagaaacctcttttctggaacgtggcaacaagaagatggcagaaatgacagagatataaggggtgagagtgaagaacctcacgcttagaatgtgttcctggtacaaaagtaacaagaccaacctctaagaataagagaatgagatggggaaaatgtgtaaagagagtggagatgatcaggaatggctggtgagcatactgttattccttaagaaatgtgatggggcaaaggaaaatcttgccttaaatgcatgaagttggatctctgtcaagtactggtccaaaggactgtgactctaattggtaagaaagaactaataaggtcctggcatttctcttacatcttgaattttcctagttcaactataactcaagtgttcagagaaacaaactggctttacgcagtccacttttgtaattatcaacaatcatagaaaaggaactagtatatagctacttatttgctttgtttgaatggcactgtactttatcataacaatgggtgataaagatgataaaaatatccaagaaccacaatgctctatgtcagaactaggttgactggagaagaaatgctctctgaagcaaacgttctggatactcaaagactggatttgtacagtggtctttaggcgttataactctgtccaggtctctcaacacttacagctatcaaggaaactttattattgatattctacagaaaaaatcacgattactgcaagtctgtaagctcttaagtatttttcccattgaaattattgtttcattaatataatatattcaaccttgtgctatcttgggtatgcaactctacagttagagcagatcaaagggcagtagcctgaaaggagctgaatgacaaaatccatggcatttctcattagtcttagccagaagtggctctttatggagaggactcatcctggtcttgtgaagagaaatgcactgaaactggaaaggaatgagctggccacatcagtttcttcaaagctgccagttgatatgtctatgtctgcaagtatgacttatgcctgttaattaccccccaaactccttcaacagacaaagctctttattctgctgactttgaagtataatttggggatgccttgagaaggtcaacgcgacaggccagcttttgccctgcagtgggctgtgcaggtgtgtgctagctgttggcttccaggcctgttttattccagccctggcagagtttgcaggaatgtcatgagaagagatttataatactttctgattccatccagtttcaaataattttatgaataatctttctcatagcatactagtaattctacaagcagtcttggccaaaatcaacggagtgagcatgcttaaggaaataattttctttttcctttttaagaaatcattttgctgaagttttacaaacctcataaaaattaagggttggtttgaatttgggagaaagactcactttatctgaactcatttgccaaaaatatttaaatgagcacatgctggatgtaaaagtgccaaagcaatagcatcaattatgcattctcaaccttccagactttccagagtcattaaaaggcagcgttttcctacaggtgttaatgggatcctgcaaagaggaaggtggttttaggtaggattgtgacagagtggctcgtgcgttgggtgctatggaacccactgaggggcttctgaccacagtcccatgcagagccaacaatggcattcgttgttataagcaagtgtcagtcacaagagagctgccattacagagtgttgcccagctttccatattcccaacatggccagaggtttcattctttgagaatgtgtttattcagcctagtaaaaacattaaaaaggggaataaatctctgccgaccccaaaatgcttttcaccacagctgtaaaccataaaacatttagaaaggtaagcaggactaaagataatatagtttccccaagcagcaaggagggcagacctggaggtggcccttgcaaagacagctgcagtgcacagagcttccctgcaaaatcattaagaaagggacaggttctataaggtgctaaattattattagtttttttttaagttgggggagggcaataataaaaaccatgtgctcagcagcctgcttggccatataaaacagaaaggcctgtgactttaagtgttgtaaaaggggttaattgtcgatttctgaatgtggcaagtttactgatcttgttaacagcaacggggcatgtgccgttggttatcatggcgggaaagaaaaacagccatccatcccttattccctggatgccgttattagtcttggaacccaagttaagggacatatgggtgaatgcagtcttaaaattgctcctttccacctgtccaaatttctacccattctaaagcttccagttccacctaacaactgcatttttactgccatttttcaaatgcctgctgtggatcagttcctttcacacaaaatgtgttgtctatttgtatgacaacctaatggagtgggcaaggatgatacaaccattttacagacaaagcaactgaggttcagagaagttaagaaagttatctatggcgacagagctatgaagcagaggttcaaacccgtctttatattccaagtccaggtcttttcaactagttattcaaataattcatttgttcatccatttactcaatagatagttattggccatgcactaagagccaggtgctggtctagttgttgaggatagagccctggacacaactgacaatgttcctgccatcacaaggcctatagtttaggaagcactagtctaacttccaataaccatcctctcttctaacctactttcacatgcacagtcagcatctgtaatttgatattttattttgctgttgagtattgcacattacctttgagtatggtgtgttacctttggctcccccagctagatgatgagcctggtgaaggcagggctgttgtctaatatttctctttttcacagtctacccagcacaacccattaaataagtgctttttttctcctgtagaacatctttattactgtgatcttaagatcatttggggttttatttagagcttagctattgcagcttctgttattgagctttgtcaaatgttatgtttatattgtctcattagtgctgacaccacccaactataagacccattttacagttgaggaaattgtggcttatgagggctgagaaacttgcccgagttcttagagtcagtaagaagaaaagctaggattctgccagtggctgaattcaaaagcccaatttctgtataccatgtacttgagcctgagcagtgagggaatctttgcccacctgaaacatatagagaatatcaaaagaccctatgatatgatatacatgatacataaggtgaatttaataccagccattgattcatccagtcactccaatcactcagaccttcatagtaaaattcatgtggcatcttggctcctgccccaccctctattttgtggtcttcttaaaatgctatcttttttcaatagaataattttcaaaggaatccctgtgttcctagaaaggtgacaaatcagagattgactagcatgaggagggtagtggaaggttcacacctgtttgtaataactggcttatacaaaacgtaagtacgaacacaatggatggcgattgtgttctgccaatgcggttggcattcattctgagaaaagatggcagaccaaggccagagcatggcccagttgctgaaaatcagaaccacactggagccaccagggaccctggtaactaggtggagctgaaccatttatttctgttttgatggcatagtttccactttaagtaatgtgggcttaatcttcatttacattcttcaatctacacagaagtgtatttattattgtcttgtgataagcagtagtgttaatataaagcagtgctccctgaaactgcagacagtttccaaggtctgggcaaaaagaaacaaaaatgtagggaggggagccctgcagcatgacaagagtttttgaaaatgaaaaccaaaaaaattttaaagaaaatgaatcctaatccttttggaactttcatcagtcagtctgtcgacaaggaactgataatttctgaatgtgaagatttggataacaaatgagttacatgtataactaggcttttgctgggtttctctatgtagataatgactcaactggtgagtaccatcagagaaaggccagtacactgggtggcctgtggatgcttgtgtttatttgatgcaaggctcctgctttcgttggggattgctggaagagtgacacacaccaagctacatttctgccagttgtggttttgagataacaaggcttaaaatttgtatgccaaagttaaaattcatgatctttttcctgtgggcacattttagttcagtctctttgctcaaaagaatttgacaccaattattgcttttcagtactattgagcatgagacaatctatagaataatccaaaaaggaagatctataattatacaccttctcataaagggatcatggatattattgctatgtatgtccagaatagctcttcttacttttgaggagtaactattagagtcttaccaggtgccaaccacagtgcttcacattcttgccacagagactggtccaaggataggcagatgacaaaaccaggcaaattctaattcttccacaaatgttttctaatatagagctgccaaaattgctctcctgcattttttaggtgtgcaattgcaatataaatctgaaaatgcccatggccatgaaagatctggaaatgaaaaatagcattatctgattctttggatctagtcttccctgagccagctccacttttcccatgcatggggcgggggggtcggggctagcgagctaataaatatccttttattgcttaaactagctccagttctgatcccaccatttgtaaccaagtgtcctgagtgacataaataattaaatcaggcccagagaaatatgacccttagtatctgacaattaggagaagcatacaaaccataaattaaatgacataaaaataattcttatgcaaaagacagtatacctcaagacatgaagggttgttttgaaatccttggaaagcaatacagactgcagaatataattcttgtgggagaatcagtctccacagtgttttctgcagaactgagaaagtatcacctacctgccagagcagggctttaaaatgacaaatctggtttgttctggacacagtgatttttttaagaattttttttactatactttaaataataaaaatatattttcattgttattaaatattattataatacttttattggtattttaggagcattactccaaagatggtgagaaattattatatacaaaattgtaatgtgtttcaccttcagaatgctattttattttctcagctaatgattattattttagcaagatttgacaataatagtaaaataatcgaaccagtattttttttttgagacatggtctcactctgtgtctcaggctggagtgtagtggcataatcatggctcactgcagactcaacttcccaggctcagatgatcctcccacctcagcctccccagtagctgggactacaggcacatgccacaatgcccagctaatttttcgtatttttggtagagtcagggatttgccatgttgcccaagctggccttgaactcctgggctcaagtgatacacccacctcagcctcccaaattgctggctttataagggtgagccaccgcgccaggcctcaaagcagtacattaagaactgttcgtgtaaataagctctgttgagggacattaactggggaataaagtggctggaaaggacacattgaactcctttttcatcttctctgaaaatgttaataataactgagacacatctctgtgtctatatctatacttttcataagtgaggaaagaatatgtgaaaatttggccaaaacttaaagtttttgaatgcaggaaaaggtttgttattcacagtggaacaggggaaatgtaagaagatgatacggtttggttgtttccctacccaaatctcatcctgaattgtagctcccgtaattctcacgtgttgtggcagagacctggtgggagataattgaatcgtcggggcagtttcccccatactgttctcgtcataatgaataagtctcatgaaatctgatggttttatgaggttctcattcccttttgcctgccaccatgtaagacacttggttctcattccctcttgcctgcctccatgtaagatgtgcctttcatcttccaccatgattatgagacctccctagccacttggaactgtgagtccattaaacctctttttctttataaattacccagtcttgggtgtgtctttattagcagcatgagaacagattaatacagaagtcttctgcatattgaagagaaaaagcctattgtcttctcaatgtccagatcaattgcatttattccaagtctggggtgtctcatggttcattcaaggaacactgacagtgagtcatgtgacaggccttgggaaaaaaacataattgtgttcataaatattattaagaaaagcagaggatctcaaaagtcagatttggatgaacattagttgatgcattgaaacatggattatgtcaaatatcccatggattctaagctgccttaattgtaaaaaaactctttgatgctctgcttagtacgtaagcaccttcaattgctgtcaagtgtacatacagcaacaattaaagataaacaaataaacatattgggatatgctgtcatcagagtacagggaaatgacccaaaagctcaatgtttccaagaggaaattagttccgaccccacgtggccattgttacagactagaatctggattttgtttgctcttgattacacagaggaagaaacaaaaaataagttgtcctggtgataagcaaatggctgggatggttttcctcagtgaaaatcaatgtgatgtcttattcccaggcctagagataggtgggagatggggagggaagctatttagtttaccagcattactaaagttgcccttttttccctggtggatttccttttcctgatttcagagcttagagaactcagttctgtctagaggccctaacattccacttcccacactcagcatgggcctattgtcatcatggacattttttaatgtataattcaagtaatcctcaaagcagccctaatagtttggtatctttattgttatcagcctctcttgagaatcagaaaagttaaatacttttttaaagatcctgtagatggttagaggcagctaggattcaaatacccatctgtctggatctgaagcctatctcttaatccccaaacccactgcaacatgcagtccattctcacatgtgcaagtgcatctaacccacaaatgctttttttaaaaaaaatattaaggatgagctggtggtgtttcctccataccccggccagtcacagtttagcatcatgggataagtgtgggaaaggtctgactagagtagaaatacagattgtgcccagccttaaaacaataacatgtttctttcacatttcacattaacaaatctaaacagctgatgaaatactgtaatcctaggattatataccatgaggagcctaagaacccctttttaatttatcaaagattcagtatatttgtaatcacatgtaataagtgaggttgctgatgtagaggaaaaagaaatgacaatctttgatcccattgtaccctgggatcccgaaaatcatccttagcctgctggtagccagtctggtctttggtgttcctgggcatgtgtcccattctgagccatgggaatacttcttctcatgtcctaccctctcacacataatgcccacctggtattcttccttctcactccacaccacactccccaactaaccacagccaccattatattctcttcttccctcttctccccttccctgcccttgcttcctttcttctccatgtgtctcttctcctactctgttcccaacataagatttagcatgaagccatgccttttctcctcaaaactgagtttctcaaagatcattcacctccatatccctgcaggaagcgatgggtatgagcagtgtctactagttggatggacagatcaagggatggatggggcttttgaccatgtgtttctttcaagacttgttgaagtcattttattcagtgaacaaatagccattttgatatcatttcttctcccctttcaaattacttattacaattttgggtgtgggtttatggtgggtggcggtagttgcccatgcttttggagctgagatgtaattcttccctccctccctccctccctccctcccttcctccctgcatgcctccctacctcccttcctcccttcttccattccttccttccttccagaaattctttagacaagcaaagaaagaaacttcacagagactttaagcagtttatatccaactatgtgactcctaagaggtgaccgcaggtggtttcaaaaatcttctgggaatgatcccatgttatataataatgagaacactgagcttgacatcaggaggcctggctttagctttggtctcccttttcagtatgcctggaattctgggcagatcacttggcctctctgtgcttagttttgtcatctgtaaatagggaaggtaggactaatgagtgatttttaaactgttcctgggagccctcaaagattcatggaggtgtcttgagagtctgtcctacaagggatgttatggtagagaaggaggtggttgcatagatcaggcagggctgagtccctcattcctacttcaacctgaattaatgttctggtgaaactttttgaatgtatcccatttttaagctttctgctagaaaacctactccaaaaaagtttgaaaactaccagactggattatctttaaggtgccttccagcataactgacttcaatatataaattatctgtgtgtgatcttcctttacagaaataatggagcctttcttttcctcgtgtggttgttgctctaagaatgcatttcttatcaagagaataatctgcttttcattctgcttcctacctagctcaacagagcacaaaatgcccaagctagatcccttattcccctgtgaatatcttctgtttagactcatccatcatcggtggggcttatgacagacatagatgttttcacagttaccacacagggccaactgttttagtaagggtgaccacttaggacagctttgggctcttgagctgtcctctgttgaagccgggaaaccctaagctgtcatcttagcaacaccgggttgttcatccactttgaaagagacaactttatggtcctgatgacatttcctatattatattaaggatgcatcttgagaggatgtgttgggtttgttttctggacaagctggatgagtctctctctctttctgttttagccactgccctttgtagggtttgtttttcctgctgtcccagaatagatgacttaatgggttgctgaaaatgtccaggctgcctctggctctgggggtagctcggccttaacaatggaaggcatttagcagagcctcatgttttagagcaagaaagacttgagagagcatctcatctggtatttttcaagatgctttttaattttttaaacagcaaaccttttctttccccaatacaaatctgacacaaaacctcaatttataaaacagatttttaaaagaggggtgggaggtaggagaaattctaccaaatggtactttccttgctatttatcctccccccatactacctcctaccacacacacacacactcagcaatacctaagcacttctagggaacccttggcctcccaaaagcaatagaaacccccagtcctgaacctctttttttttgtttgtcaggaaactgaaaaacagtgagatacggtaacttgcctaagaccccacagctagagatctcagtgccagactgcaacacttctaaatctggtttaatcttcctctccacccctctctaatttattatgccacttcacctttgaaccctggaaaagggcaggaagaaaaaattatgtaccagtgtgctcaattcttgtacatctgtctttaattctcaaagcaactttacaaggtgggcattattattatgcccattttacagaaaggttaaatcacttatccagtgaaactcagccagaagtggcagaacttacattgaaagctaggcctatcaaatttcaaagctgttctttctactataccacaggattaaacaatgccaactattgcttgtcataaatgaaaccctctcttaacataagtttgactcaaaaagtctgactcataattcatgaaatactaagtaactcttcttaaataactaccatagactgtccctctccaaagttttctatgtctattgcaagcatgttttgcctttaacaaacaacacccctttctctgggaatcattctctgtcattcctctaccctatctcatccagaaactggggctctagaaaccatgattttgatgtttaattcaagtctggtcttgagtgggccaagctaggaatgaggagcaggagagagttaagacgtaaaattttactcactgtatggattgagcagtggaaagagaaccaagaagagagatcttgtgacaacttacatctccggtttacttttgcatttcagttcaatgaaacagcctacttaccatataatttagtctgccttttttttcctgaagctttggtgtttgtgtgtgtgtgttttgttgtttttgttttgttttgttttgttttgtttgagacagagtcttgctctgtcacccaggctggagtatagtggcacaatcttggctcactgcaacctccacctcttgggttcaagcgattcttatgcctcagcctcctgagtagatgggattataagcatgtgccaccatgcccagctgatttttgtatttttagtagagacggcgtttcaccatattggccaggctggtctagaactgctggcctcaaatgatccactcgccttggcctcccaaagtgctgggattacaggcatgagccgctgtgcccagtctccttcctgaagctttgaatttatgttactagcaaaccaaacaatcctactgactatatcatcaaatcggatggcctgaggattcttcaggtagattcaggctgccttcttgttgcagtcagtcatgcttattttacattcatatcatacagtgctgccatgattggagtcctcagcaatcagttattccagtcctctttgtttatactgaaacaagtcactataaaatctcctgttcacatggataaggtacagtatccagagaaagccaatcttctctagccttattgattttgtctcttagacttctccctgctggacagaaaatgtaaaataggaacgttcaaaataaataagccagggatactaagttcaattaaatagaacaaaatgctttatattttacaaacattaacttgagaagagaaatctaagttattatggtctccaaatggtaatagcccaaatttctactagcaataagatagataattatggtactatgtattcatacagcaaaataatatacagcaacaaaaagtaatgaattatagttacaggcagcaacatgggtgaatgccatgttaattcccatttgtgatagaaatcaaaataatagttacctcttgaagggaatgaccaggaaagtcataggggaggttcctgggtgccataacatttgatatctttatttaggtggtagttacagagctgtgttcactttgcaaaaattaattgaattctatagttatcatttgtgcagaattatgtatgtatattatacttcaattgtaaaagcttaccccaaaaatatctgaattattagaaattagacataaaacttacttcctctaggtcatggtctcccattatataaaacaagaaattaaactcaacattcttaaaactggaagtgatctaaggaagagtatctagttcaaacatgaaatgttttacagaaagagagaccgtggccaaagaagtaaagtgataggctataaattatgaagtttataattggtagagccaagattagtccttagatcttttagctatgttaacaaagatattctaaataaacctcttaatactattctaaaataatttgctctgaagtatacttttgtactaggaacaaagggtttgtaaaataaataaataatgtgaacaataccatcagtgtttgcatagaaacaatatgatatcattcttaaagataaaatccctttgtcactcactccatgagataccatctgatttggtttctgaaaattttggcaaaattatacattgcttgaaatctcattcccaggctgtatttgaaataaagtcttttttttttaattttttactttaaatttcaggggtacttgtgcaggatgtgcagggtttttacataggtaaatgtgtgtcatggggtttgttgtacagattatttcgtcagccagatattaagcctagtatacattagttatttttcctgatcctctccctcctcccactctccaccctccaataggccccactgtgtgttgttctcctccatgtgtccatgtgttctcatcatttagctcctacttacaagtgagaacatgtggtatctgcttttctgttcctgcattggtttgctaaggataatggcctccagctccgtccatggccctgcaaagaatatgatctcattcttttttatggctgcattgtattccatggagtatattatacatgccacattttctttgtccagtctatcattgatgggtatttgggttgattccatgactttgctattgtgaatagtgctgtaatgaacatactcatgcacatgtctttataatagaatgatttatattcctttgggtatatacctagtaatggaattgctgagtctaatggtatttctgtctttaggtctttgaggaatcaccatactgtcttccacagtggttgaactaatttacactcccaccaacagtgtatacgcattcctttttttctccacaacctcaccagcatctgtttttttttttttaataatagccatgaaataaagtcttgatgatgataatgatgatgatgtcaaggattctgacaatgtaaacaatgatgacaatggtacagtcttatgggtggtatgttagtttcctcatttgctaaattaattttttaatggctactctaaaaaagtagcacaaacttgttgactgtcttacagttttgaaagtcagaagtccaaaatgggcctcactggcctaaaattaaggttccttttggaggctcaaggggagaatccattttttttttgtcatttccaggctttagaggtgacttgcatttcttggctagcagccctcttccaaattcagtcagcaacagacagtggaatccttctgaacactgcatcattgtaacattctgactttctgcctctttcctccatatttaaaggatgtttatattccactggacccacccaaaaaattcaggagaatctccttattttgaggtcagctgattactgatcttaatgccatctgcagccttaattcccacttgccatgtaacatattcaaatgctctggggattaggacattcacatttttaggggcctttattctgtttatcacagacaagattgtatttatgcatttttgaaatacatacatatatacatatttcatatagtatatatatatataaggccttgagacaatgctttctttacctagaacaaagttattttgttctaggtataattatttccattttaccaagggaaaaaaaaagaataaggtgaagcaaattgcctacatttctggagctggttatggcagagccaggactggaagccagatttccaaacccagtgttctcattcagtgaaaagtggttttcctaaacccagctgtcatgttcctcaagctccagaacctctggagggtgagctgtggtggacaatttgagaatttaggtgggttttgtttcagagattgaaggatttgagagatgaaggattggcagttgctgaatagtaagtgctagtccatggacaaatttatgcaaaaggctgcgttctccgtcaatttacacacaattgctactcatctgtaagacttagcatctgcctcacactctcctatatttaaccctcagcctgatcatgtgcttgtcacaaatcaatatttctcccactcgacaggaacttcagccctttcaaatttgttccaggtaatttgaggagactccagggcagtgatgaaataaagtgaaagcccgtgatttactggatctggaggcttgtgctgtgagtgagaagtgagggtgaaagacccttatcacaagtatttgtgcttttagatgcactgagtccccacccagaggtaggctccctgccaactcagtcccaaaccccctctgaaatggggaagaaggggcccgggctgtgcagttcaggtaccacaaggtcttcatttgtgcttgcagcaaatagaaaagcatgtttctgacttggcccctagtgtgaggtctggtcttggaggttccgcggtctctcttaagactctcactggctcacctctgctgcccctccacatgccagaattctcaggcaaactaagcttaagcaccaactagggctccagtgcagcccagaacttaaagcactttgctaggtgcagacctggctttggtatgagtctgtgtaatttgtcccatgttgtcacagttgtcagtcacacctccctgtttatagtggttccagggctttgggattcttcaggatcagtcctgcatagtccagccagaggggattactgttccccaaggtactacaggcctcttctttcatcccagctgactgtggggcagaatcagctctgtgatattgataaagaactgaaatagatccttttagacttcaggacttcatcagcctgaaataattttctcagtactaaataaatagttaccccaacaatgatgaaaaataaatatcggggctatgggtgaaataagttgctgaaggaaatttaatgttatcaataatataatggaattttgccctgttttacagttcataaagcactttcacacatgttattcatgtcatcaggaaatgtttactggcgggccccagtgctggagatacaccaggaagtgaagcagagattgtgttctcgcaggccttcttctgggattataaagtggggctgctgaggagtgaacctgtaatcttacacattagcgtatactcccaccatggagccatatcctgctcacagtgcatgtcatcacaaacaactccccgaggcaggcaagactgttaatactacctccacatcagggatcaggcaattgagcctcagagtggtgaagaatcttgccaaagccccacagattgatatgttaaatctgtgttcagttctggcgatccttccaatatgctggtttgttgcaaagcacagtgcctggtccataggaagccctcagtaaatatgaatagctgctaagtgctcagtcaatgccacctgctattatacttgtcacggtggtgtgagaaggataacaaaagtcatcggagcatctgaactcatcagaggccgccagaggaacattctgctccagagcatttgtgttccaaatggaaactataaaagcaaaaataaaatgtttatattttctagttggctgtaaataaagaaataatgataaaaataaattagttgcctgacctaatgctttaaagtttgcagattgagtaatgtctttttccgacagtaaatttagttaacagttatttgtaaaataattaaaatttcaagtaacacatgctcattttgcttaactaagtttgtgggtttattgttgaaaataaagatcaaataggccgggtgcagtggctcacgcctgtaatcccagcactttgggaggccgaggcaggtggatcacaaggtcaagagtccaagaccagctggccaatatggtgaaaacccatctctactaaaaaatacaaaaattagctggacgtggtggcgcatgcctatagtcccagctactcaggaggctgaggcaggagaattgcttaaacccaggaggtggaggttgcagtgagccaagatcacaccactgcagtccagcctgggcaacagagtgagactctgtctcaaaaagttgagtttatttttcagctaactggctattttaaaattttggaaaaatttaaaaatattacaaatcatacacaatagatgttgagttaaattcaattcagttgacttttttgatttggtatttttttaaaaaaaaagttgaccatgtgtggtggctcgtgtctgtaatcccagcactttggaaagctgagttggaaggatagcttgagaccaggagtttgagaccagcctgggcaacatggcaagacctcatctctactaaaaataaaaaataaaaaataagctaggcatagcagtgtgttcatatagtcccagctactcaggaggcacaggtgggaggatcgcttgaacccaggaggttgaggctgcagtgagctgtgatcacaccactgcactccagcctaggtgacagagaaagaccttgtctcaagaaataagcaaacaaaataagcctatcagtaatatccccaaatgttaataattgataccttgatttaaagatagtgatatctatttactttatatcagcatcacttaattttgataaatactccaagccttcattttgtttttaagtaaaagatgtaaaactcatctgggaatatatcaaacccctactagtgcctgccctcaaatgatcaagcctacacatagctgagtcgtaacaaatgtgttttaagggaatatcaagcattagcaatctacccaccacaggaaaacatctaattctataggagtcaagagttagtcctcattctaaatgcagatactctggggtgtgtaattcaacccatgtaagtgccccctctgtgcctggaccatggaatagatcgttcataagattgctgcatctcaggagacgggtcttttcaggagcactggatgattaggccaagttacttgggaaagccagtcactgtatttatttttacaagccagatgctggcacgtagtgcattcttttacaaaaataaaagggatttggagaaaaagaaaggttcagggtcacagatgaaatcatgagggtattttacatggttttatgggtagaaatttttacttttaccttctacaatggttctaaaaaagccgttgagctgctctgtgcagaaagtacacagggaagagttttatgcccacagtagagtaaaaaccttaaactgggacatcaagggactccatgcctgaggccgtggagaggctaatagtgccacggggtagggaacaggggagtctctgttcaccatggtcctgtctcattcctaaggagtctttgggagcccatagttaagctgttttgataaacagtaagtaataaccagatatggacatgtggaattgattaagagaggagggattaactaatgcactaaataacccatcatgcgtggtgggttggggaggaggtagagacataatggtacaagctcctgacgaagaagggccctgagattttccttcagcccacagatatttactgagcacctactgtgagccagctcctgttctaagaacgaaggatatgacagtgaaacaggcacaaattctgctctattgcttgtggagcttacattcttgagggggaacccaaggatgcttaagaagagacagaaatcatcacaatgagaagaaagagagtgatgtggtagaggttgctactttacatgggttgattagaggaggcctctccgataaggtgacatttgggcaaaggcttgaatgaagtgagagagtgagccatacgtttatctgagagagaggcagataattccaggcaaacgggacagctaacctaaaagctttgtgacagaatcatgtttggcagaatcaaggaataaaaaggcatcttagaaattgcttgggtaatgctttaagatcaattgtcatctcctttcaacttgttacagactcctgcttttaggtgtatgctatatagttattggtcaaacattaagagctggtccccattaataactataacacttcctgtattcaggtgatgagaaaaagaaggtcctgctctcaagaggtgcaaatagtgctggggagaggtctggagagaatgagagacagaggcaccaatagctaagtagactagaagtaggtagcagaaccctgacctccacatttctcctgtttgttttaacagctccgcttagcagcaccacaagaaggagcgtggaaagtatggaatcagatctgtttgtgcggtttttacatttcaggcgattaagtgaaatggtaaatgaaaccaaatctattgcctctatccctgtcagtgtgaggcaaagagggaaaataaacttcaactcctggtgtagacagtggaagggtgagacaagcaaacccagctccttcacacccacttcctttcttctcacaaagagaagtccctctcagtccctcagagcttacattgatgtgtccagagagggaggttaaggaaccctggagattcattgttgggcctcatagctgtgcttttattcacctgtcttttataaatgtccactgtatgccagcattgtgctggtgatacaagtgctgtgatgggaatatgcacaaaggtgggcttagaaaaatcttcctgaagaatgcaacaggtatctatctcaaagccagacaagtagggtttgatcgccttcgcttttttaaaacagttccttcattgttaatctgctcaattcatctccgagccatggtctagggcaggatttttttaaccttgacacttgaacctggataataattccttgttgtaggggctgccctgtgtattacaggctgcttagcagcatccctggcctccacgcactggatgccagcaacccctttctccccaatttcgacaaccaaaagtgtctccagacagcgccagctgtcccctgggatgacaatcacccccctgttgagaatcattggtccagatgaggaagtcccaggccaggcctggtgttacttacaaactccaggtacacaagaatgaggctcttcttatgaacatctggtctcattttccactgaagtttgaacaataggaaacaggctaaaaaagcagcaggaagatgttaggttcgctatggaaaagaatttcctgcttaagaagttagtaaggactgacttggcgatgtgggctcttttttggttccatatgaactttaaagtagtattttccaattctgtgaagaaagtcattggtagcttgatggggatggcacgttgtgcacatgtaccctaaaacttaaagtataataataataaaatttaaaaaaaagttcaaatgcaaaaaaaaaaaagtaaggaactagaaaatctcaatgcaacatttataaaatatcctctagatatgtgagtgaaacaaaacttcattaagctgcttatttaaagggaaagttaatctgcagtagaggacaaagtcagaaatagttgctttgtttcttaaaaaatatataattgccatttcaatatatttaactgcaattatcaattaaaatttgcctgaaatggttggtgatttaaaggtgttttctgaggctttgagaacttagtatattaactgaatgtgaatgactttcaaatgagtccttataagtagtatgttttcataagtgaatacacagtgttctctaaataactgtggacactgttaatttttctgtattactgaaaatatagatttcagttctcccattatctgaattaacatgactccaagttagttgtgtctcacttcaccttaaaaaaaaaaggtttctatctaaaaggagggaaagaattaacattcattgaccacccatttgtgccaggctttgggcaaggtcagcagttctctagtgagggggattttgccttccagggaacactttgcaatgtctacaaacatttttggttatcacaactggaaaggtattatatgagcatctagtaggttaaggccagagatgctgctaaatatcgtacagtgcacaggccagctcgctccaacaaacaactctccagccccaaacgtcaatagcgctgagattgagaaactctgcactaggctatatatctatgttatcttatattacccttaggacatttcttaaaacatctttactattattatcccctattatagatgaagaaactcaggcttagaggggtgaagcaacttgttcaagatcctaaaactagtacatagaagagtcagggttcttatccacaccctaggtgctgtgggcagctgtctctaccacactcagctgtcctcttgtaggtggtttttaatttattatcattattatttttacttaaagccatgtgtgacaggactttgcaaggaggatgctgatgagtccaaaggaaaatcacaagtgtgcccagtcctctactaatcaatatagcatgaagtcatatacatcctgtcccctcatgggtaataaattcttttttttttttattttactttaagttccgggatacatgtatagaacacgcagatttgttacacaggcatacatgtgccatggtggtttgctgcacctattgacccgtcctctaagttccctcccctcacccccacccttcaataggccctggtgtgtgctgttcccctccctgtgtccatgtgttatcatggttcagctgccacttatgagtgagaacatgtggtgtttggttttctgttcttgtgatagtttgctgagaatgatggcttccagcttcatccatgaccctgcaaagggcatgatctcattcctttttatggctgcatagtattccatggtgtatatgtaccacattttctttatccagtctatcattgatgggcatttgggttagttccatgtctttgctattgtaaatagtgctgcaataaacatatgtgtgcatgtgtctttatagtagaatattttatattcctttgggcatatacccagtaatggggctgctgggtcaaatgttatttctggttctaggtccttgaggaattgctgtactgtcttccacaatggttgaactaatttacgttcccattaacagtataaaagtgttcctatttctccacaacctcactagcatctattgtttcttgactttttaataatcgccattctgactggtgtgagatggtatctcattgtgattttgatttgcatttctctaatgatcagtgatattgagcttttttcatgtttcttggccatgtaaatgtcttcttttgagaagtgtctgttcatatttttcacccactttttgatggggttatttttttcttgtcaatttgtttaagttccttatagatgctggatattagacctttgttggatggatagatcgcaaaatttttctcccattctgtaggttgcctgttcactctgatgatagcttcttttgctgtgcagaagctctttagtttaattacatcccatttgtcaattatggcttttgctgcaattgcttttggcgttttcattatgaagtctttgcccatgcctatgtcctgaatggtattgcctaggttttcttctaggttttttatggtttggggctttacatttaagtctttaatccatcctaagttaatttttgtataaggtataaggaagggtgatccagtttcagttttctgcacgtggctagacagttttcccagaaacatttaatgaataggagatcatttcccgatcgcttgtttttgtcaggtttgtcaaagatcagatggttttagatgtgtggtgttatttctgaggtctctgttctgttccattggtctatatgtttgttttggtaccagtaccatgctgttttggttactgtagcctgtagtatagtttgaagtcaggtagcttgatgcctccagctttgttctttttgcttaggcttgtcttagctatacagggtcttctttgattccatatgaaatttaaagtagtttttttttctaattctgtgaagaacgtcaatggtagcttgatgaggatagcattgaatctataaattacgttggacagtatggccattttcatgatattgattcttcctatccatgaggatggaatgtttttccatttgtttgtgtcctctcttatttccttgagcagtagtttgtagttctccttgaaaaggtccttcacatcccttgttagctgtattcctaggtattttattctctttgtagcaattgtgaatgggacttcattcatgatttggctccctgcttgtctattgttggtgtaaaggaatgcttgtgattttagcacattgattttgtatcctgagactttgctgaagttgctcaccagcttaaggagtttttggggtgagacgatggggttttctaaatatacaatcatgttgtctgcaaatagagacaatttgactctctctcttcctattagaatatgctttttgtctttctcttgcccgattgccctggccaaaacttcaatactatgttgaatagagtggtgagaagagggcatccttaccttgtactagtattcaaagggaatgcttccagcttttgcccattcaatatgatattggctgtgggtttgtcataaacagctcttttattttgagatatgttccatcaatatctagtttattgagtttttaacatgaagggatgttgaattttatcaaaggccttttctgcatctactgagataaccatgtggtttttgtctttggttctgtttatgtgacggattatgtttattgatttgcatatgctgagccagctttgcatcccagggatgaagccagcttgatcgtgatggataagttttttgatgtgcgggtaataaattcttagcacacgggtacagtcttttgtttcactttgttttcctcgttattctgtaaacctgccagtttatgcacgtcaaaggtctagaagaccttgccagttcctctgtccagagtccccaccctgccactgaggagtagcatgcagtttcacaagtcgtgttaccccaagagcttcggtttcctcatctgtaaaacaaggatgataacactttcctcacatgattgttgaaatgatcatagagtaataataatagtcagaggtacaatttattatgtgtgttatgtactgggcgttatattaagtgctctacacgtattatctcatttaatttttagaataaccttttcagtagttgttgcccccattttgcagacgacaaaagtgaggcactgagaggttgtgtaatttacttgagtgcaggtggtcagtaagtagcagagccagcatttgaacttagaatgtctggctctaagcctcagactctcttaaccacaaagctctctgtcaagtgctatacaaatgtgagaattattatgagcaatgatagctagtttaggtgattaaaaagctttatgtgcttcagagagttttcacagggtaatcatcataaattcctttttcatcgtctttgctgttccatccttgtgatcattatgcagtacctattatgtttcacctttgtgtttttttctttcttttcacaagtttaaataagggaactaggggtcttttttttaagtcaagctttgttaatagattttcagaatgcacattaaagtgccagaaattgagtgcttttctgattagtaaagattgtattggttttttttttaacaattcactttttagatttctattttaagcccacttagagctgattacaataacccctatttataaatagaattttactgggcctcacctctgacgtattttcaaattcagtctcactcactctaagtaaaataatcattcatcaagtgaaggtagggtagaataagagcatatttctgcagctacctctgtgttctgagggagccagccataaatattcagcatcggtggtcagagtttggctctgcattaaatcataatcattttactggtgaataaatgacatgtttaattattttatatggatgtataaattttggtcttgatctgggcagcatatttttaacatctggatttttttgttttcttgttgtgtgtgtgtgtgtgtgtgtgtgtgtgtgtttaaatcactgtttaggctgggcatggtggctcatgcctgtaatctcagcactttgggagaccaaggtgggtggatggcctgaggtcaggagttcaagaccagcctagccaacatggtgaaaccccatctctactaaaaatacaaaaattagccaggcatggtggtacatgcctgtaatcccagctactagggaggctaagccaggataatcacttgaacctgggaggcagaggttgcagtgagccgagatcacaccactttactccagcatgggcgacagagtgagactccatctaaaaaaaaaaaaaaaaaaaaaaaaaaaaaaaatcactgtttagctttaagtgctaggacacaaaatgtgaagtcactgtggtctttaaaaatctcaattaaccagaacattcaaattgctgggtgtattcaacactccacttctgggataaagagttaagtgacaagggcagagctggccgtgggaatcactatggggctcccagtgcctaggcaagtcaggttgagtgagcctccactccacccatcacataacacacacacacaccaatacaacattctacaacaaaaagttagcaaaagagtgttcagcaatgacagtctaaaatggaaaagtcagagagatgaagtctcaaagggacattctgtattctggagattatgtgtagagagatacagaagaaagtcatttggcaacaagtttcaacaagcttctgttatatgggtcacccttacagggtcgtaagcatcccttgggggattgttaaaaataatgtttaggaccctgtcctagtcctactaaatccaaatctccagaaaacccagggaaaatgatttatttaaagggccacaggtatcttggacacaccccagagctactgaatcacagtctctagagcttgggccaggaatcggaatgcaaaagaagctccacaggtacttctgatacaaacccccggcttagatctctgggggtggttcctggcaatctgcatctttagtccatcctctaggtgtgtcttacagacaccccagtttgagagacatggcatcaactattgttctgagttttatcagagcagaggtagccaaatcttctagaccttatagatcagctccgatgcacaagattggcatgaaaacagcttacattaaagtttacttaaaaattacacatttcctattaattttaatcttcacagtcttatgaggctgctgtagctggaattataagtgaagaaaatgaggttcagaaaggataagtaacttctccagggtattttctgagcactctgagcaggtggcagagtttgggctcaaatcacatctttttgactcaagccctgagctccattcctgcacttatgatgtggtgcacagtgcctagatagcactttcacacatagaatcttccttgtgctatagaagagccctgtaggcaaagttacttatcctttctgaaaaatcacaatctcggctcactgcgacctcaacctcccaggttcaaccaatcctcgtgcatcagcctcccaagtagcttggactacagacacacaccagcatgcccagctaatttttgtatttttttgtagagaacagggtctcactttgttgcctagactggtctcaaactcgtgggctcaagcagtcctccgctctgccttccaaagtgctgggattataggtgtgagttacctcattcaggccctcctgccttccttttattatatggtagggtgggatgggcaggaatttgttgtcttttgggggcttctgatgtccgaatgtcttattaattagccctaccaacagacacaactcagaccagagctaaccctgtcaatttagacatcacttcctctaggaagcctttgctatatccctccagtaaaggtcacatgacctcctctgcacactcagtctccctgtctttgtccatatcacatagcactatctgttccatgaggccaggtattgtccatatgtacaataggaacataactcttaatcaaatattcgtggagttgatgaacaagtgcagttagaatcagtggataaatccttctaatattcaaagcaatgaaggcagctcacttttctcctatgcctattctaaaatcaaattattcttttattcatattgtctgttttaactagattttatgtgcataagtgtattgtaaagtgggaaggaagaccactagaggcaagtacttccttctccatttgatgatgaggaatctgaaggtaagaggcagcaagtaacttttctaaggtcacacagcctatcaggtatagagctgggttttgcattcaggtcaattgaacattgaaccctgaggacaggcagctggtaagtatcacagctgagattaaaacgcaagccatctaattcccatcctcatctttcttctgcttgcttcctgcctaaaaaacaggataacaaaggagggttgtttctgtttgtaatttcaaagttagtactcaatatatcacaagggtctcttaaatcatacagtgttcattacctgcatattccttgtgagagttaagctttggtcttcctcattttaccagatgggaaaccaaggccaggaagtttcagcattctcaccagctcttcagaaagctcatgtatcttggaagcagaatgcaggatggtgctggaggggctgagagtaggtaggaaattaagggactctgttaggagcagtggagtaaagacctttaacttgaaaccatttaaaaaatactttcataccatatatttgtgagcccaggtaatttctgaatttctgatccaaatcttttcctccaaaatgcctgctaagaaactctagaggtcgggggtgaagcggggagggagaaggaagaaaaaaaaaaagaaagtacaatgattccattcagaaacttggtccaaatccttgtctctttcttctatcagaaatcctctgttgtcagtccctggcatcacctagagatttccttaccagcagcattcttatgtttttactaaaacttctcctagaagagcatgttttgcttttaggagccagacttaagaaagtgcatcagcttaaaaatacatttgcttgtaatttttgtccatgctgccatctgacaggatttgaggatgcttccatttctgccaggataatagctttgttatctgctgagatctgcaatagctcgacagcacaggaaatctgtgtctcagccccctgctccaagtttagctcatccattacctaaaattgggtttacacaaggaaaattactttagtgctaatccagttgacttgtaaagtaaatttagcttcctcgggttcctagtcccataatctaaactgatttcaacaacagctttaggagtcctcccacacttcttaagaaccctcaggagcatgggtccccagcaagctgaccacagctactagtcatcttcaagccagtgatgtttgctgccttggtacattgtccgtggctccacaattacacactggagggtagggctgggagtagtgggagaagatagccttgggctattcatttcacatttctgtgtctccgtctgtaaaatcctggtaacaaatgaggtgccacatagagggaaaaagtggaattaaatgttttgaacccaactcacagaaaatctgtggagtaaaaagctgattacaggtaacaaaatcttcctttttttctcccttgttcctaagtgttagacctgggttcacttgccacaacttataaaccaatcaaatgtgatgatgtttaagacttgcttacagtggtttccccaaagctaatcaatgaaaagtccttacattccacaaactagtcagctttgcagcaacagcctcaccttcttggggaggcacatgatgtgagtcacacaattttcatgccagcccagagcgttgggtgccattacaaagccatgggtgtcttacatgaatgggagcctcacggggggttgaagaggctgatctgatctgtggttcctcaattcagaggacatgagcttttgaaaataggcctttctaggtggattggcctgcatgtcatagtttacacatactgagagctgatcatatatcaataattgttctaagttccattgtgggtgagtgctattgtgatgtgctattgtgtgtgtactattgggtaagtgctattgtgatgtttatcagatcctcatcataaccacatgaagcagtaaaggtattatctccaactggggcacagaaaaaaaaagttaacttgtccaagtcacatagctagtaagtggcaggcctagaattccaacccaggcattctatcatgattactagtggccacgaatcagatgattgtagtaacttgtcctggacttgggagatctgtatgctgactcatagagccctaacagtgtcttaattgatacgcccagtggtttcttctcagtcaccagtgaactttgtagaataggatgcagctggttaccctttcatagcatctttcacccttttttcccacctctttgagactctttttagtgtgctttgttgacttctcttcctctttcaacctcatatttgtggattcccccacaagtttctgtccctgcccttcctccttccctcaccatctaatctcacctgcatacccagtgtgctcatcaattcttataggttcaactgtcagttctataaggatgactgaaatttatcagccaaccctgactcttttcccgaatgcaagacctgcatttccagcctcccattggacatttccctatggacagcctgccagcattccctatttcacctctccacattgccgcactaatttgcacagtagccagtacataataagcatgtgataaattggtaatagatgaaagaatgcataatttaatgaaacagttgccaccttccatagatttaatcttccagactgctcttacctaagctactttcttccgtttttctgaatcccctcacttaaccctgctctcaggtgcccctcaacctgcatcttttgtttctctttgttctggtgcctgttttcttctcttctacactcttttatagttatttctgtaaatgtcttttctattcaagaatatgcatacattaagggaagagattgtattttcttcattggttttcactaaatagcctaacaccgtgcatttcacaaagaggcacaccatatctatggaaagagtgaatcagtgaaagtagacatagcactctgcagtttacaaagggcttcacaggtaccatccctatattctgcagtaggccgaagagatagccgttgagtcattagccccattgtacagatgaggaagctgcaagttagtgtggttgttaatggtccagaatctcactgctcttaagtttccaagccattcttatgattttaaactggaaggcagatcatcccctcatcatgactttctcccccatgtactcgggaaaaatgagggagagagacaagagaactttggggtgaaaactcacattgggaacaattacaagtgtgtctgatttggtagcttggatgttacaaccactcatcaattttcatgtggcttcaaagaccctcatttgaagctcctaagagcagctcacttcagaagagacccaggtaccaatttattctggagagttccagtgtttcgtcctaaaaaaaaaaaaaagaaagaaagaaaaaagaaagcataaagtttaaacagatccaaggatttttcttttggaatctgacagatctgggttggaggcccaactttaacatttaacaatcgcctccctgcccccatttataaaatgaagataaaaacactcttactcgtggtgatatatgtggattaaaaggataaattttaaagtgcttggcatgactcctggcatgggaactcagtccattttctccctctgcccctgaattgtgcctctgcctttaactccttctatatgtgggaccatgaccggtgaacttggggccaagatgagcctcacctaccaggggtagagagtagaaagcccaagctgatgactgaagctggaagtgtcagcttcttgcacaattgctgccctcttagagctgcttgaggccatctcaacgtgcaacatgactgacatgcagttaggtcattgaaatcacaccatcggaattcttcagcttaatatgtcgcttcttagaaagttaatgcccttttgatactatcagtatgaaatgttgagaagcaaaagctcaaaggcttaattttagaagagagagagcagtttctaaaggagtgactgatgggagagagactcagtagttgactatgcaaaggtgcccagggcaggtgtgaacaacaaagctggcttcctgatacaggtagtactgaaagaaccccggctccacagccctgcagcacctttaaagaaagggtgagggagacatgcttaagcatttttttttctgctccacaacagggcccagggtattgacagtgctgacagaacaactgagaagttgtttaggttggcattaacaaacccggcacattgccttttctgattgacacaattcaaacgggtatcaactgcctttcagtaccactgagaagtggtgaacgatgagggaatcatagggccatccaagtgcattcctagcagggaccatgaatcagccttatcttgtcccacctcctctttacacagggaggtaagccaaggctcaggacatcatcagatatgtgataaatcctccattaactggaatagtcagttaacaagacttgtttgccttttatattgttatagtccaattttggttaagtagaggtaaaataggtaaaaataagatggttgtttgtttgcttgtttttgagacgaggtctcactctgtcaccaggctggattgcagtggtgcgatcatggctcactgcagcgtctacctcttggactcaagcaatccccctacctcagcctcccgagtagctgggactacaggcacgtgcccagttaggttgggattttttcattgaagtgattttaagtaatatgtacagtttcacatctggtaccttgctccaccatttactaactaggtgaccctggacacatttctttatttttatttttataacttgctctgttgcccaggatggagtgcagtggtgcaatcatagctcactgcagccttgaactcctgagctcaagggatcctcttgcctcagcctcccgaagagctggggctacaggcacatgccaccatgcctggctaatttttaatttttatttatttatttatttattttgtagagacaggtcttgtcttattgcccaggctggtcttgaactgctggctttaagcaattctcccaccctagcctcccaaagtgcatttcttaaattcttatatatgcctcagtttactcatctgtataagagggtaaatagaacttacctcttatggttgtaacgataaataaataagataaagtatatatatgtgtatatatatatatcacttaaaaagaataagcactcaatatatatttattttattaatactgctattatcatctgcttttgctctatctctattcctgcctgatgcacctgaaggttgagcggcattgtaaacagagggtggcagcatgagcttaggcattgtgtggaactggatgtgaacttggggaaattgcttcattctctaaacctcagtttcctcatctattaaatgggaggagtaatacctgcctctacatgattcttgtatggaacaaataagatcatatttataaagtgcttaatacacacctgccaataaatggtcaacatgattatggttagaataaggattctaaaagcattataaagtgccggatcatgaaagatcgtagctcttcattgattcagtatttatctcttgagtacttgctttatgccagatacagagtttggcactggggacccagatttacaatgtgttgaaacaaatggaagtttctcgtgaactcttggtcactaatgagatgagaccatcccgttccaccgcactttcaagttaatccatgctcttctatagaatccttacattccagctgtgggatggctgtgtctcatatctcctcagatcaaaaagcatttctgcgaacagtgatattgaacattaaactggctgcatcaaacttgaaaggatggggcggtgattttgtgtcacaatatttttaacattatgcctggcgaatgtgcacatgttagatataaaggaggtttccaaaggggaagctttactacttggacttttaaattgccaggctgcattcttgggaaagccacataaaagaatacccctttttaaatgagtattacctcaaaaagtatagctcttttacgaaaggaatatgttgttctgaagccttgtccttgatgattttactgatattgtgatggttatttcaactaacataagaaggaatctattagataacaaacattcacagattgcctctgcttgctgggaattacatccagcagcttgaagagctgggtatattgaaaggaaaagggcgttttaaatgtataatctactcttccctttggcaccaatccgtgtagtgagacaacacttggctgggactcgggatctggccctggcttccattctgccatgactttgagaggaaactcaagttccgccttctccaggaagttatccctgaccaccccagcctacggtggattttcctgcactgaatgtgttacacttagattccatggtatatgatttaacacatggcctctcatatgaaataacatatgaaatgttatttcaacattttatatcttgtctctccagaaacgttacatgctccttgagggaagaaatcaagtctaacctgccttttgaaccctctatgtagtgctataaaataaatatgtcctcaaccaagtcctgattgactaagaaaaccagtgattggtcaatgatgttactttgtcttctgctaaacatttttggggcaggggatagaggggtgtgggagaatgggagttcaactcagaggaaacttagtaaagaggaaaagacataacagacctggtattgagtccccatctggccaattaatcaccaagttatcaaataaagcctatttgatctcttcgacctcattttcctcatctttgaaatatcttcctcttagcatgattttgaggatcaaatagagataatatatggaaaattctttgtatgcaggagcccactttgtaatgttattcattgcttcaattttcaatttggcttgggttaagaaaaaaagtatttttttttctctcaaaccagtgagcgggggaagaatgataaaaatcacattttctgaaattactctagcttatgtaagaagtttgatctgccagtatttgcctttttctcacatcacctgctgcatgccacacacctgatttgtctgttgtgttcatgtaggattttgtagctcacaaaagcattttcacatgcattatcatacaaaaaccctgtgatacaggcactgtggaagtaagtattcccatttcattgatgagtaaactgagactcacagaggctttaaaaatgccccaacatcaccctatcaggctgacagtgcctgccttcctccagccttgtcctctttccacaacaccacactggttctcctgtacaaatattaggcagctcccacaagacattctcagtcacaaacatgatcaccatctacttcctagtcaaggagatcagttcacgcattttgtcttcatacaaataattaaaacagggactgggtaccttggcccatgcctgtaatcccaacactttgggagttcaaggcggggagatcacttgagcccagggatttgagaccagcctgggcaacatggtgaaaccttttctctacagaaaaaacacacaaaaattgctgggtttagtggtggcacttatggtcccagctacccgggaggctaaggtgggaggatcacccaagcccagtaggtcaaggttgcagtgagctgtgattgtgccacagcactcctgcctgggtgacagcatgagaccctgtctcaaaataataataataattaaaacattcaagcaagatcccattcagtttataagtcattaataattcataataaatgtaaacattgtaagcctggcctttctgtatttagcagtatagcaaaatggttaagaattagatggacctggccgggtgctgtggctcacgcctgtaatcccagcactttgggaggccgaggcaggcagatcatgaggtcaggagttcaagaccagcctggccaacacggtgaaaccccatctctactaaaaatacaaaaattagctgggcatggtggtgcatgcctgtaatcccagctactccggaggctgagtcaggagaattgcttgaaccgggactcgggaggcagaggtagcagtgagccaagattgcgccactgcactccagcctgagctacagagcgagactccatctcaaaaaaaaaaaaaaaaaaaaaaaaaaaaagaattagatggacctgatcctaatgctcgttctgatgctcagatcaaggggaaaatgaggaggctttttaggcctcggtaaatcagagttaacaacacccagttaacaagcccagtgtcacagtgagagtgaaatgagataatgcatatatagcactttctcctccatgtgactcatagataaaagctgttgatatttcaactgttctgggctatgtaaattttaaaagatttcatgtctaggtgacacgtgaaagtccagcacgtggaccataaatgttgtcatggtttgacagtattaatgaaacacttcatcgtgtgtcagccagcctcaccttgacaggtcatctctggctggcgtaacccaagggccaatgtgaaaaggacatttcactgaggacatgatggggttgccttgtttttcttgcttcttaaagagccatttcaattaatttttttcacacataatcctgaccccttggcctcccagtagaatgctatacgtgcacaacaggaattttggcgtttattgtttatcctctgggggaatgtggtcccccttttactgcctttttcagcccactccccccagttgaatttttctgagaggcagtggaagggaaagtatatacccccatagttgtatttttttatccttattcacgattctcaacagctttttaaaagtgatggctggcagccaggtacagtggctcatgcctgtaatcccagcactttgggaggctgaggcagaaagatcatgaggtcagcagttccagactggcctggccaacatggtgaaacctcgtctctactaaaaatacgaaaattagccaggcgtggtggcaggcgcctgtaatcccagttacttgggaggctgaggcaggagaatcacttgaacccaggaggtggaggttgcagtgagcccagactgcgccattgcactccagcctgggtgacagagcgaggctccgtctcaaaaaaaaaaaaaaaaaaaaaaagtgatggctgggggcctatagtctataatctgagctgacctatatccatggcacatgtgttaaaggtggaaccatagtaggtcaggacagccatgtaaggtgtaggtgataatatcctgactttggaaatgaagaaatggatgcttaaatggctaagtaattatttaaggccacatgggtaagaaagggcagagctaggatttgaactctggtttatttgattccaaagcccttgctcttggatgctgtgacttagagtttttcaaatgccactttcttaaaaaggggtcttctagaaataaaaacttttaagaaaaggtgaactttcaatggtggaaatgtgtgtattgtggcagtccagtcaggaaatggtgtgttatttttgagaagcaaaaccttttggtggttctcgactgttctccaaagacgcaatgtgcactgggcctccacgtagggaactccctttgctgagtctttaaaggaacctactggctgatgatgattattattaataaagtctaatatccagagagcaggattctttcccatgaacaggaccatggaaagcctggagttgggggaggcctagggagtcaacaatacaaaggaggcagtaggttcatggagagtgctgtgtgggggcacagtgaggaattgctacggggagcctaaagcagcattgtccagtggaaccacatacgtcatcttcagtttttaagagctacattttaaaaagtaaaaatgaatgaaagtaattttaataagctatttttaacccaaagatccaaaatattttcattttaatgtgtaataaatataaaaatatgaatgagatattttactcttttttttttctttggtactaagtctttgaaatccagagtgtattttacacttaccacacatctcagtttgagcccaccacattcaaatgctcaaaagcaggcacgtgtggctagttgctaccatactggaccacgtaggtctaatggtaacaatggcactgcagcctccttgacccagcaacactcactctcctccaccccacttcattttcctgcatacacttaacacctgccagactatatatttcctttatttgtttatagtctacctcccagtattatttagggttcagtctaagttggtgtaataaatggatggatgggtggatggatggatggagaatggcttaatcaaggtagaaatggatttccctccagtctagaggaggctctccatagctggaagggtatctctgttcccagtgttcacattaacatccagcctcagtctatcttatccctctgccagcctcaacctgtagtgtttaccttgttctggatgacttcttcagcatttctcttcatggccacactccagtcagggagatacccctttttttttttttttttttttttttttttttgctcagccctatcttctttcttttcttctttcccttcccttccttcctgtctcctctctttctttccctgtccctcccttccttcctttcttccttcctccctccctcctcctcccctgctttcctcctttcctccttccttccttccttccttccttccttccatctcctgtttctttattttggtaaggacctgacccagaggtggtacaccttgatcagaaggtaaacacctccttgatcagaacatagtcacatgaccatatctagctgtggtctccagctggtggtcagttaatgtaaggagttctactattaaaattgggagagaagagcagatcttgatggacaactagaagtctccaccactgtccctcccccggaatgtaaactgccatgagggcagggattttgggatgttttgttcaatgtagtagacccagcagtggtgtaccaagggctgggcagtgggaatatgcaccctggcgggggaagagtattttaaacaacattgtttgaattgccggtgcataacggtaataaaagtggactaacataattggtctcattattgtttttatattatccacagagtctgcatccaatattggctgcaccagagcagactgctctgttgcccagcccttggtacaccactgagccctggcacctaaaatagtggctactcatagcaagcactcagtatctgcagaatgaaccaatagatctacctctgcctcttttccttccatttcttcctgacttctacccttggagaggcagccctcaccaggtagtagcccttatggcatttcattatggttagctacttcttcctctttaaactgtgagctctttgagcaccagaacctgcaccagctgccacaacctggccaccaaccaggtgctcaattagtgctagttgaaggaaccagtaaaattcattgaaggctgctccccttagcctcacttagcctgcatttagttgactccaagcaggaattttctatctgattctctttgttttgtctgaacccgagatgttgaggctggaaatacagtcaagatccaatttgtgagctagcttatgagtcaggttaaggaatttacactgtatcctaaaaacagtaggagtcatcaatgcaatttaaccaggtggaactttcattaaaatgtaactatgtgatgtgaggatggggaagaaggaactaattggccctttctcttcagacctcttgacttcagctttctggggactggcatttccactgttcttccatcatttctgagggtatcattggtttaccctctcaatccaaatgttcctctgtggttccccattttgatgtttaatctttgaggcatccacttatgtattcatcgatccttcagcagtcatgtactggaaacccttaggatgcatgctctgtaagacagggcgttctgccttgtccactgctgtggccccaagagtgggaggagtgggctgtcagtaggccaccaataaatatctgtgttctggctgacccccatatgctaggatactggagatgaggaactggagaaggtgcttaaagagcacatctgtctggtagaggacacagagctgtccttcaagcatttgaacgatgttctcatttccctggaatcttctcctctccaggctcacatctctagctccttcaatgattcctcttgcgacatcattttagttctcttccccaacctagtctttttgcttttaatgaatgatcactgatgtatagccctgatgacatctggtgtccacagtggtgcctgatgctccgggtgaagttgaagtttgaccagtaagagggaagaaagaatggctcctccctcatttcagagaatacatcctagtcacaagtgcccctaatgtcactcaggtttttgatagctacattccctcactgatccagtagaatacactaccaactgatgcaccatcttgattaacaacagcaagcctccccttccttcctcagtatctctcctcacatggtctcccatccagatttgctttaagcctgccactctggaagggacaccagagatcatttaaataaaacacgttatagaactggttaataggctacctctatgtctctgcaaatattccaagcatagtttggtgagtataatcaaagaccaaaacaatgtttgatcctcatggagggacactatgtcttgttatactattgtaagttcccggggttttattcattttggcatttagtggatttgtctttgacatgttggatttaaggacatcattattcttggaatttagaaaagaacactgtgcctggcatgacatgaagccaacttagaaaacccaaatttgaatcccatttttgccacttaactagctgtgtgatcttgggaaagttggttaatctcataaaacctcagtgttttcatctaataaagaatactaatataaacatagaatggacagaaaaagtgctaaaaatgtacaaacagttcatgtaataactagtacaaaagttttacaaaggtgaacatatgaaaaagatgtttaactttactaaggataaaaaacgaggtatgatcttaaaaagtgattttacctagcaggtactttaacaggcacttgtaggcattgagtgcagaaaaatagatactcttccccattgatggtagaaatataagtcataacagttttcttaaaagatatttataaattcatgtaaaaaccctgaaaatgtgcataccttttaccccaaaataattccacttattgttttgagcctagaaaaataatcatagcagtatataaggatctatctacaaggatgtttatctcaacatttttataaataatgataagttgaatataatggtaactgtgtaattgtggtcactaaaagtaatattttagaagaatacttcataatgtggaaaatacatattacattaaaaagaaaaaactatgtctagtataattccaatttgcaaaaataatttgtgtgtttatatgtatgtgtacagaatatatgctacatattaaccttaattatctgtggtttgtggatgtagatgattttaattcccttctttgtgcttctattcttcaaaattgccacaacaagtattatttttaaaagggtggaatgagaatgccctggggtatcttataagaatgtgatgaaagtctaaatttaaattataaattaaatcatgcacatttattgtattattgttagatattagactgatctcaagctttgcctttctttttctcccttcttccctttctccttccctctctgtctccatctgcccctttttcttttcttcactgtctattctctcctttccttctaggcccggttttttcctgctccttccatggggagcattgctcagctgcccctaggattcagagtcaaatagtttgctgaccctggtctgaagctcatttgaccaaactgagcaagaagtgcacaagtttcttgcatttccttccagacctctagtagccctgacacacatcctggactaatcaagactatgtgaaacgtacgtccatcagttcagagttgagctcttgtcatataggagcaaattaccaacttctcaaaaactgccaggggtgggagggggttctttccttctgcatcccaagtgctggatgcctctgccttccaacactactcgaaaatagctttgtcaaacaaagcatgaacactaggagtttctgacattttcataactatgagcatatgatttgcagttcatattgaataacgatgtaagaaatctgccaagaaagctccaaatactatttccagcactggttcataaccagttacagctgcctcaccacagaatgtgagcacaatagactaccatgttccatggtctcttgcttgcaaagtttgtattgagttactaggagtcattctaatgggggaagtcactctcctggaaagcatttaagatgaataaagtgaagggtttaatgttctaatgaaaaaatttgtcaatatattaatcaaatgtgtgaacactaaacgtttttacgtatgtttgctgtagaggttttaaggcgggctttggctttccagactcaaataaagtagatagatgcactgttaaactttcgaacaatgacaaagaaaaacatggggtaattgcttcactcaaagcctgccaggagattaattgcctaagagatgtattttgtgcagtatccaaaaactgcagaatctacaggagtgtcttgctttcactaggagaaaacgtatgtcacctctcaccaaagatgtttatgtcttttcacaaacctgtctttttgcagtctaaaaacattccaactggaaatgactacaaagctgggagttgataggttaggggtgtttagtaaagcttcaaatactctcatggagtcagatacgattccgtactacgagccccacataacagcaacctgggcccagggattgtgaagccttttcatttctggttaatcagtgggagaggtggggagccatgagcctgccttggacccaccagccccgaaactaaaagactaaagttgcagggcttatggggagttcgcctagtgcacttaagaaatagggatggaacttgccttgttccacctttgggattgtattcaaatgagggcttgctaaaggctgaaggtgttggaatctgtaggaggtctgtgtagccatagcagagaaacatagagtgcgcttttataaacatttatttggtgccttctacaaaccaagttatatgtactagactctgctgggagtgagactggggttgcattactactacatggaaaagtaagaacagttgctgtatttctggaacattctgcctggtagaggaacagacttctcaacaaataataattatacagtgaaggatgctagagagaacatattttctcatgaactaatctgaaagtttcaggaaagcatcttaaaggagataagactgaaccgaaactggaaggatgagggacagagagccaggtgaagaaaaatgagaatggatttcctggaagggaaatagccaaggcacaaacatcagtgccagtgtgatatgttcagaaactataagctgttctttaataccaggacctgagaaccaagaggggcaatgcaggagactgggctgaagatgtccatggggcagttatatagggaccttgtgattgctgttaatgtgctaggactgttgccagtggactttatacaatagagagtcactgaacatttgtgagaaagagataatgcaatctacctattagctcatcattctatggcaacaggaaagatcaatttacaggccaagaatggaggtagagagaccagttaggagactcctgcagccatcttggtgggatattttgagagcttacactagagtaaccataaaaggttagaattggaaagaacatattatacagttcaacttccatattatacaaatggagtaagtgaggacaaagaaggtaagtgacctatccaaggttgtatggaaataaccttgttggcagccaaagtgggaccaagaccctggtcttctcatttccagtccggtgacttttccactcagcaatgccaagttcagtcccagcatcatgcttcagttagggaatgccctagagaaacttgaaatgtacttggctggcatttttcctggccatatctaggaagtgagaacagtccttgttggatggagggaccttgaatccagccaggctgcctgggagggatctttttctgttcattatctttctggctttaggtacctcccacatcttccaccctcttcttctcctctaaaaatccttcttcagccattgcttacaaattctctcccttctgctgagtctaggcagtgtagaacaaaacctagcaccttttttcaagtttgtttcctcaatattttaacctaactattgtatcactgttaagcacttgggcaattttgaggatgaataatccaataaaatcgaactgtttccatctaaactccttccacactttacatggcggtgttatttgtgcaaatactgttttgtgttgtctctttttcactaaatcatatatgtacacatttcaaagctcttggctttattatatatttcttataatggacactgcaagaaatttggagcaagacctaagcttttgggaaagagacttaatctctggacctaattcttcaactataaaatggagataatgctacctaccttgaggggttcctggtacaaggtaggtgtatagtaagctttcatctctctctctttctctgtctctctctgtctctctcctctttctctttcctctgtgtgtgtctgtctctttctctgtctcctctctctgtctctctctctctctgtctctctctctctctgtctctctctcctctttctctctttgtctttccgctgtgtgtgtctgtctctttctctgtctcctctctcttggttgcttctggtttggggcaatgtagtattttcataaacatgtatgatcacaaattatatccatgctgaaattcaaaggtaatttttttgatgtctacctcgaggcctagaatactgttgagcatagaataaaatctcaatagggcataatggtaggaagaagaaatgaagaggagaaaaagaataaaccatcttaacttgaaaaccaaattagctgagatgctcgtgagcttccaatctcatacaggcattctaataacaagtattcacttactgtggacccaagaatggccagatggcttgtgaagaacatcagcctcagcaatcacacagatttccaccttagatggccttttgcagcctttggaggatggattggaagagtggaaggttggaggcagggctctcagtgaggggcagctgacaggtggtgggacctgagccatgagggaagaaagtggtcaaattcaagaattcctttggaagcaaatttagttttcaaggttgctactcttagaagctgcccctcttcctcttctcattatttcttccatttagcaaaactaaatgcatggggaggccaggtatggtggctcatgcctgtaatctcagcacttagggagatcaaggtgggaggattgcttgagtccaggagttcaagaccagcctgggcaacatagcaagaccctgtctctacaaaaaaaaaaaaaaaaaaaaagtaaaaaaactagccaagcatggtggcacaagcctgtagttacagctactcaggaggctaaggcaggagaatcacttaagcctggaagtttgaggctgcagtgagctgtggtctcaccaccgcactccagcctaggtgacagagtgagatcctgtctcaaaaaataaagaaaaatgcatggagaggttgggtggctggggtggggaagtagagagattgactacacatttcagattgctagaggatccctctttgctgccaccacacagaaattaaaataaaaagtgggagagatttaattcacttattgaacgtttatttattaagtatcaacaacttgacactgaataggcactattctggccattagggacatagtagtgaccaaagcaaagttcctagtcccatgaagtttgtttataaacaataaacaattgaatatatcaatacagagtatgcctgatgagactaaatattaacacaagaggtaataatcaagtaagtgtcggggggaagtggcagggcatgaggtcagagaggcaaggtgaggcaggagaagatgatgtaaggatattgtaaagatgccagttttacttagcatgacaagggaagcctttaggaagattgaaacagaggaggaacaggacaaatctgtgcattacaaattaatcattattttaatgtgaattgctgcttctgccattataaaaatttgtaagattctacctgtgacatgggcatctctgtattgcctttgggtgggtgctggagttgagggtacagagaggcattaaactcaccattgctttttacggaggccagtagtctttttttaaccaccatcagcagaaggaatgggaaacaaagctgagatgagacagaaaagcaagaattggggattgggtttcaccccacttctgagtagtaagatgaaattaaaacccttctaagatgtccctgaattccatttaccactctttccacaaaccttctctttttcaatccatgcccaaaggcataaaaggaaagaaaaaaaaaatcaaagcaattccagtaacacttgtggtagaaaatctgcctagattggtatgtgtgaatttcatattattctaaagtcccattattcttaataggcaattttagggggtggtttgaatgcctgatatttggagaactttcaaagcacatccaaggggtctctaataagaacttgggggcgctgaactcggggactccaagtgtcacctatgcatttccagcttcagcctaaccttgggggcaaagcaggcccttaacagaggaaaagtaaaaacaaccaaagcattcttagaggtgcaaggccgccctatcatgaaaacctcagtaaattgaagacagtaaaaaatcactcattcttttgattagcaatcttctgtattcttgcaaatactgtactagtgcagtcctatcatttcaaatgtgtgtttaaataggaataaaatatattacacacataattttccctcaaattacgtttgtgagatacaagcctgggtaattctgctcctgttccaagtgaaatgcaaacccttgtgtttccaaacatcactatgaagcaaagccaataccttcccttttctgagttggacacaagtaactcttccgtgctgctctggaaactatgacagaacgttattcatctgtttgttttaatagccaagggaaaaaaacttcaaaattttgatttaattttttaaagaaaaaaaggtggtatgaaacaggtcgagggactctttagctaagcgaataaatgttaaccaaattgtcactgaccagatgtgggaaccagcatgtgatattcgacacagtcacctcaaaattgcttatgcttacaaaggcattccaataaaagaaaaagggatgtaagggttagctgaattctcaaccctatagatttaaggcttctctgtgagtcgttggccctctgggttgacatgccttgattggctccctttcaaaactgaccttaaaggtcaagtatgttaacacgtactttttgatgcccactttcagaccggtctttagaaagcagagtttgtgagataacttcaggatcacatatttaacctgtaatctcttgaccacagccagcctgaggtgaagtctgcttttggtgctcccgacagctccccttcctggatcctcaccctccccagccatccctttccttgtctctgcctatacctgtccagagatgctccctctcccagggccatcatttcaaggtgtgtgcagctagggctgataagatttaagtgatgccccctcctcctggttagcagttaactaaggttgcttccaggcttgaagtctcctccagaagaggaaggaggtaggttggaataggaggtaacttttcagaccacctccaattataatctgttcttaaagtttctatgtctctgatcttctgtctacattggaataattctgcatcttttacttggatccttaattttataatgtagccccgtttttattaaaagccagggctaattttaccttgagagatctgtttgcccctcccaagggagaagaacgctgcctctgaagtgggaagcttcacactcagctcgaggttactagagccattatgtggccatgcttttaaccagatctgctaataggtggcccaattcacaagttttaaaaagggatgttttccatttattcatggccatgatggtcttttgggaaagcattagtaagttgtgtttgcttgggtaaagagaaattgctatccacatgacagaaaataactcccactttaataaactgctcactgagcaaacctatggaccgtccatctctttgagctgtgtgatgactttccttcaagggttttaggggcagccatcttgatgtgatttcctctccatggctcaaaacagggtgtatgaaaggggctggggggataaattcagaggtcagaggtgttgggctatttatttcactgctctctgtccctatgaggctgccatgctgtgggattgccaagtcactgtccccggcattccatttgaagagccatgagaatcagaacaaaagaacctgctgatactgagtaaactgctcatgcttatatcagtttagtctgcttggaagtgacttacaaagctacccccacgacctcccccaccttgaggcctgaatttgcaaccattggccctctcccaaggtccctctaccttggcccttgtgtaaatgatatttttttttaattaaggtggaattcacataacatagagttcaccattttattttattatttattttgttatcgttatgttttaaagagatggtcttgctctgtcacccaggctggagtgcagtgatgtgatcatggctaactacagcctcaaactcctggactcaagcaatcctcctgcctcagccccctgaatagataggactacatgtgtgtgccaccatgccctgctaattttttcatttttaattttgtagacacagagtctcactatgttgtccgggctggtcttgaactccaggcctcaagcaatcctcccaaccttgatctcctaaagtgcggggattataggcatgagccactgcacccagccagaattaaccatattaaaatgaataagtcaatagtagttagtatattcataatgttgtataaccgccacatctgtctacttccaaaacattttcatcatcccaaaataaaattccttgcccgctaagcagttacttcttattcctccctgtccccagcccctagcaaccaccgatctgcttttctctaaagacttacctattttaaatatttcatataaatgggatcatacaatatgtgccctttttgttcagcttatttcacttagcatgtttttgaggctctcccacatcgtaacctgtttcagtacctcattcatttttcatggctgaataatatagtctattgtatgtatctaccaccttttgtctatccattcatctgttgatgaacacctgagttgttcccacctttggactattgtgaatagtgctgctctgcacatttgtgtacaagtgtgtgtttgagtacctgttttcaattctttggtttaagtgagattttacagtcaggaaagtccctctgcatccattctcttctcattaagaagaggtaggagacccggcgtggtggctcacacctgtaatcctagcactttgggaagccaaggcaggtggatcatctgaggtcaggagttcaagaccagcctggccaacatggtgaaaccctgtctctactaaaaatacaaaaattagccaggcatggtagcacacgcctctaatcccagctactcaggaggctgaggaaggagaatcgcttgaacccaggaggtggaggtttcagtgagctgagatcgcgccactgcactccagcctgcgcaatgggagcgagactccatctcaaaaaaaaaaaaaaaaaaaaaaaagagagagagataggcattttaactgaaattatccccaaaaagaatattttaggaccaaatttgtcagtaccgatcggttcagctatgtctgcccatgccctgtatattctgatgaggaagaaaatcgcttccaattagaggatactcctggtatggagaagggtccactttggtgggctaccctgggatagtctcctcatctcttctagttctattggcctgtcagtggtaaggtgggcgctaaacagataaaatagtatatgaaactggaaatctgtggaatggtttgatgaaagtactgggaatgggtggggttagtgagtgactaactttccagggaaggtaggggcatttgggtctgaaagatgagaacattcacaaggagaacgagggggtggagggcatgccagccctaaggatgagcatgggtcaagccatgtccgcatcgaagtgcatcctgtggtttgagactagcaagatcatccacatgactaataccatcaggcttgtaggcttgtctggcagggaaggaagctggaaaaactggcaagaactagattatgaagtctctgcagaacagcatttcctttccttgctctgcagtggttcctagatgggcactccttttgctgccgcactgttccacgatccctcttagcactcttcaaatatccttcataagctccttgccctggagaaggaggagaccctggaggtggattacagaccacatttgcgtttcccaatcccatggcagagaatatggcaggttgtagaggctggcaacatggtaactcaattacctttatgagaaacatgagctcccatcacaaagcacccctgcaccttgacatcatggtgaggcagcggcgcacgctggtgccagccactgtgatgaatggccaaattccatttgccctttcacaatgcacttttcttctccattgaatgcagccttgggcacgctcactgcaagtgcccttgcacttttgctaccttgccacttgcttcatgtttttaatttgctgagcatggagtaaggcaggaagacatcaatgatgaaagaagtgtgagctggaaaaaagcataaagctgattaatgctggaggagcatttgttcccctccagccaaagccagtggggaaaaatggaaaagaaagaaatgtgtttttgactttatgtttaaaagaaaaccttttaccacccagaatgcaccaaagcttctccacagcagaaagcccctctaagcagtgcaaaaactccattgccaagccacttggaaagaagttatagagtgtggttagaaacactatttagagcaaatctagctcttctacttgctgcgtaactttggataagttctctatgctttctgagtctcacttttctcatctgtagaacaggaataattacatctttacctttttttataagattgttgttgggataaaatgacttagtatctgttttgtaagtatataaaacttagcagtatctgatacagaatcaagactcgttataaggtctctttctcgagtaggctgatttaactaagagtagtattgaaacgcagaacatagttacagatctaacaacatgggatagtggcctcatcttgagtttcagtttaaatcctagctccaccacagactgactttgtgaatttgagcaagttacttaacttctctgaatttgagtttctctctcgtaaaataaggataatagctcatcaggggctgctttgaagaaagcacctaacacagtacccagcccagagcagcagacacttaatacatgtttggtttttttcagtgttgtggttctcaaccacattcaaatcacctgataggtttctttaagcatagatacctaagcctcatccccagagactatgatttaataggtctaaggtggggcctgggcattcgtatttcctaaagcttctcaaggagattctttcattcttttttttttttttttttgagatggagtctcactctgtcacccaggctggagtgaagtggcatgatcttggctcactgcaacctccacctcctgggttcaagtgattctcctacctcagccccctgactagctgggattacaggcacctgccaccacacccaactaatttttgtatttttagtagagatggggtttcaccatgttgactaggctggtcttgaactcctgacctcagatgatccacccgtctcggcctcccagtgtgctgccaaggcgattctcataaggagccaagacagaaccactccccagcagataacagtacatactggttttggggtttttttgtgttcttttttaaaaaatctgtctcccaggagactgaacaggatagtaggaattctgggaatagtcaaaaatttaatacacctgcagttctaagcctttgataagaaatgtgcagccaaggaattgcattccattttattctgaaaaaaagtattcaaagagtctttttaagagtcttgaactggaaaggtggtaagaagtttagcctaagcctcacacataaaatatgggaactcccagtaggttggggatttatatctgggggtaattccagggttttgtcctcccaagagatataaattgaagccttgagagtttaatgtgggggagaaagaagtgttctcataatgacaccttaaaaatccagggctctgctaatgcctagggatagaaaagcatcatctgtaatagcaggggggtggcatgggggtgtattctggtctctgtacttaggtttccaagatccaagtgtgggtcatcaagaaccttctttctccccataggtttatggtattagttacccaataaaagttgggttaattttacaacccaagtaaaatttaagccaaaaaggcttcagcattactctaggatttatgaaagtaaacatgtggagtgcttgcaggattgtgcaacagtaaaatttcaatgtctttatgtcaggtatatgatatattcatttgtatgtgtatttaaaggttaagtttttaagagctttgcaacacaaactattttcagtactaaactgaagatacttcccccactttcacctttaaaatgattcttttaatgaatgggagtagagagaagcagaaaattagtgtcctatcaggtgatttttccacttggtttgctcctatactttgactttctagactcctacgctagaccttcaagctgggaagtgagcaccacagcactaaccgcagtgcctcttacgatgtgggagcttagtaaataactgtcttttaaataaatgtccctttggtcattgtaaatactttaagaatagccatatattatctctacaatttaaaaaagcttttacattatctgatgggatcataatgactttcccatgtagggcagagaagtcagttactgtgtccaacttgtagatgagaaaattgtggctcagagggctcagacagcttgcctaaggatgcccaaatgttaaactcaggaagagaattttgttctcctgactttgctctgagggatttttacttagaagaaaccaaaggggaaaaacggtgtatttttttttttttttttgagatgatatattgaggaggagcatccagggttgaagtcaacttatacacgtggcaggcagactttggtttggctatggtctgcctttgagaaacagctggatgttctgcactcgagggatcttgtgctcatcgtaggccctcgtgggagatggtagcctctgccctttcaggttgagcctgccatcttgggtcttcatctccagccttagatctccagtccttttacctggcacatgaatcatgtcatttctggtgtccctctgtcttcaagatgaaatctattacccctccttataaaaaaagtcttataattttgaggccgcaaaattttaataagactatttttttaaattgtagagaagcatgaaagcaaactttccatggacattttctctagatttccttggatttagtgactcaattcaaactctccagactatggtttgccctggtcctctttgggcagggtagagataatggaggttcagcagtgaagagtcacctaactgggctaccctcgggtttctttccagctgcacccagcttctcaccccatggatccccctaattgacgtgtcagttggagtggatctgttcgcccacgcctttgtagcaaatgaagcagaaataatctgtgcttaaaaaacaaaaaactgtagaacatgtgcccagatttccaactcatttcctctttactcctataactacatcatcttccagcccaccaccagctgcgaaaataaaagcattttctcccatatttaaggatgattttgtgcttcaggatgactttctgggggtgtaggaaacttgaccaatgtgaccaacagatgttttaagaactgagcaaaagcccaattccttagcccagtcttttgtatattgtgcccaactgtgccccctagtgactatttagggtatcgcgcagtcagagcttgctgtgccctgtatgtatgtggtgcatcagctaatgtctgtctatgctttctttcagagatgagtatgaagaagatggattctgtcagccatacagagggattgcatgtgcaagatttattggcaaccgcaccgtctatatggagtctttgcacatgcaaggggaaatagaaaatcagatcacaggtaggtagcaccaatgaaattatatttgtcccttgaataactatttttctcgccaaaagttttattgagctcctctcttgacaaaggattaagctcagcatggaggttgggagcaggaccataaaaaagcatgagacatgatctctgtgctctggaatttacattaaagtaatttattgaaggttgctcttagaggaaaaggaagctttgtgaaatctcacattcattcaaacactcaataaatattattaagtgctttcaccgtaccaggaactgaatctgaatgggagaggtgatggtgtgtaaataagccaggtacgtctctgccctcacagagcttactgtttagaagcaacatgatgtcgactgagaggggatgaatttagagtttagagttctggacactcatcccagaactattatgacagtgaactttggggaaatcgcttactttcccaaaaagtccccttcttcatctgtgaaatgagtgatgaagcaagatgaccattggtctcttcttgctctagctttcaatatttcactcttcatttttcttaattgaaagtatccttttgatagaaatctaatagcgaagcacttactagcacacatgagttaaagtagcataggctgcctcataggattttgcacgcatcgttctggtggttacagcagctttgtccccttccattagtgtagttatgatgcctctgtgtcacgtatcctttgcaatccattcacattgtcttcatgacattctaatgaggttgccatatctagcaaataaaaattcaggatacccagtaacatttgaatttcagataaacaacgaataattttttagtataagtatgtcataaatatttatctgaaattaaaatgtaaccgttgtctttttctttatctggcaaccctagggtctaggagaggtaagaacaaacccaaggcagaaacatagaacagcaaaaggcccagaagctatgtggaagctatgtgctatgaggaatgtgaaggaactgagaggaggctggggggaagagggaggaggactttttttttttttttttgagatggagtctcgctctgtcacccaggctggaatgcagtggcgcgatctcggctcactgcaagctctgcttcctaggttcatgccattctcctgcatcagcctcctggaggactttttaaccaaccaaaagaagcaactgtaggaataggtagttgccattttctgaagccctcatttcaacaggaagagaattctgaaatttcaaagagcagtaagactgacagggaggagctgttaaacacccatttcaacctaatgtaagaatgccttaatgtacttttaactgaatatccacaaaagcaagtagacattttgggccaggcacagtggctcactcctgtaatcccagcactttgggaagctgaggtgggcagatcacttgaggccaggagttcgagaccagcccggcctacatagcaaaaccacatctctactaaaaaacaatacaaatatcagctgggtgtggtggcacatgcctgtagtcccagctatgtgggaggctgaggcatgagaatcccttgaaactggaaggcagaagttgcactgagctgagagcgtaaccctgcactccagcctgggcgacagagtgagactgtctcaaaaaaaaaaaaaaaaaaaaaaaaaaagtggaagttttgatgtaaataattggtaacctatttataaaaatcctctcttggagatttctaatgggtatcagcctggtggaaagtttttttttaaattcatttacctttgtttatcccagcgtttcccaaacttgttggcttgtttctcaagcactattctatttcacatgattaatgttctgagcaacatacttggggaaataatgtatcagcaacctcctaggtttccttgtgaggtgtaagctccttgtcaatagcggtattcaaaggtaggctggtgcgctttttgtgcatcttaccctactagtaagagattaagctaaggaaccactaatattcgatgatacacattggaacaattgtactgtgctctttgagaacttccaagtgagttgcctcattttcagaagatggagtagaaagtattccagccacaaagaaattaagcaagttaccctaagtcatccagcaactcttgccgtccagcaagacacagaactggatcctgtgctcaggctcagccactgcggaaacaagttctgtccctacagctgtcaaatgttttagaagcctcacaaaactaataaaaagcaccagatgaaacacaaagttcgattgctttgtagtaaaaaatgaaaaatatattgtactttaacttaattaatttttttattaggaaatggtacatatgtaatttaatcctgttttattaactttgtagtcaaaatggtttttttcaagccagtgaaagtaagctgcttagacatctgaaatgaatctccttctctgggccttgtctgtttcagcacggcggattccttgcaatgtgtgtttatatctgatatccgttgactagataaccaaagaagataaaccctggcctctgggagttaataattgtgtttgttttccagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaagtaagtggtagcccctgaccttctgtgctcttctaagggtcagcaacctgttggcacagggaaaactggaccttgacccatagtgattttcatactgttaatcaaattattttccaatgggctgagtactgtgcctgagcattcagtggtggattagacatagttatcttcaagaagcttcatgaagacaataattttaaaatattggagctggtttctcaataacttaaacatagaattactatatgacctagcaattctactcctgagtatgtaatcaaaagaactgaaaacagatgttcaaacaaaaactcatatgagaatgtttataacaacactatttacaatagccaaaaggtggaaatgacccaaatgccatcagtagaggagcggttaaacaaattgtggtatatccagacagtgaaacattatttatccataaaaaggaatgaaatacagatacgtgctacaaacctggatgaacctggaaaacattatactaagtaaaagaagccagacaccattgtatgatccatttatatgaaatttccagaatagataaatccatatagacagaattcagattagcggttaccaggggccaggctaggggtagtggagagtgattgtttaatagatatggggtttcctcttagggtaatataagtgttctagaacctatagtggtgaaggttgtacaatattgtgaaagaactaaataaatgcactaatggtacatgtaatggtaagtgtattatagcatgtatcagtacattctcacattgctataaagaaatacctgagacagggtaattgataaaaaaaggaagttcaattggctcacgtgtggttctgcaggctgtacagggagtatagcagcttctgcagaaggtgaacggagagcaagcttcttacatggcaggagcaagagagtgagtggggaagtgccacatgcttttaaacggccatgagaatgagaacttactatcccaaggacagtaccacggggggtttgtgctaaaccattcacaagaaccctgcttccgtgatccagtcacctcccaccaggccccacctccaaccctggggattgcaattcaacatgagatttggtggggacacagacccaaaccatatcataccgccattttaaagatatagatgggtttgcctccatcccctaccccatcagcagcaccacgcaaaagactatttcagtgtacatttccctttcatctagaattaatctcaccggcaatttttcagtttccttttgatcgttaatactattttgtgagttaagtaaatgagtgcatctaaaatgcttaacacatggtaagggctcagtagcaacattattattattgtcattactcctccaaactccagttcagttcgactgtgtagattctgcagtgcttttaagcccctctggccacgtgcgaggtcttcttaatgggatctgcttctcaagggtgccgaccccatcagcacagagatagcccccacttttgttagaaacccagaatgcacagcctctgataagcatgttctgtgaattacaataccaactagattccttattacatgatttcatgtctaaggctgtcagtcagaatggaaggaaaagtttggcttgaaccttccttgaaccattcactaggaaattacttctgtgcccccaggtcccaccccagttccgatttcttctgtgttcaatgttagaaatacttttggaagactgattttattcctgaagcaaaagctttaaatcctcccaggaatgtaactgcaaggcaggccctgggtccaagcccagcaaagcagggagactgtcctgcatggcccctgaccagcagggaagctgtggccacgaggttaattacctgccctcccctccagaaactgctggctagaggagagctccagcatctcctatgtttctttctaattgtttgggtttttgtgtgtttttcagatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcttgcggtaaatagaagtcattgcccctaatgtattcaatcatctttaaagatccctatcctacccctcttatttaggagaatcctataaggggggcaaagaaaatggacagtatttgcttgatctcaatctggttttagggtaaaccttgccgtttctacataaaacacctcgtaaggtaccaaaacacgttctcaagaagtcaactgcctttatacctgcagccattgcactcatggatgtaacagggacccagcccttcagaggcacagttgagacagtttatcacattgatttttatagaaaaagatgttacccagaatggtctgcgtccaagtggaccttttcagcaaaaaaaggaatattggaagcaggaagaaattgttttctgtatgccttaagaacaccacaaggcaggatgaatctacaaccattactcggtcatccaggacaatctgtgggtaaactgtgtccttcgttatgtctgttaatactgcagaagaagcatataggtatctagtaagaaaatggaattcctgagtcagttaactgttcctttttctagaaaatgtttggagaaaataatgaaaatgggccaagcatggtggcttatacctgtaatcccaacactctaggaaggccgaggcaggaggatcatttgagcccaggggttcaagaccagcccaggcaacatagtgagactccatctctaccaaaaaaaagaaaaaaaaaaaaagaaaatgttggtgaaacctggagttaggaactattttggaactaattcatcttcctgatcctagttctcatagatatcatagataatgccaagtttcccaggcatagtgggagagtcaggatgtcactgctggaaaagcaaaagctacagggtaggagggtgggcaaacaagagcaatagtcatgggacccacaatacaaagtgagctcggtgtttaaccagatgattattcaagccattcattcagaatatttgttgagtacctactaagtgccaagtacttactcatccgagcatggggagacgccagggaccctaaggagggagtaggcatagcacatccacaaagaagcaaggagtcatggaggcggaacaagcaaaagggagagtagcagaagattaggtcgggaaagtaacaggacccaatcatgtaaagctgtgtaggccattggaggacttaagctttgacgctgaatgagttgggaaagcatgagagggttttgagcagaagggtgacatgacctgacttatatgtttgaaggctcacctgggctgctgggttgagactagcctgtgggaaggatgcaagagcaaaagcaaggagatcagttgggaagctactgcaggaatgcaggggagagataaagtggccttgacaggaggaggagtggaagacggagggacacgtgggcagattctggatatgtgttgaaattggagacaagaggagtcactgatggatcagatgtgggatataaatgatggaaggaatcaagagtgactccggagcttctccatggaattgccttttgctgagacggagaaaactataggaggaataaatttagtgggagctggaatcaagagtttttgttcatgctgagtttgagatgccttttagaaatccaaaaagagatactgaggaggcagttttatatcacagactgaagttcaagtcagggtctgggatgagatggatacgaaggaaatgttggcatacagatggcatgtaaggccatgacacctgaaggaaagaggagcatatctacttaacaaaagagaaggaaatgtcagtgcaagacaatgaaagctagctttagactctgggtcaggggcagtagcctcagttcctaatgtaataatgatctaactgagtggctaccatgtgccagatcctatgtgagacaccttacctctgtcacctcattcaatcttcatatccagcttctatcatcctcatgttatggataagaaaactgacactcagtaagaattaagaggtttgctcaaagacactcagctatcagtgactgaatcatgattttaactcaggtcagccggattcccaaacctgttggctctttccactaagcatactctctctctagagagcaaaatgaatctgcttaatggcaacaataacaggtaaacaataaatatatagtttgtagtaaaagcagtttattgtaataggtaaggacatgggttctcatgtttaagtgcctgggtttgaatcccaggtcttcaatgaaatagctgtgtgctcttagccccttctaatctcatttttcttatcagtaaaatgagaaaataatgatatacacttaggatttattgtgagaataaattagttgttaactgaaaaaccctatgatgtccgaacatagtaaatgttcagtacacattatctattattatatagtcaatatataaagataaatcgattcgaattatcacatagtcaacatatgtaaataaatgcttgctctcagctcagcaaatattgtttgagagcccaccatggagtagggaggttataagaggaataaaatgattcatgcttttgaggtatgtcagttacaatgcagtatgtatgatacaatagaagttagcacaaatgttatggaacaaagaaggggaagggcttaaaaaattactaaagaaatccataagaaaaagttttaaaaatattgaaaagaaccctagtgatgaaaatttgagagacccttattctataattttgttcctacctgttacttgttattatagtgactttacttgcaaaatggttttacggaaagttgaacacaacaaattttagaaagatcaccacaccccctttgtgttgccgggtttcatacaccttcatatgggctttaatatactttcatacgtattacaaagtaacctcttgcagagccattgttgatcatttcaaggaaaattattctgtattttgtaatggtttgcacttcatttatgacattttccgtgttattttcaacagtgataagaaaggaataaaaacaaaacatagatttacttagttgccccattccttctcctaaaccaggtaaggtatgagagtctgcaagagagtccaggataaaagcagtacttactaagcaccttccacgcaccaggcacagtgctagggttttcacatgctttctttatcctcatcctcatactctgacaggtattattaaccctatttttgctgatacagaagctgaggctgagaaagccccagggtcatccagctagtaaatggaaggtctgtctgattccaagctcatcttcttgctactcttctgtgctacttcgggttattggttgatgtacagaggaaaccaaatgaactggtttgttttgtttctttgttttttgagacaggatcttgctacgttgcccaggctggtctctaactcctgggcccaataaatctttctgccttggcctcctgagtacctgggactacaggcatgcaccaccatgcccagctttaaatgaattgttttaagaaagaaatgggctgggcttggtggctcacgcctgtaatctcagcactttgggaggccgtggcaggcagatcacttgaggtcaggagttcaagaccagcctggccaacatggtgaaaccccgtctctaccaaaaatacaaaaattagccaggtgtggtggcatgcacctgtaatcccagctagttgggaggctgaggcatgagaatcgcttgaacttgggaggcggaggttgcagtgagccgagatcgcaccactgcactccagcctgggcgatagagcgagactcagtctcaagaagaaaaaagaaagaaagaaaagaaaagcattatttgttccaccctaggtaaacactattgttctttgggtgacttctgacccttaatttccaaccaatgcctatcagaagtagggaagtaatttgtccagaagctggaagacatattgatactctgattcaaggactcaagctctattacgattagtttaagcaaggattacaaattatacctaaagtactcgttttcatttcgatgcccttcctgcagcatccagatcaaacccatgctaggagggatgaaagaaaccttcgaaaggtctttcagactgagtagaaagagggagatcacttacatctacaggatacctactatgtgcctgcatggtgcctggtgctttacatattcatctccatttaaaattcacaaccatgctgtggggtaggtatgattaacatatttcactgaggttcaaaggggctacaggacttgtctaaatcacacagccaaccactgtctgcatagagctctgaccaaactcaaagctcatgttcttttaccagacactctgctatctctcatttgaagatttttctgaaataaatacaagcatggtgattggttccacctctggattacatcatgccgatttccattatatgatatgacatcaaaatcttcccgtgctgatgaagaactctatcatagtattactcagtgtgttattatcttagtattaatcagtatagcaatgttgaaaacccttggaatatttcttttctgaatatatgtgcagaggacacagtgaaaatcctgaggactggttaatactagtcacatgagagatgaatttagatgaaagttaaatatagagatgacaaggcagttttcaccacttagatttttttttaaagaacattttcattttattttaaaacaaagcagttcctcttgaattcttcaagccaagccacgaatatatccattaaaggaacagggaagccttgacatatgatcaataagctgctggagggccagtagctcccaggtgggattcctgagaagacagtaggtcagcatcagctgtgctcaggggtatgcgtgtcttctcccagtcgccctcagcccacctctaacaaactgatcatcatggaatcctatttttataactcctttggggcatttgatttttttttctcatttcattgtcacaaaaccatgaaagatcaagtaggaatttccagccctgttttaccatatgagaaaatcaaggcccagagaagtgagaaggcttacctaagatcacaaatgaattcatggaaaccaggtctcctatctctaggaccactgctctttgttctacaccagtgattctcaaccaggggcaatttcatcttccagggaacatttggcaatttctggagagattttggttatcacaagtgggtggggttgggggatgctactggcaactgttgtgtagaggtcagggatgttgctaaatacactgcagtacccagaacagcccacacaatgaatcatctagcccaaaatgtcgaatgttggggttgaggaactcttttctacactgtacaattgtaaactatagaataacaataatattcaatagtaattatcatttattgtatgcttacaatgagctgaaaactctgctgacacttttaggcattatctcatgtttaaatagttctatccccctaggagtaggttttattatacccaagaaagaaaactgagacttggagaggttaagtaacatgtgtccgaggtcacatggttaataagaagtggacccaggactcacatctgtactcagccttttaaactgtggtttatgcatgtatgttgtgtatgtgtttttgtgtgtgtaaacagataaaacttgagaataacttcattttacagtgagttgtaagctagtggggcagatttgaaatgagccctttttctcctccatcctgaatgagacagagtctcataggaaaattcctgcattctttagctaactcaaagttaaggagatttcagaatctccatggggtttctcattttcctactgataacttttgttttagtttcaactaagtagagctaaaagaagcataggcctaattaaatagaaaatgtgaacgtttgttgtactttctctaataaaggcgcttgagaacagtctgctgcagattgttttatctgtgaaccttcactccagagcagaatataaaattaagtacaatcaaatatggctgttgtaaattctgggaattggcttggctaggattatatgcatatgcccagacagtgcttagagaaagtgaaaaaaaagacaaaagttggtttgggcaagacctggcttctcatcctccatgtcttttctttcatgtcacaggcatctaacaattagaattactaattatttattcattcactcacagaaaccaatatatgttgagcttctactgtgtctcagaccctgtgaacaagctaaatcagaccatgcccttgtgtagcctacaatctaatgaaggaatcagatggaaaaaaaaatatgaatcacattaagtattgtcatatagttcccagttttatgtctgctcttatgtgcgtggcattttaatgatgactactgcttgttgaatactgtgctaagatatctgtgccggcatctagcctaggacttagttggtgctcaataaaatgtgttgaattaattggtttaatccacacggtaaacacaagataaaggtgtcatctccattttcctaaaggaaaaacaggcaatgttgtttttactgaagccgagattcaaaccaattccatagaatttcatatccattcctccatctaccatgccataactgcttaaacaatagagtcctgattatttcagaggaacacacattcctttattattttccctttccctttgatcattatgatctctctgggtctttgggatgctgcccattgatattcttatttgcagctccagggatataggaatgaagcccccagccacaaagatatctactctgagagaccctactgtgctcctcttagatgcagccctgatatagattagctccccagcagctccacccacatctcacagggtgtgcccttctcccattaagtcccatctcctctctttctggaagccccatgtctcctccagtcctcaaagttggccatcttctctgcctgcaaagcttcattcactatgctttcaccttttgttgtggtcaccttccaagtcaaatatcttgggttgggtgtaaactaaattgagaaagaagcattttgcctaagttctttctaactggcatctaggcacactgcctaggttcaccatttcactgtagccctttatcattgcttttctatgcagctctgggggtgtagctgtggaaactgtcaatacctctgagaactccttttgcaacaatctgtccattttactttggttgtattttattaataccacaagacttatgttctctctctctctttctctctgtctctcatttagatcccctatttgtttctttcttgatttgtatgggaaggcagaatctcaatcgtattggtatttttatatttaaaccatgggcctttgttttacccttgatcaaatcctgaggtcacatttcttctcctagccatgccagcatgtctgtttctcctctaagtaaaggtttctccctctaccaaataaaagttccaagcagcagtattgtttttactcctaaaccagcttcaccaaagagtatccatgataagaaaagtggtgaaccatttggctccatttggagttttcatacctggcctattgcttttgtatttccttttaagtcactggcttgcaacaatttgccaaagggcgcattgcccagttttgtgcctgaatagccttgacttgtcctataatcttacaaacacccaccctgggctccagtttgtcacaaaccatattctgcaacgtggtggtttacagttcggggcaaggcagatgttttccagattgtgaacactgccatttttaacttgctctgtcagcagccttctcccatatttcatagaagacctgttgtaaggcaatttgtctttcagccatttcttcaaaataaaattgaacgttacagtgaattggatggtggagggggtaaaggaggaagaagtatagcactgttttatatagtttgaagctttctggaagagttatttttatactgcagagattttcaagatgtgctttcatttccagtctctatacattttcaacaacaaagtaaagaacaatagtgacccaaaacttatagctaagtcatgttccatgaacatttttaaccataaaataatttctctcaaaggtttttttgttgttgttcctagtatatattgagtcatttacccagtgtgtaagctgctctagcaataagcttctgaaacctctgaactttttgggctcaccaccatgccagtaagaagtgcttgttggtgtcttaacctttgctgacagaaatctgatataataccacaatgattgttgccactggctttgtaacaaactgttttttggttaagcttctggcaggaaacacatggcacaagccgatagactaagggaaatgttataatgtaattatttagggaggcattggcagaattaggagaaaccattaaggaaaggtgcgagacctggggctaacatgaatgggaggtattaccatcctagatcagttaccttaccttgcagaatatagctgagactgaagagagggctgtccagcacatgctgtggcctttggtagagggatatagtcaaccctcagcaacccagcaaggaggaagccagaggaacaagggtttcaacccatactcttctcctgcctttcatctctggcaaatgactcccataggttcaacctaactggaagccacaggtcaaaggtatccattgacactatcagtagaggttggcctcagcaaggagctggtcagaaaggactgagactggatctggtgggctgaggatactcaggggaaatgtcatcactgactttaaatcgcttcataagagtcagctttaaataaattgtttcaagaaagaaatgggctgggctcggtggcttatgcctgtaatcctagcactttgggaggccgaggcgggcagatcatttaaggtcaggagttcaaaaccagcctggccaacatggtgaaaccccatctctactaaaaatacaaaaaaaaaaaaaattagccgggtgtggtggagggtgcctgtaatcccagctactcaggaggctgaggcaggagaattgcttgaaccccagaggggaggttacagcgagctgagattgcaccactgcactccagcctcggtgacagagcgacactccgtctcaaaaaaaaaaaaaaagttcagtaagggcctaaataagttatttcaactgaatttataaaatcagagaaccttgggagcaaccatagaaatcatccagcctctacttgaacattgccagacatctccagagacagagaaatccttccacttcaaagtgattatggaatgattccaactgctcaaaagttctgcctttgtaagctagaaaccaaaactcgtatgcaaaatctgattttttttaaatgttggccactgattccaattttttaaaaaacctaataaagaacaagtctatggactggatccaaattttaacttctggataatttcttacacaaatttgaagacatatgtcacatccttcatttgattttctctttggcctaaagatcacatgggtcctcctacatttccttccccattcttctcctctaggtgtttcctagtcctttagagccctccttaaaaatgtggctcttagaagacacctttcagtgctttttaaccagagcaggtagaagaggaccacgatgttcttgatcattacccagtattgccaatgaatactactatgttgctataagtgccatatgtaaaattttttgagcaattgcatcatgctgttgctgggttcatctgagcctttaaatcttcagtaaaacttattagtaatcttttgtttgtttttagggtttggttacatcaacaattatttagtagatttgtctaatcatggattttataaacaagatctttaaccttaaagcaacttataatatttatttttaaaatttcagcttctggtttggattcattatattagcctgtcgagtacgatcctctaaaattttattccataattaaacagttaggtatctttcctagattctggccatttcaagtttgataaacatatcatcaatgataatgttgagcaggcaggattcctcaagcatagccctttacaatttgatgttgattgactgattaacactattaaataaaggcagatgatgaattacaaatacatctgatgatattattattcaacctttcatcttgtccataagaatgtcataagtcactcgagtcatttgatcaaatgttttgctaaagtttaaatgtgcttagtctgtcactaataatctcatcaaaatgaaagagatttaattttatacaacctatagaattttgtcagttaaagattggcccgattaaaaagtgggcaaaggacttgaatagacattcctccaaagaagatatacaaatggccaaaagcatatgaaaagatgttcaatatcactaataattagagaaatgcaaatcaaaaccccagtgagataccatttcacacccattagaatgcactattaaaaaaatagcaagtgtgaagaaattggaaccattgtgatctgttgataggaatgtaaaatggtgcagctgctatggaaaacagaatggaagttcctaaaaaaaattaaaaatagaattaccatctgatgcagcaatcccatttctgagtatttaatccaaaagaattgaagtcggggtctcaaaatatttgtacacccatgttcactgcagcattattcatgatagccgtttaaggcagaagcaacccaaatgtccatcagtggatgaatggataaagaaaacatggtatatgcaaacaatggaatattattcagtcataaaaagaaggaaatcctgtcacatggtacagcatcatgaacctagaggacattagactaagtaaaatacaccagtcacagaaagatagatactgaatgatccacttatatgcagtacctaaaatagtcaaaatcagaaacagaaagtaccatggtggttgtcagggctgggggaaggggggaaatggggagttattcaatgggcatagagttttagttttgcagcatgaaaaagttctggagattggttgcacaacaagaataaatatatgtaacattattgaaatgtaaaattaaaaatggttaagatggtaaattttacggtattttttacaattaaacattttttaattattaaaaaagattagcccaattcttttatagaggaggaaactgaggccctgagagtttacagaaacttttagtgaacttgtgtggattccagttactaagatttttcccaaatgctcacaaatgagttgctctccctaacttattgtagttaaaaccttttctgcagggaaaattttaatcaatgtatatggcctattcagcatttttttttaaagaattcatttgagaatacataaggcaatagatcatctacttagtatttccatcatcaagtcaagagagtgaatgcctgggcccagcctgccaactgaaggcctaattacctctctctctcgccttccaggcatatgcctaaatcactggtgcaggcccctatgtgctaccaacctgcttattttatagttgtcaagtaataaattggtagtgattcctgtttgttttctatggtttttaaatttttttcagtcaaggttataatttaaacttgtttaatttcccttgaattctaaggttctgtaagatttcttcccacctttgccatatttaaaaccagagccttttcttgttttaactcaaagtaatatcccagatgatgtttcactttattaaaagtacctctttaataagaaatcatgattactttgctttaagcttcagggaaagaaaggagtattttctccattatatttaattactaatcaaagtattgaatatcattgtaaaaataaaataggaatgtcagatgtgaactgtgataccaaattgtttgatttttaaaaggaaattaatcatgtgatctggactaagtggttggtttcaaaaatctcaagtatttaacttgatgtaactaatatgtgcatttcacttttaaacagttattccaaagtattaaaaatcttcaacattctaatttccagccgattttctctgtaatgcattggaggtgtccattaccctttaaaatgactagtaagaataatgtccattgttccaaagtgattttcttaaaatagtatgattcccaccagatattagtcttcattgaaagagaacttcggactcttaaggagaatgatgaaaaacaattatatatataatgttttagggtaattttgattagtaatataatttactagaagcactgaaggtagacaggcttgcattccaacccagactttgctactttgtagctttgacaagttatttttcctttctcggtcttaatttctctgtgtgtaaagtcaagataacaccaatgtgccttccgggttaaaatgaggaatacaaatgctcggacttcaaaaagaacctaggcagatattagttttctaatttttcatttggaaggctcattgttctatggaatatttttatagaagattttcagagccagcagagactgaatccccttctggccaaatgcagagagctgtgtagggaaggaagcactttgtatggaagacttacaatgggcctgaatgtgtttctgtcacttccaacatgaccatgtattgttctccttgattatttcacttggcaaaaagacactgggcccttgtgcttgttagcatatcctcagtgtaatcagaaggagccaagcttgactgtttaaaggattcagcttcttgaagtttgttctcctgcagacctacagggggatttgtcccagaccctcgtttacaatagaagaccttccatgaataatctgatagggcatgaatacagaatagactcctttgtttgccaggcaggtgaggccctactttctcttgttgctaaaaatctggcctggaaaaatgactagcattgcgttagtactaaattagcctcatcgcttttgtaatcattaccctcaaaatgatttcactgaaaaaccaagaataacaacagagactttacccccctagggtactgagaaatatgaaaatggtttataatgttaataataaccataacatccaacaactgtatggcaattttcaattatccaaggttctttcatgaacattatctcatttgattctcaggtgaaccaaataagattggtagagcagggactattattcctgctctaccaatcgtatttattccattgaataaatgaggaaatggagatcagagagattgtttcttgcttaagattatctagcccaaaacttttacctgtgaatccccctctagtctaagggtaaagggtaaacattgagtggtaactggtactagaatagatttgttgcttacagcaattctgtgaagtaggtattactcccattttacagatgagtttgcttggagtggcaaagggcctactgaaggtcacgtagataatgaaaaggcattattcagaggtttctgacttggtgccttgtggcagaccgtcttctactcaggtgattcctttctgtctatctataggcatgtagacacaatcattactggtgcaaccagcactgactacgacggcctccagtgatgcctgggttatatatttacctgtaacagtgtataaagcagggattttctgtaatcccagcactttgggaggccgaggcaggcggatcacgaggtcaagagatcgagaccatcctggccaacatggtgaaaccctgtctctactaaaaatacaaaaattagctgggcgtggtggcacgtgcctgtagtcccagctactcagggggctgaggcaggtgaatcgcttgaacccgggaggcggacgttgcagtgagccgagatcgcaccattgcactccagcctggtgacagagcgagactccgtctcaaaaaaaaaaaaaaaaaaagcagggatttcaaaagcatcacatttggcaaaacttcagtgttattcccttcctttcagatcaccctcatccttcctacctccatgaaacaagaggaaccctactatgagaaaataggggcaaaattctccaattattggcagtgaagtgtagtagctagaatggtgggcaaaaagcaagaccgacgatggaatcccagcttttgacttactagcagcatgtccttgggcaacttacttaaccactctgtcttccagcatcttcacctataaaaattaggataaggatgtcatctaccttatagagttggttgtgacataaaatgagtttatgaaaagcacctggtccatagtaataatagctaacatgattttgcaccagtagaaaatatttgataaatattaaaattgcgttttgttttgtttttttgagagaaggtctcactctgtcacccaggctggagtgcagtggcgcaatcacagctcactgcagcctcaaccttctgggctcaggtaatccttccgcctcagcctctcaagtagccaggactacagacatgcaccaccatgcctggctaatttttttaattttttgtagagatggggtttcgccatgttgcctaggctggtctcaaattcctaggctcaagcaacctgcctgcctcagcctcccaaagtgctgggattacaggcatgacccactgcacccagcctaaaattcgtattatttttattctactctgtaaccagatttaacccctctccaggctcttctgagggctaactcacagggcacagtcccaaaaccaggttttggtattccttttgaataactgatatgccatatctcacctgccaaacagttcccaaacaaggtgtgtacaagtaaaaactacatatggtttattctcatttacatgtactagggtaactcatcatttaaaggaccttttgggtcttttcatcactatctttatacttccagtttagcatttacaggacatgtcattatctttcttctattttccttaccagacgatgagctccttaagggcagaggacatgtcatacttaattttgtattcccagtacctacaatagtgcctgacatgcagtagcttttgtttattgacttactgaatgagtggaagggtaattgaatgaatgcatggttaattcttttgtaaggtaaataatcatctctgaattttgtgtcaatttgagttttcacactttgagttttcttaaagatagctgatcttcgttatcagggcatgtcattatgtaacccctctaattactatcccataattctgtgtttgttttaccagtcaaataattcattaatgacaatatatgcctaagtatttggtttcaatggttaggctcaaactgataaaaagacaagtatgtctcgtgttctacacatattatattcttttccaagcaatgggatataagatttcaaaaatatacttcaaagtgttagcactcataattattgggctcatatgaaaccatttaagaattctggggtttcaataaagtgtcagattatacagtgctgccatgctggaaggaattatagacaccatccaaaacagacacttcacttttgcagaggtaaaaaatgaggcccagagacgtgaatatttgttcaaggtcacacagctgatcaaagatcaaactgaccctgacttcaggcccccatattctcaggccagtggctttttggacactgggaccaggattccttagtaatgttgattctggaagatgcaggcttggccccataagtccaaaccagccaagacaaggtcatgatttctagaacaccatcttgtgggggctgatctgggctggcagccaatggaagaagagccctgtggtccacattaaggctcttggatgtatacagtccattcacgtggcgtttaacttttaaggtgttagagaaatgtaggtctgccactaaagagaggcaacatcagaggaggacccacacacgtacaaagtcttcataatgtccctctgcagtttttaaacatttgaactttaaacttttaaacttcaataaattatgttgaaggtttgatggaaacaaatggtaataagcagtggattcctttcttctcacagtggatttgtgtgtataaaagaatagaagaggtggttcattttaaactatgcaatgtaatattatacatgttactttaaagagtataacttttgctctttttcatttctgcacccagattcaaaggattccaaggagaagaataaaatggaaatcctgtacatactagtgccaagtgtggccattcccctggccattgctttactcttcttcttcatttgcgtctgtcggaataaccagaagtcatcgtcggcaccagtccagaggcaaccaaaacacgtcagaggtcaaaatgtagagatgtcaatgctgaatgcatataaacccaaggtaatgttagcagtacagagctacatttgttccgtgggcttcaagttaaagcaccatgttataaccctcccaagcttggaaatcgaatgatatggaatcagagttttataagtgctaaggttcattttaaccaaatgcaaagacgaactacctacctctatctaaaccaagacactttcatcagtatgtctacttcagtgttgagccagccatatcactgccttgccatagagtcattgggctagaagtgatccctaagaaatcatcctgaccagcccgtcaggactcagaacgtgagcaatttttcaaaatttcaaagaggaaatttcatacttttccatccaaattgcaagagagaacaagatccatcattgttcacaaacttcactgtcaagaaccttttcgttgcataatatgcaaatagttaaaaccactgtactatatacttaaaaatgattaagatagtaaattttgttgtgtttttttaccacgatttaaaaaaaatcctttgtatgcctaacttacatccctttttctttggcttaagtatattttaaggaagtgttgtccttccaatagtcttcgaatgctgttttatgataaccaaccttagccttccccactttgagctaaatcaaccccttcccttttgcttttcatccacatctttcaacgtttgagttgctcgaggtcctggcaaggaacccagggtcactggcccttaccttaaatggagcccctgcactgcatcttggaactaaaatacaacagagtctttctttcaggaaagccagcaccacaatcccaggcctctcagcaaaaagatttcatttaaataatttaagactcttgcatctaacagcctgtttttttttctaattattccaattccataagaacattcattcattcaacaaatatttatcttccctgtggactagtaactgtattattcttttgatcctcataaagaggagaagcatcacttttaataaaattttaggaaaaaaaagtcttcacactcaaattaactaatcctcttatctaataaatggagtagcgtaattgggctgacacagagccctcatttttttttctgctttactgtttaaattttttttatctaaaaaatcttgaaaagatttttgctattataaagtcatatttattaataggatttggaattccttaaatgctaaaaattcagtgtatatattctgtattcagcaaaaccactgatctcttgctgagtgtgaatttttatcattaaaaacaagcaaacaacaaaaaaaaaaccctacaaatcctgaagaccatagagttcacacagtagcctggaggatgggcagggtagggattcaactcttttgacatcccagcttctagctagctgatttacatatattatagcattttatataatatcacatttaatccttactacttagtgctactataaaagtagtgaaagcaaatggatgggggttaatattgctacacattcacctagttgacctggcagatacttttacctagctcatgacttcaagcttctagtgtaagagtcattgttccatgagactctttccctttcatttctgttggtaaatgttgagaagtcttagaaacaccagaactctgggcgggggagagacctagatcattttggttacagcagacggcagtttggtgcagtagccaccatcctggaaagatgtactcctcattgccagggcaggaaccatggaagaatcatttccatttttagaaattatcaattttgtgggttagccttaatctgaaatttaattacatttttagtggaggtttgttttatatcacatgatctccaacagaaattccagagagctttgtggcataaatagaaaaaaggctaatatatatatcgatgaatacaaactgtcaagaacaataccaggagcttttacatccattatcacacttaatcctcacagctattatataaggcaggtattattattactattgtacaaccagggtaattgagacacaaacagactaagtaacttccccaaggtccaagagctagttattagaagcaataaaatgtgaatacaggatctttcaccttttctaaatagagctggcccttgctcttgcagaatccgtgataactttttcacagaacagatcaagttgggaaggaggagggagggttaggcaagcaactgagtgtgatcccatttggtcagtttgtgcttcagagtaaccacaggcattctcctggcttctgacaaatatttaaggggcctgcatggcagtctctgaatgatgtagccctagccctgccagggacatgtacaatttggctagagcaataatagttccccatccttcatggtcagagacaaatgtgaaatatactggcatgagttttcccagagactgggtgaagtaaacattgttttcatagtttctggatcatttctgaggtgtgccttgctaaatctcccagtgtcaagatttgtccactatgaggcttagagcttagccttaaactcctgaaccagagaagtagaaatggcttaaatatttgaatgggttggggaggggaaaggaaacaacaaaaacaaatgctaactttttttttcttacacttctaagggacttggctccgatcaaatttgagttattcaattgtttgttttggttcttactgagtgcctttcctggaaaaagcacaaaggactctgtagaccttaaagaaaattcctaaatgtaaacagaaaatctctaaaactgctttggaaggtcactgacacataaatattacatgtacctataaaatctaaaaggaaaggacacacataagaaagaaacaaagaaaagtcctgaaaacaaacactccaccagagcaaaatcaaaagaatatttggaggcgaggatgaaaaaggaatgaaggatagaagccagtctgccctagccttattcttttttccccttggccaattcaaaagtcagagactctagggttcttatttatccaaatgaacgtgcccttcagggtttaaactctctgcttccatctctcttcacttgctgagccgctaaaattctcctgagtgtttggattgagaagaagaggctcctgtgggagattagaaactgatacccttgagagaggacaatagggagctgccgacagactggctgacgaggcccggcttgggtccccagagaggtaggacagtgcagttggaagtaaaagcttttgatgagccatgagtttccttctgatctgtgggcaaaggaagccagtggaccagagaggcaccttaacgccgaacaatcaggaagatggagatgtcctggctcccatgccaactgctctgtgactctgagaagccatctagctttttgcagttcaattttctcagctgttcaggagaagtagactgcattcaagtataagactgtttattttcctgttattttgtttagccaaagatttgaagccattcaatcctctaacgagtactgtagtgatgcctaaactaagcaggattttctatattgcattacaaattttacaatctgagtgaggttgttttttcttcttttagtacagcagaaattgaaccttctcagaggagcctggaaactctaaattcccttctctgtttcttttcctttgcttctccttccctttcccctacatcccctgccaggtatgactctggaaaacagcattctgtaagcttgcttgggtaagggagagaagctgtggtatgtgctactgtgggagcagggagggggcagagtctccccttcaagaacaggatgggtcccattcagcccaggcctcctggctcctcacctgcctggaggttaggcagacagagaggttaaaagatggaggagtctgaggggcatggttgctcacacctgtaatctcagcatttgaggaaaccaagctggacagatcgcttgagcccaggagttcaagaccagcctgggcaacatggggaaaccccatctctacaaacacacacacacacacacacacacacacacacacacacacaattcgccaggcatggtggtgcatctctatactcagagctactcgggaggctgaggtgggaggattacttgagcctgggaatttgaggctgcagtgagctaagatcatgccactgcactccagcctaggcaacagagtgagactcatctcaaaaaaagaaaaaaagatggaggagtctgagaatgggggcgaggaagagtcaaggcaggccaggggtgtgagatgcagccaaagcctggacagcccccatgagtcgaactcctgcagctcctggctgatgtaaggaacatcgcaggggaaagaaagcaagactggcccagctttccaaagctgatggctgtgttttacttctcaatttaccctcatctcttgccagcttctctcctttttcacttccagacaattcatctctccgttttcctttccagccaaagtagttgctgaatatactgaaatttgattacattctctggccctgtcccttttgccagcaacatgcttccatctaaaagccctgctggagtctggctaccctttttaatttgctgttcttaccaaatgtcaccacacttcatgctaaaatatcctcgataatttttccactcactccttaaagctattgtctcccaacacttctgagctcaccattctattaacatgggcctcttgggaagcaccagtgatgttatttaatccagtgacctttgccaagtcttcctcccctttaatttctctggagcctttgatattcttaaccaccatcctgaaatatatttttttttccccttgactttcctcctatctgcttcccacacttccttcactagttcttttaattcccttaatgggagcatcctctgacattcttttcctctctcattctcttgagctgatttcatcctctggcattgctctagctcccccttgagtgtaatgatttcccaacctggaaggcccagtttcaagttataaaattcttgccaccaaaatcctgccacccaaaagtccatactatcggggcctagcttacctttccagccacacttttctcttagtttatttctggaaagtagtctgatacacttcaaagagcaagagtgtagagacaaagagatatgattacaaatcttggctctgctgtcaactggccacaagatcttaagcaaataactaacttctctgaaccttttattttctcatccataaggcaaggataagaatagtacttaaaagggatattttttacactttgagatagcatgtctggcacctcacaggtacttaatagccagaaattactattattgttataactgatgagtacagatcttttttttaacttttattttaagttaaggtgtacaagggcaggtttgttatgtaggtaaacttgtgtcatgggagtttgttgtacagattatttgatcacccaggtattaagcccagtactcattagttatttttcctgatcctctccctcctcccaagctccaccctctgaaaggccccagggtgtgttgttcccctctgtgtgtctatgagaacaacatttagctctcacttaaaagtgagaacatgcggtacttagttttctgttcctgtgttactttgctaaggataatggtctccagctccatccatgtccctgcaaaggatgtgatcttattcttttttatgtccacatagtattccatggagtatattgtatgtaccacattttctttatccagtctatcactgatgggcctttaggttgattccatgtctttgctgttgtgaatagtgctgcagtgaacgtatatgtgcatgtgtccttataataaaatcagttatattcctttgggtatatacccaggatttaaattgctaggtcaaatgctatttctgtctttagatattttaggtttccacaatggctgaactaatttacactcccatcaacagtgtataagcgttcctttttctctgcaacctcgccagaatctgttgttttttgaccttttaataatggccattctgactggtgtgagatggtgtctcattgtggttttgatttgcatttctctaataatcagtgatgttgagctttttttcatatgtttgttggccacacgtatgtcttcttttgaaaagtgtctgttcatgtcctttttatggggttgtttttctttaaattccttagaaatgctggatataagactttcaccggatgcatagtttgcaaaatttttctcccattctgtaggttgtgttactctgttgatagtttcttttgctgtgcagaaactctttagtttaataagatcccatttgtcaatttttgctctggttttgattgcttttggtgtcttcgtcatgaaatctttgcctgtgcctatatcctgaatggtattgcctatgttgtcttccaggatttttataatttcgggttttacttttttttttttttttttttttgagatggaatctcgctttgtcacccaggctgaagtgcagtggtgtgatctcagctcactgcaacctccacctcctgggtttaagcaattatcatgcctcagcctcctgagtagctgggactacaggcatgtaccaccacacgtggctaatttttgtctttcttcatagagatgaggttttgccatatttcccaggctggtctcaaactcctggcctcaagtgattcacctgccttggcctcccaaagtgctgggattacaggcatgagccactagggttttacatttaagtctttcatccatcttgaattaatttttgtacatagtataaggaaagggtccagtttcaatcttctgcatatagctagccagttatcccagaaccatttattttactagggaattctttccccactgcttgcttttgtcaggtttgttaaagatcaggtagttgtaggtgtgcaatctaatttccgagttctctattctgttccattgttctatgtgtctgtttctgcaccagtaccatgctcttttggttactgtagccctgtagtatagtttgaagtcagctagcatgatgcctccagctttgttcttttttcttggctatttgggctcttttttagttccatgtgaatttttaaatagttttctctagttctgtgaagaatatcaatggtagttgagtaggaatagcatttaatctgtaaattgctttgggcagtatggccattttaatgatattgattcttccaatctatgagcatggaatgttttttcatttgtttgtgtcatctctgatttctttgagcagtgttttgactacagctcttttaatgaagcaaatgctgtgcaaacatagattaatgaagcaaatgctgtgcaaacataggatactgtgggctggggaggaagctataggatccagcaatgcacagcattaactggggtgaggacacaggcaagagaatcccagcaaagattatagaggtagctctttggacagctctcgtattccttgtgtccatcctgttagcatacattctcctgccccacaccctgctcacatcctggataaaatccatcagggtggagaaggtctgacagtgagggctgggaggctgcccggtacataacctcagcttaaaccaatgtctatagaaactctacttctgggaaaaacaagtcctataaatgactatattataaattggcatcataaacggactaaagtacttcaatatctcaatagaatctttgtaataaccctatgaagtaggtactaatttaagtctgatttttaggatgagaaaactgaggcttcagattcagaattggcccaaagtcacaaattattaagtgacagagccaaacttgaacccaggtctgctcaggtgcagagcccagtgcttttctatttgcctctactgcctttattttcaggctgactgaaatatatgagcccaagttatgagcacgtgatggctcaagctgacattaaaattactggcatctgttctgtctatttccaggcagaatagaacctctcccattggcattataaagtaactcaaccacagaatcaaccctgctcaccaccaaacattcaagctaactatcagaaagttacgttatagagaaaagaaatgcttctgaagttaaatcacttccagagaaatgcagctgaactccaagcaagtgtggcaaaatattggttgaaactccctctagaacttgattgcataagccagaaggcacttaatccagctgtagtctttgaaaatgtccataacctcccaaaacaaaatggctgtggcctctaagcttttaaaatgtaatcatttccatttatgagtagagtcaattgtttcataattctaacactgtttacctaagaaccagtaaaatgcacaagaaaggaaaataggttttggagtcaagcagatccatgtcaacagccaagtctaggtactaagaaatcttacatctatatactctccagggctctcatgctcaattcaggtgaaggttgccatggacaggttttgttcatctatcccagtcaactagctagcagagacaacagagcatcaacggagtgaggtctaactcaaaaaccagagagctcttataccttgagcatttcacttttgcatcaatggtcctcatgcttttaaaatgtagagtcctttgaggatcagatggaaagtctgcctcctcttcccagaaagctctgcaactttggtgtcagacattcttggatttgaatcttggcatcaccacttaatagttgtgcttctttaggcaggctacttaaccactgaatgccttatgtccttatccataaaatgggggcagtcgtaatatgaatctcacagaattgtgataaggattaaatgggttgatgcattaagcactttatgtccgagagcagacaaggagtatagtgtggtcattagcaaggcaggctctggtgtctgaattgaccacctaccagctgtgagaccacttaactgacctgttctttggtttttccatttgtaaaataggtgtgagtcatagttaccaatctcatggggttagtgtgaggatgaaaggagctaatatgtgtaaagtacttacagcctaacatataagcattcaaaaaatcatagccattattaggatctcagtgtctggcacatggcagatatttaataaatggtaggtattgttaaattcagattacagatatctaggataggagccatgtcttctctcttcatggttctttcatggcccctcatatagtagtctgtatgtatattcttcagtatattgtatatacagtatcagttgactgactgatgcaactagctattaaaatatatcctaaatgattggctctaattgaaactaaaggaaactggtgatatggcccaagctatgactacaagtagtcatgtagtatataaacctaataaatgctggttaatggttcttatatttttctctacctgatatttccaaagcatcttttcaagcaagagtattgttttctctcagttggataagtttaaattgcccaactaggttcatcagacacattgtggtcattcatcatgcagagagaagggacccagatcactaaggaattgactgatccagaaaactacatccatttattccaggggctctcaaagtgaggcctctaggccagcaggagtctcctcaactgagaactgtcagaaatggacaatctcagacccacataggaactcttgaggtggagcccagcaatcccagcaatctgtgctttaacaagtggcactgatgcctgctctgatgtagactatgctggtcagtacttgagattcaggaagcaagtcagcccatagggaataccaatctcagagaaaactgtgcttccaaagagaaaaaggacctgggatagccctcctattaccaaaaatactcctctaattttagtagggccagggtctgctcatcattcctctgatggggtgtattagtctgtttgaacactgctgataaagacatacctgagaatggaaagaaaaagaggtttaatggacttacagttccacatggctggggaggcctcacaatcatggcagaaggcaaggaggaccaagtcacatcttatgtggatggcagcagacaaagagagagcttgtgcggggaaactcccccttatagaaccatcagctctcatgagacttattcactatcacgagaacagcatgggaaagacctgcccccatgattcaataacctcccactgggtccctcccacaccatatgggaattcaagatgagatttgggtggggacactgccaaaccatatcatttgacccctggtccctttcaaatcccatttccttacattttaaaaccaatcatcccctcccaaaagtcccccaaagtctcaactcatttcagcattaactcagaagtccacagtccaaagtctcatccaagacaacgcaagtcccttctgcctatgagcctgtaaaatcaaaagcaagttagttacttcccagatacagtgggggtacaggcattgggtaaatacagccattccaaatgggagaaattggccaaaaaacaaaggggctacaggccccatgcaagtccaaaatccagcagggcagtcaaatcttaaggctccaaaatgatctcctttgactccatgtctcacatccaggtgactctgatgcaagcagtgcatcagacacctctgcacctttgcagggtagagtacccctcctggctgctttcatgggctggcattgagtgtctgggacttttccagactcacagtgcaagctgttggtgggtctaccattctggggtctggaggacagtggctctcttctcacaggtccactaggcagtgccccattagggacttgttatggaggctccaaccccacatttcccttctacactgccctagcagaggttctccatgagggcctcacccctgcagcaaacttctgcctgggcatccaggcatttccatacatcctctgaaatctaggtggagattcccaaacctcaattcttgacttctgtgcacctgcaggctcaacaccacatggaagctgccaagccttgggacctccaacctctgaagccacagcacgagctgtaccttgaccccttttagtcatagctggagtggctgggacacagggcactaagtacctagactgcacacagcagagggaccctgggcccagcccacaaaaccattttctcctcctaaacctctgggtgatgggaggggctgccgtgaagacctctgacatgccttggagacattttccccattatcttggtgattaacatttggcttctcattacttatgcaaatttctgcagccagcttgaatttctcctcaaaaaatgggattttattttctattgcattgtcaggctgcaaatattccaagcttttgttctgttttccttttaaaactgaatgcctttaacagcacccaaatcacctcttgaatgctttgctgcttagaaatttcttccgccaaataccctaaatcatctctctcaagttcaaagttccacaaatctctagggcaggggaaaaatgccgccagtctctttgctaaaacataacaagagtcacctctgcttcagttcccaacaagttcctcatctccatctgagaccacctaagtctggatttcattgtccttatcattatcagcattttggtcaaagccattcaacaagtctccagggagttccaaactttcccacattttcctgtcttcttctaagccctccaaactgttccaacctctgcctgttacccagttccaaagtcacttccacattttcgggtatcttttcagcagcaccccactctactggtaccaatttacaatattagtccattttcacactgctgataaagacacacctgagactgggaagaaaaagaggcttaatggacttacagttccacatggctgggagcgcctcacaatcatgacggaaggcaaggaggagcaagtcacatcttacgtggatggcagcaggcacagagagagcttatgcagggaaactcccccttatagaaccatcagatctcatgagacttagtcactatcacaagaacagcatgggaaagatctgccccctgactcaattacctcccaccaggtccctcccacaacatgtgggaattcaagatgagatgtgagtggggacacagccaaaccatatcatgaggcaagcacaaatgccatgtgaaacctgctattcttctgtagacacttgtgtccagccagaatcagcttcaaaagaatagcatagatttgaaaaagggcagcagtcagtcttgggacattagaacatggggaattaactggccttgagtgaaagggaccacagggggaggtttggagctgacttatgaatatggatcctgtttcagcacctactgttgttaaagccccgtttctgtcccagagaaccaccctgggctcgattccctgcaccctaatgtagctctgtttttcatctgtgtgtctacttcaagttagactcaaaagtagagcaattatatgacattatgttcaaggcaaaaagtgacagagcaggcttcatgttgcatacaaatgttggcagctattgcaaaatcctcaccgcatatcctatggtaatcacttccttaaagtaagcaggaaataggttagtagtaggctgcttcaccaggagtcatttcaaatgtattgtcacctaaggtataacttcccaaagatggaaagagataaagccactgagtctgccctctttatccatctacagccaccaaggtaattacagtttttaaaaacgctactcatagttcattgctttcatatctaaagttaagagatctaaaagttcccccacatccccacttagcagtcatgactaaggtgaaaaaagccaccagtatcagcctggtctctcttatcagcagtttagaaagtactacaattttcccatctgactcacatctaaatgactcgcatctaaaatgtttttccttaattttccttccgtaaagagttcatttaaactctaatactgttgcttttcaaaaatttctaaagaaagaagcatcttggaacaatgtattaacttctgcatcaacttttatttcatataataattttatataattttttaaaggcagatgtgtgtttactttgagaagtaaaaatgttaacattgaaactgaaagcctgtttcagttttaaggtacttaattgccttacagcatataataaaccgaggccatcttgtccttcaactaatggagggagtgataaagagataggagcccgggaccctattcattccagttttcctttgtacttggtttactttggcaccatgcctcatgtgtattttacacttctttacattttgtacatccctgtatgacaaatacttgtcaaacaaaaactaaacagatttataaccccttaacttgaaatgagccaaaattgaactgccaaaactttatgacttcattttctttcatagttttccaccacattggttcaaacagacaaactccacttgaggtcaagcagaggtcatttcactttcattactaaaatataatttacaatatgccagacctaaacaagtttagcctaaagggtttgtataatgtaaaccatctgttcctcaacaatacagctaatttcctgccatcaccgtacagtctactgactgcttctttaagggtttttatgattttttaactagttcaggatttatgtaaaatttgaaaatgagtctatagttaggattcatttgtaccaagtaacttgagcaccttaaaaatgcaaatcactgtggaaattgttcccctgaaaccaagctaggagcattttttttctgggcacttctttgctggcagctgcacaggtgttcgaagggaagattttgtggactctgccattttagatgctttccatgcctctttgcaaagcaaaccccccaaatttagttttcagtagctctagtaaatgactccttggagaagacttgggattatatgctatatggcccactggatattggtgagataggacaagatacactttggggtaaaatctactttctttcatgtgtctgaacagggaggaagaacaattataattccatagagtgaccacatactgaaggctaacctagctctgtgaggtggcaggcctctcaggctgagcctccagagacattcggcttcaatctgggatcgctggccagcaggcttctctggtttcaaacagaatgctggggccgaaaaacagagagccttggagttgcaagtgtggctctttcggctctcctgaaaattcttgatactttctttagcccctttctccatctgtaaaatagcaaaattaggcgttctgtttccaaaggcaagtatatgagaacaaatttgcttacctcagtggaggggaatgcagctggccttcttagccacgaagccccaaggccatgtgtagggctgatgccaaggtcctgtccacctcttcctcttttcccacctccagaagtttggctggcttgcttcctttacccatctgctaccatccactcttccacacgagttcttgttgccttcaccttcattcacatctcagaggagccagctacaggccactcaacttctcacccaccctcaagctccaaaacaaattccctgtcatttttaaaggattttttttttttaactagcaactacaggagaacagagaaagattaacaggaagaaagttaaacactctgcaactacttaaggcttaaatggatctaaatcatttgcattactttacttcctggatgactttcctaataaggataataagaatgatttaaagggcacttattaggtgggaattacgttcatacatcgttgtatttaattcctactgcaacagctcaagctagatagtacattagttcatagatatggaaacagaggttcagaaaagttaagaaattcacccaaggtcagtgattaatattataagacctatgccacaggatcatggtgttaaataagttaatatttgctaagtgcttagaacattatctggcacaaagtaagtgctatgtaagtattaactattattcataaaaagcagcagattcaagatgcaaacccagatttataggagtccaaagctcacttagtttgaattatgccatactgcctatggatacttttcaagcagtgaaggaggagagggtattgggtttctaactcctcattataccagcctaatattccatgagtttacttcctaattcccattttccacaaagaagttttagtactcagtcccttaaagttctctgtctccaaaagcgtagagatcttatttttgtcaaaaagtaagtgatgtctactttgccattcaagggaccttcacctaaactggatttatttacatcattaggaaaagttctgatggaaatctccaatcttaatgtcatgcaggaaaaattcaccttgagttactcttgccagcaaaagtaaaatcatctgagtgctacaagacaaaaaaagtagggttggctcaactggttacctttctcatcacccacaccttgctctctcaaaggaattctacaagctcccacaagaatacagaccctaaaagcaaaaggaaaaatggtggatggacttacaattgcaaaagatatttcctagttcagtaagatgggaagattcgcctattgtttttttttttttaaaaaaatagttatttaatttaaaaaaatagtaatttaataaattaaatagttatttaatttaatatattcacctggttgaaaaattttaaagcatagaaaagcagaacctctgcccccctttttctagtttctacttccatacccccaataatcactgctatctatttcccaagtatcctttcgtagtttctttatgcttatacaaagaaatatgtttcatgtgttctttttctccttctctcttacacaaaagcagcatccagcattaactgttctgttgctttttatttttagctgagcaaaggattttgcagaccttcccataccagtacatacgaaacgtcctcattcttttttttcaaatgtggaatattctatttactagctccactgtaattgatttaatatattctctatagggacatggaggtcattgataatattttgctattacaaacaatactatattgaatagaactagatcaataagatttaatttactgaaagtttaaagcaacaaattaccattactttcagcacaagtaaactttctaaaactcatttccaaatataaacctcacaaaatctgctttgatgaacaaataagaccaatttataatgagacagtttatttgcatagaataattaatgttccaaaatccccaatcccaatttgtccttttaagtgagtattttgctgcaagtttatttacacttacaattaggttagtgggcattttgccctggaaaatatcagcctagaacaaatctaatcatcatgaattctaaattagtagagtttggataagagaacttttttaccaaattatctaaactgttgttttaaactctgtacagagagctctggatttcatatgtatttcaacattgtcagtttcagttagaattttcagggtagtattcttttttaaaaaataaggatttgaaggatggggattatttgaaaaatcagttgtatgtaaaatgcattgtttttattactttcttttctaacaaattaaatgaaacatcagactaaatttgaggtacattttaaaatagtaaaaacatataacattatagacatttacttgccaagatcaaatgtcatgattcaatacttattttcattgtgagctaatgccttcacctgtctgtcttaaggtcaattaataaacaacccacttgcgaagacctagggatatacgttggtatgaagggcagtgcttccaataagatttcccttgaaatctcgttgtgaggacaaaatacatgcataaaaagaacagaaacatcaagttgataataataacaaaaagttaaatagtacttaccatgggccagacataggtctgagtgctttacaaacattaactcataggtctgagtgctttacaaacattaactcattaaaagtttgcaataacatggtaagtacaattattatcatcccattttatagatgaaggaattgaggcacaaagttaaatgttgtatctggggtcacacagctggtaagtggagaaggcaggattccaactcagactggctatggaggccacttgtgtaaccagccaccacactgctttgtgtatgtggtggcattcacagtaaaggcaaaagagtctagcaaagaaatgaccatagtggtcagggaaggttttgcgggaagtggggcctgaaacaggctttttagaaaacaaaggatttaatcaatggagaagaccgcatttcagaccttcccatctctattgtgagtacttcagaaggacaatcttttgttttggtttctcttttagcacaataaatattcgaagaatggcagaacattggaggaacaaaagtattaggcaagaatgtaaatggtttcaggagtggacattgagaaaacctatttaactaaagtgatgccatcacacagagaagtagcaagggatcatgtcaggaaagtgagttaggaccagattacaaatgctctgagtaccaggctgtagcctctgtggtagtgcttctgacaccctaatcttcacagaaaccactggggtcttgttaaatgcacatgcagattcagtaggtctgaggtgggcccaagagtctgcatttgcagtaagtttgggtgatgctgatgttgctggtccccagaccacagtttgagtaccaagactctagacaacagcaaaaaaccattttgtggctgggttgagggaaagggatagggtagtgatggaaagttgtctatggcacctcccctgagttgcagccaacgatttgaaagatatatagacctacaatattttattgaatttgtttatagaacctttttctatatgccccgtccctcctttcggatgcaaagctgtcttgcctgaagatatgttttaaaccacgtttttcctctctttcatacagagcaaggctaaagagctacctctttctgctgtacgctttatggaagaattgggtgagtgtgcctttggaaaaatctataaaggccatctctatctcccaggcatggaccatgctcagctggttgctatcaagaccttgaaagactataacaacccccagcaatggacggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccagaaaaaaaaaaaaaaaaaaaaaacaagcaaacaaaaacattgtgggatgtgcactccattggagtgcatgacatggcattgggattggaacatgtggtttcgagcactgaaagctgcaaaccagtgaagaggaaaagaaccttgtgattaaatataaaaccaaaagtcaaatggtgctttgtgttttagccttcagtcaccatgactggtctctcccccagatgtatatataccatagcatttgtctacctgctgtcttttcttcaggacagatgttcaggaattatattgattgaatttagactctgtgcatgttcttatggaaatgatgttcagaatccatgaagaaacttcaggccaaatttgaaaccctggagggaaatgagccataagggaagtataacaagccctgaagccttttatgtcgttgtgcttctttgggaaggtgtagagtgtgcctttttgtgaatcctcctctgatcatgagggtctttcccacagtttctcacagtgtgtttacactgcccttggaataacacagcgcatcagaccataagaaggctagatgtggatgctagaattgattgttggttgatagttctctttgctggattaggaatgaggcgccaaaggaagcacagccaggaaaatggccccacagcctagatcagcatctgtgggaaaggaaaaagggttcccatggggacagcccccataggagttttctggaaccagtaacactgaaaaataagtgtgtggctacagatgagcacgcccaccccttgcaactccctgtttacaagttgtccgaggcattggagtgcttatggtcaatgggctctagggaagtaggaaactccatcatgatacaaatgtctagtaattttaaagtttctttccctttttttctgtgctggaaatgttcacagatttgattcccgccccaagaattacaacaatgtattcatacagtcagttggaa
